United States Patent
Da Costa Garcia et al.

(10) Patent No.: US 9,222,077 B2
(45) Date of Patent: Dec. 29, 2015

(54) ANTIBACTERIAL PHAGE, PHAGE PEPTIDES AND METHODS OF USE THEREOF

(75) Inventors: Miguel Ângelo Da Costa Garcia, Lisboa (PT); Carlos Jorge Sousa De São José, Lisboa (PT); Clara Isabel Rodrigues Leandro, Parede (PT); Filipa Maria Rodrigues Pardal Dias Antunes Marçal Da Silva, Belas (PT); Ana Raquel Martins Barbosa, Sobreda (PT)

(73) Assignees: Tecnifar—Industria Tecnica Farmaceutica, S.A., Lisboa (PT); Technophage, Investigacao E Desenvolveimento Em Biotecnologia, SA, Lisboa (PT)

(*) Notice: Subject to any disclaimer, the term of this patent is extended or adjusted under 35 U.S.C. 154(b) by 146 days.

(21) Appl. No.: 13/823,519

(22) PCT Filed: Sep. 19, 2011

(86) PCT No.: PCT/PT2011/000031
§ 371 (c)(1),
(2), (4) Date: Oct. 28, 2013

(87) PCT Pub. No.: WO2012/036580
PCT Pub. Date: Mar. 22, 2012

(65) Prior Publication Data
US 2014/0079671 A1   Mar. 20, 2014

Related U.S. Application Data

(60) Provisional application No. 61/384,015, filed on Sep. 17, 2010.

(51) Int. Cl.
| | | |
|---|---|---|
| *C12N 7/00* | (2006.01) | |
| *A61K 35/76* | (2015.01) | |
| *A61K 38/47* | (2006.01) | |
| *A61K 38/48* | (2006.01) | |
| *C12N 9/36* | (2006.01) | |
| *C12N 9/50* | (2006.01) | |

(52) U.S. Cl.
CPC . *C12N 7/00* (2013.01); *A61K 35/76* (2013.01); *A61K 38/47* (2013.01); *A61K 38/48* (2013.01); *C12N 9/2462* (2013.01); *C12N 9/503* (2013.01); *C12N 2795/00032* (2013.01)

(58) Field of Classification Search
None
See application file for complete search history.

(56) References Cited

U.S. PATENT DOCUMENTS
2010/0172918 A1   7/2010 Yoon

FOREIGN PATENT DOCUMENTS
| WO | WO 9739111 | 10/1997 |
|---|---|---|
| WO | WO 2002/076483 | 10/2002 |
| WO | WO 2003/080823 | 10/2003 |
| WO | WO 2008121830 | 10/2008 |
| WO | WO 2010/041970 | 4/2010 |
| WO | WO 2010/090542 | 8/2010 |

OTHER PUBLICATIONS

Chica et al. Curr Opin Biotechnol. Aug. 2005;16(4):378-84.*
Sen et al. Appl Biochem Biotechnol. Dec. 2007;143(3):212-23.*
Chhibber et al., "Therapeutic Potential of Bacteriophage in Treating Klebsiella Pneumoniae B5055-Mediated Lobar Pneumonia in Mice," J. Med. Microbiol., 57, pp. 1508-1513, 2008.
Tecnifar-Indústria Técnica Farmacêutica, S.A. And Technophage, Investigaçãao E Desenvolvimento Em Biotecnologia, SA, Search Report for Singapore Patent Application No. 201301938-5, 6 pages, Nov. 11, 2014.
El Solh, et al. Update on the Treatment of Pseudomonas aeruginosa pneumonia. Journal of Antimi-crobial Chemotherapy. (2009). vol. 64. pp. 229-238.
Rossolini et al. "Treatment and Control of Severe Infections Caused by Multiresistant Pseudomonas Aeruginosa". European Society of Clinical Microbiology and Infectious Disease. 11 (suppl. 4): 17-32.
"Pseudomonas phage LUZ19, Complete Genome," Nov. 27, 2007, retrieved from GenBank Accession No. AM910651.1, http://www.ncbi.nlm.nih.gov/nuccore/161168305?sat=43&satkey=10346167, 18 pages.
Technophage et al., English translation of the Notification of Reasons for Refusal issued for Japanese Patent Application No. 2013-529096, dated Sep. 14, 2015, 7 pages.

* cited by examiner

*Primary Examiner* — Christian Fronda
(74) *Attorney, Agent, or Firm* — Margaret B. Brivanlou; Nicole Fortune; King & Spalding LLP

(57) ABSTRACT

The present invention is directed to the field of phage therapy for the treatment and control of bacterial infections. In particular, the present invention is directed to the novel bacteriophage F387/08, F391/08, F394/08, F488/08, F510/08, F44/10, and F125/10, isolated polypeptides thereof, compositions comprising one or more of the novel bacteriophage and/or isolated polypeptides, as well as to methods for the treatment and prevention of bacterial infections using same, either alone or in combination with other antibacterial therapies, e.g., antibiotics and/or other phage therapies.

19 Claims, 758 Drawing Sheets

Fig. 1B

Figure 1A:
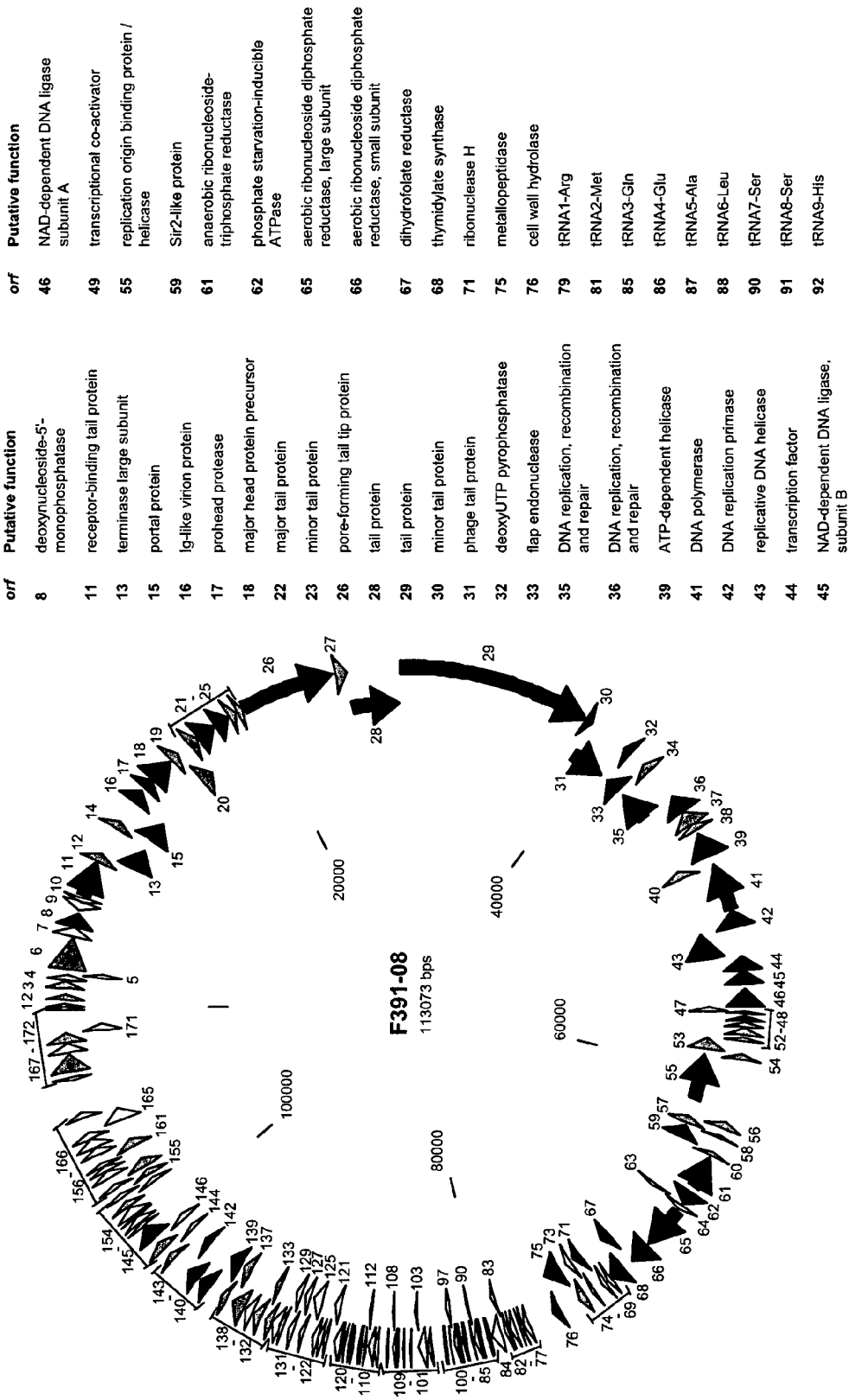

| orf | Putative function |
|---|---|
| 93 | tRNA10-Arg |
| 94 | tRNA11-Gln |
| 95 | tRNA12-Met |
| 98 | tRNA13-Ile |
| 99 | tRNA14-Met |
| 100 | tRNA15-Val |
| 104 | tRNA16-Asp |
| 105 | tRNA17-Asn |
| 106 | tRNA18-Cys |
| 108 | tRNA19-Lys |
| 109 | tRNA20-Phe |
| 113 | tRNA21-Leu |
| 114 | tRNA22-Pro |
| 115 | tRNA23-Thr |
| 116 | tRNA24-Gly |
| 119 | tRNA25-Trp |
| 139 | deoxynucleoside-5'-monophosphate kinase |
| 140 | ATP-dependent Clp protease |
| 141 | holin |
| 142 | lysozyme |
| 144 | thioredoxin |
| 147 | serine/threonine protein phosphatase |

Table 1 - Features of phage F391/08 gene products and assignment of putative functions.

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 1 | 52 | 240 | 5 | MKRFVISSKPAAKLNKMASSELVK MQRDMARRYRSYQRGGQQGLPMI WDNMMRYLKSLQNNV | 62 | Hypothetical protein T5.008 [Enterobacteria phage T5] | YP_006836.1 | 4e-04 (23/54) | | No putative conserved domains have been detected | | |
| 2 | 408 | 668 | 6 | MQNVKTPMIGDSVFIPFVTGDVSKP GENEKIGYIKGAAMIPFDKINAVYAE TEKAKNSDAKIYSVRVDSGDVVKVI RKDDKWLAVA | 86 | Hypothetical protein AGC_0006 [Enterobacteria phage EPS7] | YP_001836929.1 | 8e-18 (53/87) | | No putative conserved domains have been detected | | |
| 3 | 1007 | 1411 | 7 | MTATKTEKFAWNETNAATAVEMYE KIIASDGLEVANSQGLIDIAKAVGAE SHVKVRSKLVSAKVYQKSDKPRKV GGGSSLRKAHYVRVLTQHAIADGLI DDADGLASLEQMKLDQLDVIARMV GVQDEVKESAE | 134 | A2 [Enterobacteria phage T5] | YP_006834.1 | 8e-44 (88/133) | | No putative conserved domains have been detected | | |
| 4 | 1479 | 1748 | 8 | MALIKGSVIKLTGTVVDELIQTGYQD NKVMTPPSVKVPEYIVLWVNPDAD TFGMAINREVFKPEMLELSSREIYLL NYAFSVEEKEVVK | 89 | No significant similarity found. | | | | No putative conserved domains have been detected | | |
| 5 | 1745 | 1972 | 9 | MIFFPTESLILIAGFFAAACLYGYYN FMEIGSEQTDLLRRDFWFKKASICR RWSIIFIILAVTFGISASIIPAIV | 75 | No significant similarity found. | | | | No putative conserved domains have been detected | | |
| 6 | 2056 | 3732 | 10 | MIIAIEKQKAILTAANNLNFWGKRLR AKKLEICDELSKEHYGTAKHSSEIC DWLDSNKPVKPAAEKRAQRVAVE DSRPVAAGQLNSSVESWKVIPGRR FLLTSIQNNTFPHANFWKTLQEAAK YLGATLLVSKYAYNKKGFQNGQGN DELKYDDAFSDFICDENVFLGNRET GFAFMAEINILPTADFPLSGFGETAT AYGLKGLAIGHAKITAESVPAMKGD TVRRMYSTGTATLKNYIQQKAGQK AEALHNYGALLVEIDDNGNFFARQI ETMDESGMFYDLNHKFTVNGGEE VTGHVAALQYGDIHAEKLDHAVAFA SWGPCDDSLVNVLRPRYQIVHDVH DFTSRNHHNRASGVFLAKQYAAGR DKVIDDLIDTGRVLEAMEREFSQTVI VESNHDLALSRWLDDSKANIQQDP ANAHLYRLNAAIYEAIENKDDTFN VLDYALRNVAGCDFAAIFLTTDESM KIAGIECGSHGHNGINGARGNPKG FRKLGKMNTGHTHTPSIYGGVYTA GVAGSLDMGYNIGASSWSQTHLIT | 558 | A1 [Enterobacteria phage T5] | YP_006832.1 | 0,0 (402/559) | | No putative conserved domains have been detected | | |

Fig 2A

| | | | | | | |
|---|---|---|---|---|---|---|
| 7 | 3801 | 10 | YENGQRTLIDFKDGVFFA | 150 | No significant similarity found. | | | No putative conserved domains have been detected |
| 8 | 4253 | 11 | MKLTFIYNNRKSFTASNVVENSLVIS RDSEGRPHVSYQKVNTVDGDTVLK ALAAILPRPAEFKESGIVSQLVAADS ILYEADICEIVEIDAAAAGLMFIVVSE NDYDDTYLLGDVMDYSSSEYTPPL AIVPVMATRIKPAELADALTLFF | 238 | Deoxynucleoside-5-monophosphatase [Enterobacteria phage T5] | YP_006829.1 | 2e-81 (142/231) | deoxy-nucleoside-5-mono-phosphatase | No putative conserved domains have been detected |
| 9 | 4327 | 12 | MAFNKLAIKAIKLWDLDGTVINSFAR VFPCMDDKGNLDLNMYREKACVH DAIMTDTLLPLVEYMRASLNDPTVL NIIVTARYMGKSDYYFLRKQRIRAG RGGNIQILSRDVLHRYIGDADYKEV YYSKDGIYKTHYFEMLKAEYPNATI TMIDDNRGVLAAAAAGLQTMDAT AINDILSIGVRLAGESFIDEALDDDN DYQYLCERLAHCWEGMTEEERSD YGIKPQQFIQSLAIAS | 153 | No significant similarity found. | | | | No putative conserved domains have been detected |
| 10 | 5199 | 13 | MTIVLIFTTFFFLAAVWFGVRAHDLR NAVVAADLRNKSLHQEILQTRAER QVAISKHQRVMNDLRNDPSNPYYI PPVTPQVAKRKQKRAGSDNSRKVS GSPSSNSGSSRSDDGSTAAIIATTA AVATYSGYDSGSSYCDSGSSSSSF DSGCSF | 74 | No significant similarity found. | | | | No putative conserved domains have been detected |
| 11 | 5664 | 14 | MEVVIGALVLLSIVLFVITVKQGKAIK QLERTNGVLQKSYDNQTRLLHKAQ LNLSECKAELESANKIYITKGMV | 658 | Receptor-binding tail protein Pb5 [Enterobacteria phage T5] | YP_006985.1 | 1e-127 (269/674) | receptor-binding tail protein | No putative conserved domains have been detected |
| | 5888 | | | | | | | |
| | 6002 | 15 | MGFYAGRIGDKKVLSLTSGNNKDV NNHTNPGWDTIFHSDMPHVVVLET HERDLWDGGDWYRCTRMPDRIIQ VLSADYDRVVLTEVEFEDGTRRFIY GTSLGVGAKAYNAYFSNTVGSQAS AGTMASMKTNVCASADLHMDISFY FEETPGTINEKLRDGTGCMYTWGV NSEWGDRGPGPPVGAPIRPNFETII KAGWVLYRGAFSGNIAGSVSPPNR PLTIGVDAMRHPWMRTTGVNSICL RGETLNRNMYGHMGPRYGQSSNP VGGPYAHNIQTESYQEVQYKAGFF RGPPNNFMGWENTDNNNAGSGW GNNAIYRDNNFRVPKRVRWYITNM KYNGQGFYAENVFGSRNQEIKISP REFIVNGINLMNTGWKFINQNDINY SPGNRPDIRVIATNVARFSGNPTVG NNGYVHFNQPLTRPDNGAEFGQG NVSEMHVTTVGVYNFRSDAQWYV KSNPPEIGNQWGPVWSESTRPLRL VGGTGSADIGGNLRTSGNASHHLA | | | | | |

Fig 2B

| | | | | | | | | |
|---|---|---|---|---|---|---|---|---|
| 12 | 7989 | 8462 | TLWLGVNNSRNGACVVTLDWKND EWIAAAGIGCYNPLEDLTQWSEVD SRLRIFGNHFQKRVHQIMCLPVNM CVPFHFIRGTVTQCGVIPGNNAMQ MKAMWAPTTTNSATQGDYAIIYWLI ARADGSVEVWVNVEMSNIMNMRVI LPEVRIAVQRLA | 16 | MSNDLIVPDTMSPEGMLVIEAYLES GSDVAKAALAVGMEEPKFREIMRK PEVKAYLTDIFMESGFRNRDKFFGI LDTVLTMKMEELDETGMGSEMDIM DILKLMHKMKMDEMKMQIEYEKVK QAKAPIHQNNTQINLAGGHDSNYT DLLSRIVGAGK | 157 | Hypothetical protein T5.156 [Enterobacteria phage T5] | YP_006984.1 | 2e-42 (98/159) | No putative conserved domains have been detected | |
| 13 | 8462 | 9778 | | 17 | MEISRSYINTTDVVDFGVDKRFFKF PVSGLLATEGIVPNGPQCAIINALED PRHRFVTACVSRRVGKSFIAYTLGF LKLLEPNVKVLVVAPNYSLANIGWA QIKGLIKKYGLQTERENAKDKEIELA NGSLFKLASAAQADSAVGRSYDFII FDEAAISDVGGDAFDIQLRPTLDKP NSKALFISTPRGGNWFKRFYEQGF REDLPQWVSIHGTYRDNPRVSLADI EEARKTVSKNYFKQEYEADFSVFE GQIYDTFSVSEHVQDLAGMGHFFA ADHEFETILGIDVGYRDPTAVLTIKY HYDQDVYYILEEYQQAEKTAQHA MYIQHCIDRYNVDRIFVDSAAAQFR QDLAYEHEISSAPAKKSVLDGLACL AALFQQGKIIVDASCTALIHALQNYK WDFQEGEEKLSREKPRHDANSHL CDALRYGIYSISRGK | 438 | Terminase, large subunit [Enterobacteria phage T5] | YP_001837088.1 | 0,0 (393/438) | Terminase_6, terminase-like family | pfam03237 | 2e-24 |
| 14 | 9970 | 10452 | | 18 | LASNVKYKRDAISIMRDGIKAQYKR GNCCAICDSQENLELHHYSTVALLV KNFAKEFQLDFTDSEVVLSNRDKF YKHYWHELVEDTVTLCVFHHQTLH KVYTKEPPLLFSANKQKIWVEKQRE RCMNPEAPRTSNTGERSGFAKWL PTDVKTEKSGFARFL | 160 | Hypothetical protein T5.153 [Enterobacteria phage T5] | YP_006981.1 | 6e-53 (95/145) | No putative conserved domains have been detected | |
| 15 | 10452 | 11663 | | 19 | MAIRDWLVTKLNRGQRIIRDLEDVS HRTNVKPFTTGKAYSSIEILNRSAN MVIDSAAECSYTVGEQYKTITTYGTI RSKTLETLLNVRPNPYMDSSTFRRL IVSDLLFEGCAYIHWDGSSLYHLPA ALMEVKADDKKFVNKFVFNNMIDY RVDEIIFIKDNGQNGGINSQITGQSR VATVINSLTKREKMLEFKEKFLDNG TVIGLILETDEILNKKLRERKQEELQ | 403 | Portal protein [Enterobacteria phage EPS7] | YP_001837086.1 | 0,0 (314/396) | Phage portal protein | pfam04860 | 3e-23 |

Fig 2C

| | | Sequence | | | | | | |
|---|---|---|---|---|---|---|---|---|
| 16 | 11660 | LDYNPSTGQSTVLILDGGMKAKPY SQISSFKDLDFENDIARFNKDVCIAL GVPQLLIDGGNNANIRPNIELFYYM TIVPMLNKVCSSLTFFFGFKVTPNT KDVVALTPDKEKEAKFVTALVNNGI LTGNEGRIELGYEELADEQMKKIRI PANVAGSATGVSGQEGGAPNKDE EKQ | | | | | | |
| 17 | 12379 | 20 | MIDYKALKALFPNGLPEAHNVFATV KAHLTYQILRKEYGYAATNSKTWD QFKEAYAEATKPVPVASVSITGAPA SLDYTKTVQLAATVLPTNADNKTVT WKTSDATLATVSSTGLVTALSKAGT VKITATAGGKSSEVSIQVKAPVVAV TGVTMSPKTITIEAGKTGKLTGTVA PANATNKSVTYTSADTTKATVAAD GTVTVPANLAADSTVVITVKTADGN KTDTAIVTVKVPTAGV | 239 | Ig-like virion protein [Serratia phage KSP90] | BAH15178.1 | 8e-21 (84/186) | Ig-like virion protein | Bacterial surface proteins containing Ig-like domains | COG5492 | 7e-07 |
| 17 | 12576 | 21 | MQNINLNAEIKSVKAVGEGDNPPLK IKGYANTITKDRAGDVILSEAWTTS NALKNFMKNPIMLFGHNHSRPIGKI LDLVPTESGLMVEGEVSAADLQIYS LIRDEVLKTFSVGFYIKDAEWDDMT ETFIIKDLELLEISVVSVPCNQDSTF SLSKSVNHNDYMELRKSFVKSSQV QPVEQPELSNLEKFLVAAGYAKG | 198 | Putative prohead protease [Enterobacteria phage T5] | YP_006978.1 | 4e-60 (117/196) | prohead protease | Peptidase_U 35, caudovirus prohead protease | pfam045 86 | 2e-25 |
| 18 | 13186 | 22 | MSYDIAQLSKDLGLGDIAEQLKGLT ASQIKAEEARKFAAEQEAKELKRME DLVAKATGEDRKNLAEALELVKNLD EKSKQSAEAFVKAMNSQQEEITGL KEEIKSLLAARENGRSFVADGVAKA MFGKQEDFEDEVEKLVLLSYVMQK DVFGTKRGEAHLKAVNGSSSIEVST EAYETIFSLRILRDIQAKLIIGTMFEE LPMSSKLLTMMVEPEAGEASWVDA STYGTPATVGAEDKTKLSEITFKTY KLAAKAYMTDETEEDAIFTLLPIMRR RLIEAHAIAIEKAFLTGTGAAGTPKG LIQFAKDDGKVVATTAKADGSVKVT AKEIHKLRRSLGRHGLDLNKLALVV SMDAYDLIEDEEFQDVAQVTATTA IKLQGQVGRIYGLPVLVSEFFPAKA ASAEFCVVVYRDNIFIVPRQRAITVE KERQAERQRDAYYVTQRLNLMRFF ENGVVAGAYAA | 460 | Major head protein precursor [Enterobacteria phage EPS7] | YP_001837083.1 | 0.0 (325/460) | major head protein precursor | | | |
| 19 | 14627 | 23 | MQFMTDSDWRTYGGLKRPDLESNI PMLIKAANALITQLLGIDDTANVVDV LPTKPARKKYFLSSPVPSTITKITIND | 170 | Hypothetical protein T5.148 [Enterobacteria] | YP_006976.1 | 3e-65 (115/170) | | No putative conserved domains have been detected | | |

Fig 2D

| | | | | | | | |
|---|---|---|---|---|---|---|---|
| 20 | 15139 | 15900 | 24 | QEIDKSQYKNYPDGTLLLKFSPPEG YMEVEFTQTGFTSIPDDLVLAACFL VDHWVKKDYRESRTFGGETVTFNT TKSGVPEHIRTIIEVYRRL VALGDLARQIVKEQLDIMSGGSHST KNTVIYSAETMDNHKDGTIGKVSFR FTKPVSEDLLNVRTSSILKAVSSSLN LEGDVGVIDNLLNSITGKKSKIGRKR STGRVEVNFGDPSDADNGYAGAIS GASGRFVSNTNLRALLELVAKEYLV KDMKKAGAPLKFRTGRFANSLKIKD VLLREDAGAKTPDLNITYNYMLKPY SVFNPAVSTYRGLSLRPFPGARNP QKLIGEAIAKAARDLIHSRYRIRVNQ GT | phage T5] Hypothetical protein T5.147 [Enterobacteria phage T5] | YP_006975.1 | 1e-106 (185/256) | No putative conserved domains have been detected |
| 21 | 15900 | 16385 | 25 | MNYRTSIADALVERLKKDMDGSNP TEFFTNMYGNVSRQTYSFEQINEF PYIAVHVGTETGNYLPSAQQWVYL EIPILYDKEKDDINMQLEKLIADVKT SIDTGGNLQYTIMKPDGSTIDSEAT DMQITSVSTDEGILSPFGFAQVNVT VRYMPLRRALDR | Hypothetical protein T5.146 [Enterobacteria phage T5] | YP_006974.1 | 8e-66 (113/161) | No putative conserved domains have been detected |
| 22 | 16409 | 17536 | 26 | MSVQLLRNTRIFVSTVTTGFTKANT QEILVQDDVSWSQDSNSTDITLNEA GPKPTRGSQRFNDSLNAAEWSFST YILPYDDAGKQILPDYLLWHGLATG AAVNLAGTTGVFQNATNLVVNFKD NGYHELAMLNIYILTDSSWSVIRNC QVGQAEVNVDIDDIGRVTWSGNGT RLETLASQPFDPKTIGIDDALYAKIQ SSYIKNKLTILKLKNNATGGKTYNIPI TGGSFTMNNNVTYLTPNIMSRVDV PIGSFTGSFELTGSLTAYMNDAANG SIQLYKDLVSDLKAVNDFEVAIILGG EYDTARPAAVLVAKHANLNIPSIETD DVLGVSIEFKAIPTQMDAGDEGYLG FSSKYTKTSIAKLISSGDGNPVTP | Major tail protein [Enterobacteria phage EPS7] | YP_001837079.1 | 9e-164 (276/377) | major tail protein |
| 23 | 17546 | 18433 | 27 | MLYSLMRESRVVIEYDGRAYGFDA LSDYTAGTSYEEFKANRRTIHRRSN YAYSKITAQSPSSISLTLNFSSNALE GLFFELMGFIEIDGMYQMPLFSNNI EPKMFSVYIINKNTSLRFDNCFATT CDFSLDKSVPVLNVGIESGYFEEVG HPLNSYTLDQGEVLPFSLPQVSSN GRVLPGLMSAGMSFQQQCEWRG DRSLFDINKIYNNRRAIVNELNSSAL ISMYYAKSLQIDSTHNIKPDIGLPVQI RNKYIVDFPSTRITKRLDLTDVYKI | Minor tail protein gp24 [Enterobacteria phage BF23] | BAA02256.1 | 6e-95 (171/296) | minor tail protein |

Fig 2E

| | | | | | | | |
|---|---|---|---|---|---|---|---|
| 24 | 18437 | 28 | DYDVIPTEQSDPVRIKLIGE | | | | |
| | 18859 | | 140 | MSINLKDIALDTKQITIAYPGLPHFKL KVNYVSRKLSKKILEAAQENQFVNG IAVKVQNDDKFAEEFVKVAIAGWEG LTVADVEKLMLIEVPEDRLEDKVEF SIDNAMMLVRNSSAFETWMNSTVF HLDTFRGSKSEPTA | Hypothetical protein AGC_0154 [Enterobacteria phage EPS7] | YP_001837077.1 | 5e-42 (79/134) | | No putative conserved domains have been detected |
| 25 | 18933 | 29 | 108 | MCESLGEEPNPEVLKRFVEIHDFPE IAQTALTIYNNLSDNYIPGDYPTYLG KDKSALLVFFDIYGVEDADEKSLILQ IINIFDSHAVAASRKRVEAAIKKSKM KSSSR | Hypothetical protein AGC_0153 [Enterobacteria phage EPS7] | YP_001837076.1 | 2e-25 (56/95) | | No putative conserved domains have been detected |
| 26 | 19343 | 30 | 169 2 | MTDRLIRELLVDIKQRCGGSKAAKQI RDVEAALDGAAQSSEGLNTSLGKL PGSFTALERSVSRTAKSLEKLSSTT SITALAASIGMLSGKFTSFEVDLAKS VLKINANLNGVTSAANKMASGFDTA ATSSVADLNRVNKALQELDAHASS VAKVLQTLKAGAGLESISSSAAKAS TDLSHLVSGVEKIGNQLARMAEQA VLAGRSLQGLKADSLGAAGEHLSK AASGISVAVSSMGEEVNKLINKLLE LAVKADLASKSIANIAPGTKLNSLGT EIQKINTSLATAANTSVAEISKIKAAL TSLVSSTATAAASMKTVGTGSGLS KLISEISAATSASTSDISKVTAALKQL NVDATAAGKALQSIKAGANLSSVPT VVGKIGTSMTQLRAQLEGSVTGIEK SLNDLSRAFATMGGTGNLNPLGNS IRGMIPSLTQLAKAAVQVNSALSKIQ AGRGVLQLPTQFKAVTASLNALETK LASTSQILERGFSKGFQDMASKSTS SSTRMINNFQKVVPELNAIEAAAIRS AAAIDKLIAKRIRLGQAGGGGNPAA FNMGALVAEMNRIVTSIEAMGNKM NTTMADMARSTDKVSDKLTDLNSG VRDVNTGLGGLNSTLTGTGSAANR ASRALGNTSGSARGATRNFAALAM VTGPMPLIYGAIASNVYVLKAAFDQ LKLGDQLNRLEQFGSIVGAKTGTPI QSLAVALQEATGHAVSFEEAMRQA STAAAYGFDAKQISEFALVARRAAA TLGVDMTDALNRVIKGVSKQEIELL DELGVTIRLNDAYAEYVKILNAANT GITYNIQGLTSFQKQQAYANAVVAE STKRFGYLDEVLRATPWEQFAANA DSALRKVQQAAAKYLGPVIASINAA FYTSKASVSAEAATAQQESIKQMD | Pore-forming tail tip protein Pb2 [Enterobacteria phage T5] | YP_006968.1 | 0.0 (626/1196) | pore-forming tail tip protein | SMC_N, RecF/RecN/S MC N terminal domain | pfam024 63 | 4e-05 |

Fig 2F

| | | | | | | | |
|---|---|---|---|---|---|---|---|
| 27 | 24536 | 25150 | 31 | GKDSNAVVMNLEASQKGLDDAVKA KEEVKNKLAALNKEIMDREAKMDM STALATAANYSGFGNLLTLGASKAN KEFTQQTADMRRQAYMLQQELAD SAGAIQKWKDARDSALSKAQKENP ELAGKLNIGQNVEASNGLYTFDNAA LDGAVALRKEFNNIKKTSGDLSNDI QNFAQDSNTASRATAALGDALKAV ESLAGGSTEKANQMTKDLNLGYST VTEMNTAYKAMSNYQKIVNDEAKS KLDVEKRIAEVYAATRNKDKAEEAG RALEMQQLSAKKEALKAVLATNKD NKAIQKELTLLETEELKVKNQGMEA TKKEKFYKDKIVGIDREIALLNNRTM TDSQYNVANLKLNLQVEKDRLALLK TQADKEKEAEQSRRNIASIEREIWK EQLDRNAKTAEMRKEEFERNQSM KPLMGESQKMQEQLAFYQEMKEF TKGNADEQARWSKEIANTTAQMAA LKAQRTAQMMDRVGQSLGADYTP TTGLEGEDKKFADMENQMASYDTA IGKLSQLNSEATATAQSMGNLANA MIQFSQGSLDTTSMIAAGMQTVSQ MISYGTNQQISAIDAAIAAEQKRDG KSEQSKNIKIKKMEAEKIKLQQESAK KQIIIQTAVAVMQAATAVPYPFSIPL MIAAGLAGALSLAQASSATGMTDIA GSGGETASYLTLGERQKNVDVSM GANAGELSYVRGDKGIGSANGFIP RAEGGNTYPGVSYKMGEHGTEVA TPMVPTKVTPADKVASETSSGGAR RPVNLNIQAMDAKSFMEYALENPA AFQAAVELALNEQGLSLKNLN | 204 | Hypothetical protein T5.139 [Enterobacteria phage T5] | YP_006967.1 | 6e-76 (130/204) | No putative conserved domains have been detected |
| 28 | 25147 | 27993 | 32 | MRLPDPFTHPQYNGLGFDKATLID NDPVIRDELPNGKVNEVKTATQYW GLNISYPVMFPDEYAVLSSAILEYK RTRGYLDVILPHYESYRVRGDANN CRIAAGQKGSTLVITNTNSLSGEPK PGDLFQLTTHPKVYKITSFKNVAGV WTLNLYPDLLLTTNGSERPRFNGIL FQTKLMNGDSFSEEITVDGVYDGV NLVLRESL | 948 | Tail protein Pb3 [Enterobacteria phage EPS7] | YP_001837072.1 | 0.0 (681/949) | tail protein |
| | | | | MRQILPSAKAYLANNDKIRLAYLVSI ELPGSTGNNAVYAYMTDYMRDINY GGILFQSGKIKTISSHKQNRTLTVGS LSFSVTGTDANEVIKLVQSGVSFLD RSISIYQAIIDDNGEILPVDPDTNGPL LFFRGKIVGGGIKESNTVSGVGTSV | | | | | No putative conserved domains have been detected |

Fig 2G

| | | | | | | | | |
|---|---|---|---|---|---|---|---|---|
| 29 | 27994 | 38385 | 33 | ITWNCSNEFYDFERVAGRFTDDAS HRGLEIVNGELLPSHGAKRPEYQE DYGFFHANKSVNFLAKYQVKEERY KLESKKKLFGLSKSYSLKKYYETVT KEVDLDFNLAAKFIPVVYGTQKVPG IPVFADTERNNPNVVVVYAFCEGE IEGFLDFQFGDAPMICTDQTDSTSR TCFGQKRVSGDTMARISTGLPSTS LSTHGQEYKYNDGNGDIRWTFHG KPDQTVATVLRDIAAANNFFLQGEN GNGPEYWDSRYKLLDTAYAVIRFTI TENRTDIPEVSAELSGRKVKVYQAD GSVKMDKTSQNGVWQTFDYLTST TFGASIPIDRMVIGDWRKEADLLNII DTSYQTSWQPFWRYVGWESWTA ENRQIMQMNTILDNSNSVFKNVQE LLESFQGALNNLSGIFRITVEKDSKT PLELNFLDTYGDLDLSDTTGRNKYN SVQASLIDPTLNWKTNSITFYNSKF KNEDRGVDKKLQLSFANITNYYTAR SLADRELKKSRYSRSLSFSLPYKFL GIEPNDPVVFTYDRYGWNKKFFLV DEVENTRDGKINVTLQEYGEDVFIN STQVDNSSEAVPEISNNVLPPRDFK YTPTPGGMVGDVGKNGELSWLPS LTPNVVYYSIRKSDRVDPYIVQQTA FTPNVRMFQDIVGEPAGLTIFEIRAV DINGRRSSPVTISVDLNSAKNLSMV ENFRVLNLAPDPAEWVGPDLELGW DKLQEEGLISGIFYTLEIRDNTNKLL RSAKITSLYNYSYLLGYNKLDYKAN NSNTLGIYRALQPRIQAEGPKGEKS VAWAYI MISNIAPAKMVLQNIVTGYTIASIQH SIFSDYDVIGRTFWLTTGGVTTRRD FTGVDTFIATINNLIAGATYSAQGAF YDSMVDAELMAAKVGMNLSSTINF KMKTAPKITKVSSFAESVDVGVGAP MVVVELSGEAEYVTIEMKPEGSST WTKYYRGPITEQIIFGGVPVGRYNI RVSGVVTMPDGVTVDVSGYDTWP SLFNLTYNFTPPSAPTNLRFKTAHI QDGMERFDVRLEWDWTRGTGAN VREFIIQYISNDEFAKTGWTKANKL NVGAAKAGTITSFPYKIRHRFRVLS VAWGPDTQSITNSNEVTYIIDESTTF DNAFINETGVEMTYAGIKGKLWNS NTKQWEQTFLVDAATGAVVLGTLD | 346 3 | Tail protein Pb4 [Bacteriophage T5] | AAP75894.1 | 0,0 (338/580 )675 | tail protein | Collagen triple helix repeat (20 copies) | pfam013 91 | 2e- 05 |

Fig 2H

```
ENGKAPISFDPVNKIVNVDGKVITK
DINAANVILTNLTGKDNPAIFTQGKK
YGNNAGGVWMGVDNVDGKAKFDL
GNNTQYVRWDGDTLRISGNVIGT
PGGDVDLETGMQGKQTVFAYKLG
TSLPSRPLDQVYPPAGWSAFPPNR
TAQNQNVYVVQGTLDPKKSPPALV
DGTNYSAASQWSGVPGTGGTDGS
NGDYTVQIYQISASKPTKPGNINDP
SGWSRTPPTGTPLWMCSGRFNGD
TNALTVEGWSDPIRVDGEKGATGA
TGATGPQGPQGPAGGSVEVQWSK
DGTTNWHANFTTGDIYMRQRVGT
GGWSSAIRAVGEDGTNGTPGSKG
NYIGMRFRVAAEKPATPTGQTPSG
WSDAPPQGNPLWMVKAEFNGQTN
ALVGTWSEPVRIDGEGIGVNLYPVK
KTLDQWTGMSNGTMVKNPDTLSF
TITNTESTSSTGPGAHPVPFQGSQ
GPIVEIPVKPNTAYIFTYEVSTDSTS
FVLRDLLLEFSSITGSFTNFQELLTG
AKGKQEAKIVTRADTKFLSFRPGVR
TAGATVTYSNLKLEEGIKATAYSVE
ASDSIGEKGDQGTQGPQGPQGNQ
GPQGNQGPQGAKGDNAKGFSLSS
LGQTFTYDAEGKLKSDATILFQAFR
QNTTANVTWSAKDEKGGNITLTST
SNTGATLTAANFKTSKSVVVTAVCD
GITDQITIVRLDDGSNALVGLLTNEG
STVLANYAGYVQNYSTGSSGDFKVF
YGAKDITSECTFSTMEKNNLDADIT
SAGKYTLKGMPAGTDVINGWVDLR
AVHPTYGAVVRRVATTKSILAKGYD
RVITTSFENGNKGTWSTGSVQGVS
GATIVAAGFSKALVISARDCIEDANA
FPVVAGQKYRLGMWIMASESKVNI
NMGMRIVRAADGVVDWQGTLMIA
QGTVVPGGWSYIEKEFTVGSSNTG
IAMPWIQMAGSSGSDLGKAYVTDIH
IFALEMDGEKGDTGATGATGSQGP
QGPQGNKGDKGDTGATGAQGPA
GSSVNVQWSKDGSTNWHAGFQP
GDIFMRQQVNGVWGSAIRAVGED
GKNGADGTDGDYISMKFIVQDTKP
GTPTGNNPGSWSDAPPVGSPLWM
TKGTMNASGQLQGTWSNPVRLDG
TINPNLFAVRKWMAGMTGTEAGTS
KNDIEKLAHTLTRTSGTDNTAPGCY
```

Fig 21

Fig 2J

```
ATPYLGSGAFSHPVTPGKRYTLTY
NIDAASEVQTRDTIFWQANPDSGQ
STYIEELNTGTSIKVKRTFVVPTGM
NYLTLRPSALTLNVATTWSKIKLEE
GGEKTEYQVEYSDSIGIVGKSVLVQ
WSKDSSSSNWHDTFQTGDLFMRQ
NVDGVWGPAIRAIGEKGEIGPDGK
KGNYTNIIFRISDTKPAKPTGNKPTD
WFDAPPDGSPLWMATATFNGDTN
AIIGAWSDPVRIDASGVGENFLAFK
EWMMSIQRAEGTGSSVSKNPDGM
RFRVTAGPSRNDAYTTPYQGTGTH
FIEVSPNTVYTLSFEMETAVSTRMM
LLQFDNGNGGTHARNNQVISTSTGI
NSLTITTGANTTHLSMRMSISNMGE
TNVLMKPKLELGAFPTAYVAHPSDL
LGKDGATGATGPQGPQGNTGATG
ATGPQGSKGDTGATGPQGPQGPK
GNAGENAKGFALTSDYQSFVYDTV
GDIKSATTILFKGLKQNTTAGITWSA
VNNTGAAVTLMNSGDNRQLTAANF
GASKWVTITATCDGLSDQITVVRLQ
DGENVLTAVMTNEAATVLANYSGY
CQSYENAKGQMRVWYGSTDVTGQ
CTFSEGGRSNVTPSINSANGNYSV
TGMLDGTDITEGWVDVKATHPKYG
AITKRFAVTKVFLAKSYEMVITNTFE
NGNKGSWAGALQSVSGPTNQSISK
ALRITARDNLEGRNTIPVAGGQKVR
IRFWVNPLGLEEAIFRVGFIVHRKD
GGKGYPSRTVVTGPAPNSSWAYF
DQELTLSANDEGIAWPWFQLDNKT
SGSSLGYMLVADIHFEDLSMDGAD
GATGPQGPQGNTGATGPQGNKGD
TGPQGPQGPAGASVGVQWSKTGN
ASDWHTNYATGDIYMRQQVNGVW
SSAIRAVGEDGRVGADGKYTSLRF
QVAATKPARPTGNSPANWSDSPP
EGSPLWMVKGEFDSSNQLQGTWS
DPVRLDGETVNLNLFANKAWIASIT
GASGSGSVVAKNPDELRLRITAGS
GATDAYTMPSGGDGTFFTKYTAGK
RYTMSFDTDSALEMRMHVFFIQAG
ANTTTSSFSWIASTTAGRTSWSFTV
PAGCDRVSVRVSLNNNPGGTNVV
SNIKLEEGDFATAFIRNELDTIGADG
SQGPQGPQGSKGDKGDTGATGPQ
GPQGPNGTSAKAFALTSDSLSFSF
```

| | | | | | | | |
|---|---|---|---|---|---|---|---|
| 30 | 38389 | 38808 | 34 | DTSGNLKSNGTIKIDSWRQNTTAAI TWTAKNQAGSNITLGGTATNKTITS AQFGSSEYVTVTATCDGTTDSITVR LQDGVNSLVGYLTNEAANLSCNSY GFVQNWDGTTGNFKVFYGTVDVT SQCTFGVEDKSNLNGNIGSSGYYA PSAMPNGLEITSGWVDYKATHPKY GTLIKRFTLKKSLPGIGIGYDRVFTGSF DSGNNGSWGRTVVDIATGSPGGH TKAIQCTSRDTMESSNWFPTRKGM RYRVTAWVNNSEGEYQLRLGLHT QNSSGSVNTGYPTMLAASAKDSEG WKLVTGIVTVGDGSTAETGRARPFI QMNGSASPFGNAYVAAIAIEDLSM DGADGATGPQGPQGNTGATGPQG DKGDTGPQGPQGPAGNSVNVQW SKDGSTNWHSTFTSGDLYMRQQV NGSWGPAIRAVGENGANGTPGSK GNYVSMKFAVMASTPSRPSGSNP AGWSDSPPPGNPLWMIKAEFNGE TNAIIGNWSDPIRLDGDSINENLFYF KAWLDSITGVAGNGSSIGKNYELLR ARIIAGTGVTDAYTLPSDGSASMFT YLPPSTTYTMSFETDNAVEVRCHV FWYAKGSNTTGGVLKTIASTTAGLS SFTFTFTPANSDRISVRFSVNESGGN NVVGRCKIEKGAFVTSYVRNQYDA VGDRGPGFYTQAITNLTGWNDTQA ASFFQSTFGGPPVKYDVLTQYKSG SPQNSWTRQWNGSAWTAPALTVH GDMIVSGSITADKIIANNAFLAQIGV DILYNRAAALSSNPEGTYTMKIDLA NGYIHIR | | | |
| | | | | MSTENRVVDIILDQNVSYGLMLQFM DIDDSAYPATETPVNLTGVTLKSSIK DSLESTGVKLADFVVTVVNATQGQ ASLGLTAATVATIVSKASKERDKYN PRLRFAGYYDVIMTKGTGATATSY RVMEGSVYVSDGVTA | 139 | 15kDa minor tail protein [Enterobacteria phage T5] | AAU05271.1 | 3e-43 (82/139) | minor tail protein | |
| 31 | 38808 | 40847 | 35 | MAITTRIIAGQVTALDGANSRVSKY PKFTVQLGYSVSSLAATELLDAATR SAASAAAKTSETNAKASETASKN SQTAAKTSETNAAASAQVAQNLAG KASLVTPLGVMTGSAEAKIASITIAA NQSSSVHVLFALYATGNGANRDDI YNMEIVSLALPGPVTSVTADNIGSF LSHRVIGPANTNGFMVGLKSTIEGS NVTYDVYLKSRSSFRDPKMAFLSG | 679 | Hypothetical protein ACICU_01051 [Acinetobacter baumannii ACICU] | YP_001845710.1 | 1e-19 (54/139) | | No putative conserved domains have been detected |

Fig 2K

| | | | | | | | | |
|---|---|---|---|---|---|---|---|---|
| | 41335 | | SISVTPPTGPLVDGTSPAWKTTGFD TDVIYNRAQVIDDGISLARIKQLAIT NGKTDSSILLLSYLNETGILSTNKKSI SLRPGGTSDSSIAATEFLPNGNIILP NGDTGNQTISWLGGPRIRVNSNGS FVLSTNNPSMQTSGFITFRPQGDQ VTSTELQIRDDGNIKQTAPQSSAGN ALIRQDAAIQHIMDKAPAAGITANPL SDLNVIPTPEGTDPWGADGVRVFQ SGVSTKNTPDGTTGRLGTILNVRHT QYRIMQFFMQSNATAPILHIRSLRA DQGNTPPAWFKVTEYSKPNIQSDI AGITIDGNGFVKKASPIAKLIAEIPSK EDSFFWTGVETVGGYVGCNAEAQ GVFAVKTGLGKYTIKGSLGWNTEG WKFELPRDDNGNMLCFVESDWNE EEKELNIQVFTRKFDINTGNIIAGEP MEIPQGRWIDLRLEMPKVEIPEVEF PEDPEV | Putative phage tail protein [Enterobacteria phage EPS7] | YP_001837069.1 | 3e-09 (53/105) | phage tail protein | | |
| 32 | 41335 | 40892 | 36 | MRIKLSHPDCKPHVGSSEAAGMDL RAYFGDRASDLLRAIPPGESLMIDT GVAVEIPEGWVGIVVPRSSLGKRRL MIANTTGVIDSDYRGTIKMNLLNMS NETQPIDNFERLCQLVIVPHYNPNDI EIVDSLTDTDRGEGGFGSSGKM | Putative deoxyUTP pyrophosphatase [Enterobacteria phage EPS7] | YP_001837067.1 | 6e-52 (100/140) | deoxyUTP pyro-phosphatase | Deoxyuridine 5'-triphosphate nucleotido-hydrolase (dut) | TIGR00576 | 9e-43 |
| 33 | 42213 | 41335 | 37 | MSKSWGTMKREAEQRLASRRNLM IVDGTNLGFRFKDSGKPIAASFAN TINSLANSYDAKHTIVLGDKGKSIFR TNIFPEYKGNRDAKYADRSEAEVE ADRQFFEYLDDAFDLIASQFPTFRI RGVEADDMAAFIIQLIGHHYDHIWLI STDGDWDTLLAPNISRFSFTTRKEY HEKDMFDNHNVDTVDQFISLKAIM GDMGDNIRGVEGIGEKRGYNLIRE HGSVLDIIDALPLPGTQKFVQALNK SGELMERNLTLVDLPSFCGEAVAA AGQDIYDQFVKDITAIATGEV | Flap endonuclease [Enterobacteria phage T5] | YP_006958.1 | 1e-118 (203/289) | flap endonuclease | 5'-3' exonuclease | TIGR00593 | 5e-48 |
| 34 | 42692 | 42210 | 38 | MAVDSREKGKRAEYQIRDMLRKYT SLDWERVPGSGAFCGQSHSLKGDV YLPPSVGKMSQYCFEIKHYADEKF NSNILNVGESQLEKWWAQAAREG EQMNMKPALIFKKDRGQWLIALDS SDPMIDNLMSRAHFIVNKRGMEIVI GLFEPWLNACEIGDLVK | D14 protein [Enterobacteria phage T5] | YP_006957.1 | 2e-68 (118/160) | | No putative conserved domains have been detected | | |

Fig 2L

| | | | | | | | | |
|---|---|---|---|---|---|---|---|---|
| 35 | 44527 | 42692 | 39 | MSIVINKLTISHFMSYAENVVIEFDN HRVTQLIGRNGLGKSTIGTALEELL YNKNSRGIKKDDLFNWHTGSKAYT LEGQFTKDGDVYNVKKVVKSTAKV TLTKNGEDISGHTATQTYKLIEEVLA CDFTTFTKLVYQSVGSSLDFLKTTD AQRKTFLVNLFDQEQYKEVSERVK AGRKAVSAKLSGLEGSLRTAQSILS SKASLGAPQSEIPIPVFDEEPLVEEL TEAKVKVALAGKQKASIAKRSSLDM AVQAAEKTFAPFENLPAPTSKSEEL LSVTRNLTVVATRADDLKKRYYDFK NAAGKTQCSACGTHLDTSAAQEA MRRTKEEYDPLYKERQKLEAEVEE LRKEDRAFKDYISKFNALEQARKNL KEFDEVNGTQDEIVDASGLAERIKAI ESSIRQGRSSVELARTHNESVVRE NAKYEAKREQIQKAEQEFDKIQAEL SLVAEEVADLDILITGLKDLVGYKLE HSVKVFEEMINHYLSIMTSGKFALG FELDETKLQVVIYNDGNRTSMVNC STGQQSRINISTLLAIRMLLSTISKVN INLLFLDEVVSYIDPDGINTLVELLQE EDQLNSIIVSHGHTHPYAHKIEVKQ DEAGLSILEA | Probable exonuclease subunit 2 [Enterobacteria phage EPS7] | YP_001837064.1 | 0,0 (377/598) | DNA replication, recombination and repair | SbcC, ATPase involved in DNA repair | COG0419 | 2e-12 |
| 36 | 45503 | 44511 | 40 | MKILFSADHHIKLGAKNVPQEWQK NRFILLGEKLDEVFGATGCDLHIIGG DIMDVSDPSSEEVELLFAFLATLQH PGIIYTGNHEMKSKTISCLDHYAAAI SDATDGLWKVVKDYRSPEFDIIPYS SLHKASWKPRVSDICFTHVRGAIPP HVVPEIYLERFVEHGYSKVFAGDLH SYKNSQKIGDVDLLYPGSPLTTSFH RERTKGTNGAFIIDTVLPRDHEHYL SWIELGDLPQLIRKTIEVGEPMEAD AYDRVIYEVTGDVSQLKTLKNSELL DKKINNRVTKDAKLDLDDMSLLQEL DTYFTNVQKLDEASRTRILKRAAEY VDSN | Putative recombination endonuclease, subunit D12 [Enterobacteria phage T5] | YP_006955.1 | 1e-121 (216/328) | DNA replication, recombination and repair | Exonuclease SbcD | TIGR00619 | 4e-05 |
| 37 | 46316 | 45543 | 41 | MATKSWGSTTGGSNGDKLDYMKF NNGKNVVRIVSGVLPRYVYWIQNK EGKPAPFECLRFDREKERFIRGAS DPVHDMGFKDPEKKDGKAQPLRP KKNYLAVVIDRTDNKLKLMEVKATIL TGIHSIMAQLNLEDPGEIDITISKSGT GFDTKYDVQQIAAMQFQMAKNQP GSKEAALHEADVALIGEALYNEADE FEGFEKVPKLDVTYPVPSYDEQKK | D11 protein [Enterobacteria phage T5] | YP_006954.1 | 1e-88 (161/256) | | No putative conserved domains have been detected | | |

Fig 2M

| | | | | | | |
|---|---|---|---|---|---|---|
| 38 | 46672 | 42 | AIQAWLEGKDEEGDESKGNEGSA NSGNIDHEAASDLD MLFYDYEKIYILARGNSSLIVQIIRRM VEDPEAHVMLTGRSFILNEDTIVYN KRKLSDRQLAEYLGLLSFRNYAEYS FSKDTSLDMQYIPPWVPRAVIEHHP LIAINKSKLTFIEEN | Hypothetical protein AGC_0138 [Enterobacteria phage EPS7] | 117 | YP_001837061.1 | 5e-40 (78/116) | | No putative conserved domains have been detected |
| 39 | 48232 | 43 | MKIVISNKIYCKPSNELWEYLLKHTS YQIFKPGAKYPLMFQNSGSVGKEIK WFPVTRLDLLESFGQKVTEIVDKRT LVPMDIPKPSFTLRPGDQLPIYEDC NDTCIINGKPGFGKTILALAIAHKLG QKTLVICTNTTIRAMWEKEVRKFFG IEPGVIGSGKFNIDSPIVISNIQTVNK HGAALAKEFGTVIVDEVHHCVATTF TKFLEQSSARYKIGLSGTLKRKDGL QVMFKDYFGTKVYSPPVNNTMPPT IHRFALKTQVSGNMNVPWAIRAND VYSQPEYFQQVVDLCELYSMAGHK VLFVSDRIDLIERVTNALELRGVKTY TITGVTSLDDREQVQIDVTNDGPCV LAASQSIFSEGVSLNALSCLVLGSLI NNESLIEQLAGRVQRMADDKLDPIL VDLKLGGVGFKQAAGREAAYRLNG WEVLDFNEKNMANLDKILFAKNPK V | Putative ATP-dependent helicase [Enterobacteria phage EPS7] | 452 | YP_001837060.1 | 0,0 (304/448) | ATP-dependent helicase | SSL2, DNA or RNA helicases of superfamily II / COG1061 / 4e-30 |
| 40 | 48726 | 44 | VLNFSLPVYALRAYDVLFQEGEYIVI QTRFTRYVLDNPSLPGTFSQRRLFL YGERENLPYKLYPLLKKQFKYLSQIIN SGLKHFIDSTGKIVTWKPTTYNIIT ERVRGSTRIFNGKYQCYVKNVPYP FLLSEPANYISYALVRGSPVIFDTHE EEPETPRLRVKI | Hypothetical protein T5.123 [Enterobacteria phage T5] | 165 | YP_006951.1 | 9e-52 (96/165) | | No putative conserved domains have been detected |
| 41 | 51289 | 45 | MKIAVVDKSPNNVRYQKHFELFDH EVETFFMASEKVTGRLLKKHITIGTP ENPFNPEDFDYVILVGADPFLKFAA KKGISDYSGKRVEHDGYANWIASIS PAQLHFKPEMKPVFEATVESIHAIL NGREKRSKAGDYRPIQCPDEAEAY VKMVYTMCPGMIAYDSETSALYCR DGYMLGISISHQEYQGVYIDADVITE NTVYYLQKLFDSPEHGVVFHNLKF DMHFYCYHLGLSFDKAAEEKRLHD TMLMHYALDERRGTHGLKSLAMKY TDMGDYDFELDQFKETYCKTHKIK KEDFSYDLIPFDIMWPYAAKDTDAT LRLSNFFLPKVEANPRLKSLYYDVL MPGCVFLQRMEDRGVPISKDRLKE | DNA polymerase [Enterobacteria phage T5] | 856 | YP_006950.1 | 0,0 (663/856) | DNA polymerase | PolA, DNA polymerase I - 3'-5' exonuclease and polymerase domains / COG0749 / 6e-84 |

Fig 2N

| | | | | | | | | |
|---|---|---|---|---|---|---|---|---|
| 42 | 52241 | | AQVQLMTALQLAKAKLYEYPEVRK LEEDQGSVFNAASVVQLRKLLFDY VGLTPTGIMTDTGADSTGADALKEL SDQHPIAKTLLEIRKISKLLSTYIEKM LISIDADGCIRTGFHIHMTTSGRLSS SGKLNLQQLPRDESVIKGCIVAPVG YRIIAWDLTTAEIYYAAVLSGDINMQ QVFINMQNDPENYSDFHGSIAHMV FALPCKPTEVKKLYPALRQAAKAIS FGILYGSSPAKVAASVNEALLEEHM KTGKPYTECTTGDAKEYIETYFGRF PQLKKWIDKSHAQIQTNGFIYSHFG RKRRLHNINSEDRGVQGEELRSGF NAIIQSASSDSLLLGAIDTDNEIRSL GLQDEMKIIMLVHDSVVAIVREDLV DQYNEMLIRNIQVDRGISIPGCPIGI DSDSEAGGSRDYSCGKIKKQRPSV ACIEDKEFEEKVRSIIGMEDFDYAAI AANDENHPDHDKYANIKFLPEISKDI VNVRRVLGA | | | | | |
| | 51357 | 46 | MSRITELLDLKGIEYRDTGGDILIRC LNPDHEDAHPSLRVDPDSGVFHCL SCGFGRGIPSIFHYFNEEQYRTSPR LLRVRRMISDLRTEGRSLEIPESAMI FDQDFRGIKAETFKKYFAFGQTED WEGRVVFPITDAVGRNLFFLGRNM DSSAPPKYMIRPKKVSPPIFPVRYN TPALILVEGIFDMLNLEDKGCHNVS CCFGTHQFSLDNIADKFMPFQIAGT THVVIILDNDKSGNEAAKKLAKLIRD KTRIIPIIGNFLLPEGKDPGDLDAEE VDQLIRNVEILIAEHVKI | 294 | Putative DNA replication primase [Enterobacteria phage EPS7] | YP_001837057.1 | 8e-130 (215/293) | DNA replication primase | DnaG, DNA primase (bacterial type) | COG0358 | 5e-15 |
| 43 | 52238 53716 | 47 | MYNVQAVVLKMLLASDQKQVALET FSRLRKDHFNDAFTATYQAVQNYYK KHNGMPSLDALMLESNRNARLSQA LTVLANTQIPDVDISHAIHVLESEYT QDLFLNLLETDVLQDITILDQGELLD RVAAALHMKLEERVTTTGKVFNADT MRVFKRKEDSMLNLISLGISNEFDA QLGGIARKETLLLGGWRGTGKSIIC SNIQVAQYYNGDIAPYFSIEMPENE VFRRNLAIMAGVSAKAMRNDSLQG IELNKLAKTRAKMFEGGLEVYNDFV SRYTLNEMSDFHDMETMLMQERP LHTPMIIVYDPELSTATIDVELTKLTS KYGDKVTIALLDYINQVRLPDTKTLD MYDWKQQMVVSSTFKSTCQKHNV AGVAPYQIDQQGNARMARGILDSC | 492 | Putative replicative DNA helicase [Enterobacteria phage EPS7] | YP_001837056.1 | 0,0 (361/492) | replicative DNA helicase | DnaB, Replicative DNA helicase | COG0305 | 3e-08 |

Fig 2O

| | | | | | | | | |
|---|---|---|---|---|---|---|---|---|
| 44 | 53716 | 52238 | 48 | DMAANLNAAKQNEGHDGAIKFDFV KTRNSEGMTFMPKINWNSLRMDQ TSDLKLEDIRQMEAEFVIPLESDKP KDKPKRKKASDEDTNPTGESSRDL MAKLTWNEEITASLTAKANALNATV ISQEAVANIAAELAAETGKEVTARS VGSKLRKEGFEVQKASDVTKSPWT PGQEDELVAFLNDHPGQYTYAEIA AAVVGGAYTAKQVQGKILSLELTAA VKPTEKAAAVRSFSPDQEAAFINAV ASGASVEAIAAQFERTVKQIRGKAL SLLREGRIEAMPVQEVSNAKARED VLEGLNIADMTVAEIAEATGKSERG VKSMLSRRGISAKDHDGVAKRAKL DAKSAK | Putative transcription factor [Enterobacteria phage T5] | AAU05255.1 | 5e-95 (185/240) | transcription factor | No putative conserved domains have been detected | |
| 45 | 55311 | 54562 | 49 | MKIEIPLNCHSCGSKLDLVNDQLFC RNKSMCPAQSSKLIENFCSKMKLK GFGPQTIAKLEITKVSELFFLTKEDL VRAVGDKVATKLELELETKLRQDV DFGSVLGSLSIPLIGEVAAKKLSQLY NDFQSVKAEGKAGENLASWKNTP AGQNVINLPWKFSGAREAQVTPAT ESNGVLCITGKLNDFKNRADATKY LESLGYTVKTSVTKAVNYLICEDET KIGSSSYKKAQSLGIEVLTIKILLENK | NAD-dependent DNA ligase, subunit B [Enterobacteria phage T5] | YP_006945.1 | 5e-91 (181/254) | NAD-dependent DNA ligase, subunit B | Lig, NAD-dependent DNA ligase (contains BRCT domain type II) | COG0272 | 3e-30 |
| 46 | 56473 | 55511 | 50 | MQHVKEFIKLCCDAYYKGMSIISDE EYDALIRRFPLEEEIGPKGDVPHLF RMFSLQKVYPGRGEEVPFQGIETP KLDGCAISLLYIDGKFVSALTRGNG VLGNDVTHNVKLLNIPKRISQKTPV QITGEVHTKEVENMRNFASGAINL KDSGEFLSRIAEGGLMFTAYSIQCE TGKVGLTATFCGDMHILQGDGFVT CLDISSRVDWFPTDGVVVRMDGNN QFNAAGWTNKFPRGAYAIKEDDEG EVTTLERVEWQVGASGKVTPVGYF TPVVIDDAVISKATLNNVGYITALDL EIGCQIRVIRSGGVIPRIVERVYE | NAD-dependent DNA ligase subunit A [Enterobacteria phage EPS7] | YP_001837053.1 | 6e-136 (234/323) | NAD-dependent DNA ligase subunit A | LIGANc, Ligase N family | smart00532 | 3e-56 |
| 47 | 56748 | 56473 | 51 | MQKITLNAYSSPPLQGGEVLTWLE KEKGKPVVRTMSGFQMLGMWYEK NVLVCELYSPKSKRRVMSTFQAVC ENFYWEGKTQMLFDYYEAK | No significant similarity found. | | | | No putative conserved domains have been detected | |
| 48 | 56866 | 56729 | 52 | MKDHEIAQLVNKLTEAAKTYAHTQ QLRAHMSRIVNEALKNAKDNA | No significant similarity found. | | | | No putative conserved domains have been detected | |
| 49 | 57258 | 56950 | 53 | MNQNICQDYEGHIDDQSHVIFEDE GRQIRMTVSEFRGNLYFGFRLWLL | Putative transcriptional | AAU05252.1 | 2e-34 (66/101) | transcriptional co-activator | No putative conserved domains have been detected | |

Fig 2P

| | | | | | | | | |
|---|---|---|---|---|---|---|---|---|
| | | | DIEDNWFPTKSGFSFPYTLEMTSTL FRAFTKILSNSEVLHEVYRESQKTQ ASDD | | coactivator p15 [Enterobacteria phage T5] | | | |
| 50 | 57605 | 54 | MNKAQVVAICEKHGEFCMQYTKLR TKGVTYLYGTTEFDPKQDKYLAERI VREGLEPADKOHILVFSRSSDKFRY IPIANIKRITSLNQELDRATPVGR | 98 | Hypothetical protein AGC_0128 [Enterobacteria phage EPS7] | YP_001837051.1 | 5e-31 (62/68) | No putative conserved domains have been detected |
| 51 | 57309 | | | | | | | |
| | 58022 | 55 | MSTPTQWSPELEAELTSAYVAKIEL FPEDERPGVSMEIVAEIAKEHGVSP NGLRMKLSKAGVYVKKEAGKSTAK TGGDAPKAGGRTSKSDAQAELRAA FNDAGLEDGFLDESIVDKLTGKAAS HLAEAIRKITK | 134 | D3 protein [Enterobacteria phage T5] | YP_006941.1 | 5e-45 (92/137) | Arginine decarboxylase | PRK05354 | 0.008 |
| 52 | 58315 58097 | 56 | VSKYQLLNLFQIYSEGATAIRDLHYA LPMDEAEDNGWLTKYDRGLLKMY RLSPNGLVAVNQILENSVCFAAQ | 72 | No significant similarity found. | | | |
| 53 | 59003 58308 | 57 | MAIRKKLHANSIPDEKFKEAIQWLE EGKTKKGACEILGVASNSTMERLIE EWKDNQRVSAEMRKKKRGTKIEG AELANVIDSYLSGDSFEAIAERFYR SANMIRMVLSAHGALLRVNGEVDP LFPPAIPEESMKEVFEVGEHVWVP GYXCIGEVKKALDNPVGAYRVYL SEARQQYVNYMYMWDLASVEHLVAL GVDIKSLGFKWGKEDVAELVNNAV KAALKLEKRGKGE | 231 | D2 protein [Enterobacteria phage EPS7] | YP_001837048.1 | 6e-82 (152/223) | No putative conserved domains have been detected |
| 54 | 59320 59036 | 58 | MSKRDARWETRKFPKRDTKARKA KEIELCRVIPIRLAQMPNIYDWLEAQ RKTRLSIRINMELNMGYKSLSEFMH VTFDPTFYENRDCLEAKSVL | 94 | Hypothetical protein AGC_0124 [Enterobacteria phage EPS7] | YP_001837047.1 | 1e-10 (34/74) | No putative conserved domains have been detected |
| 55 | 62096 59307 | 59 | MFSILEGHAGFSRDPASGNWKEVK TTDYLFAKEFSNEHPEGKPASMPY KFNVVDTVDPKNLNEAYELMVQLT QDPHLVAVRGTCLVAEKAVRRKRT NFKIDHKSNIIAMDVDGISDTGGCD RFDIVGMGRHVIKLLNSISEDMFPL NAGFIAHASSSAGIKPGIRMHMLLE SNIPVTQGQLKFLFTSLNDSSRQKY GFDIADLAYYSSVQLHYFADPIFRD QFTDPFKAEGKPRLVKVNGARIELP NTMPDYEATRGEFKEEFLSLLNQIK GKRVASEKVEQTIAELEEAEDGVYL RIIPKLYHRALEDGVDFAWLEKEITS ALSDYINTKDNSRSLQDYFNNGRK QALKAFVNNSMRDIPESNVKGVPV HKLTSDSPDGMNYLKINRPPPEGH LTFIKASLGTGKTTAVTKWLERDQL KGNFLAVTNTRALVSSNAKKFEAG | 929 | Putative replication origin binding protein [Enterobacteria phage T5] | YP_006936.1 | 0.0 (731/929) | replication origin binding protein / helicase | DEXDc, DEAD-like helicases superfamily | smart00487 | 3e-05 |

Fig 2Q

| | | | | | | | | |
|---|---|---|---|---|---|---|---|---|
| 56 | 63090 | 62695 | QYDKSVDMLNFKRGAIDRMSTTIHS IHKFKNFVGQIDVIFIDECDAVMNDL LFAPVVKQRRECISVLREILLSAKVV ILSDGDISAETIEAYGSLIDFDKPVSY YKHHRKMLSDAQAYEFPDESSIWV ALQTSLEMGEKSILVSDCGPDELNE KGLTLRNNTGAIVKEIHSNSTSDIDI RRILDYTTNELIEQQIDCLLCSPSVT SGVDFNYFDNVFVITRTANQAPNM RFQAIRRDRGAKNIFYFIDKSTSGF SAGSEQYNIDEGWLELAQQLYVKR RELESRNFISTLRYYLLDQGATIDIF SESWGKIDSSAAEYTAERVSAILSS TPDWCAPRHADAYEAKLMLVKYFH LDSIKSITQEHAEMMVISKKPHKRAE FFHKLQDIFWKDIKKCSNVTISPFIE ALKKHKKDFFIRTGQSANPKYARM YLTQMGINKMETEQIVDWYRTYC SIEGISVPYEFMTDEEKALADEAQN ELGVRNEQA | | | | | | |
| | | 60 | MSIPKMERISWADIPKELIDVAENLL RAALRDEELCFIIQHDVCVGLSKGS LAQDYEILFDWDDLSDLGLMVLVN NVVFHPSNFAAFREPGAGISPGFLV ADEPWTYAPEVLREGKQNASSNSI NIMGWNA | 131 | Hypothetical protein T5.107 [Enterobacteria phage T5] | YP_006935.1 | 8e-13 (48/130) | No putative conserved domains have been detected |
| 57 | 63488 | 63087 | 61 | MLVNEKVVNQGVGLVPWAEIPLDV KESLLDHLRVWCDNMEVYFDYDN MHLGLWVPMDEDQDEVLDWGDLT EMGLVFALGYVCLLRESYIPVGVTG VSAGIWVGRNEDYYAPENINGWIQ VLRRFGFQVEGLTK | 133 | Hypothetical protein T5.106 [Enterobacteria phage T5] | YP_006934.1 | 2e-13 (43/124) | No putative conserved domains have been detected |
| 58 | 63639 | 63475 | 62 | MYHPDDILLWPNGSWCYRSDVQD MSHLSDDYQVLRADSEQWHEFIQ MGEEYAGQ | 54 | Hypothetical protein T5.104 [Enterobacteria phage T5] | YP_006932.1 | 2e-05 (20/44) | No putative conserved domains have been detected |
| 59 | 64405 | 63623 | 63 | VPTFRKGAITPLWDKYKLTEVCNIQ AFDKGFHYLNDPMPPLEALSEGSD DEPSRNLYELTHEFYNMRRQELGT VEPNIAHLRIAEWYERFPGQVVNFT TNVDDLLERAGIPHDDVIHAHGYLT EIMYRRGKDVIVEDIGYTAVDYRKY EWVKPAITFFGETAPWVMGQINLF DTLTTQDLVIVVGASNQVIDFNWEL FPAHSRGTKVWVVNNGINYLEQSL YEERGIPVWYDTAANVFSNKHFIG QVEAWLEEKIYVPSR | 260 | Putative Sir2-like protein [Escherichia phage rv5] | YP_002003582.1 | 2e-64 (127/263) | Sir2-like protein | NAD-dependent deacetylase | PRK004 81 | 2e-21 |
| 60 | 64654 | 64442 | 64 | MKIHKTDEKRIYFMMDSGAYGSISR | 70 | No significant similarity found. | | | |

Fig 2R

| | | | | | | | | |
|---|---|---|---|---|---|---|---|---|
| 61 | 66544 | 64715 | 65 | EDVVKLLRCRNHLWKDKVDPRTSECLSEKAEQLRKEEMRNYMEFL MNELDLIDNIYSILDNEGEEDLMFN NANKASEQFPTQRDMIAGEVSKYV VAQELPAYLAAHNRGEIHIHDMDY RAQGYTNCCLVDLAGMFKNGTKIG GAEIETPKSISTAAAVTAQVIAQVSS CQYGGTSIDRIDEVFAPYVRKSYDK HLAIGQRWLHDSKKAAVVATEMTE KEVYDACQGLEYEVNTLFNSNGQQ PFVTFGFGLGESWEARMLQKAMLE VRIRGLGASGHTAVFPKLIFAVKEG LNKSPSDPNYDIKQLALTCTSKRMY PDYVSYERVTAVTGDFKFPMGCRS FLSAIESGETAGRNNLGVVSINLPLV AVESEGYFDRFWKLLDEYIDKAMA AHDWAIERLKRVRAKQAPILYMHG AFGVRLKANDLVWPIFEGRASVSL GYIGINELVEVMFEDTDPMSPPAIE FAVQVLNHMKDRCNKKAEETNLGF SLYATPSESLCNRFNTKIAEQYPEY DWLTDKGYLTNSHHLDVRTKVAPN VKFDYEANFTTIANGGNISFVELPE MRKFIPALEWVVDYGLSKSHYIGVN IPVDECEECGYLGESVSGEHGFVC PQCGSGNISVTRRVCGYLGSPGSR PFNPGKQQEVMQRVKHMNLK | 609 | Anaerobic ribonucleoside-triphosphate reductase [Enterobacteria phage T5] | AAX12030.1 | 0.0 (379/608) | anaerobic ribonucleoside-triphosphate reductase | Anaerobic ribonucleoside triphosphate reductase | PRK092 63 | <1,0 e-180 |
| 62 | 66854 | 67603 | 66 | MRKAARRKESRRNGSAKRERHEN VIPVDFEARERFQPTAKELKPKNAE QKHYISTIRNFTVTVGIGEAGTGKTF IPSVLAAQELATPGSVYEKFILVRPN EPLGKSLGMLPGDLNEKMAPWLEP IADGFKWALGERSYQGLVERKAIQ YLAIEHARGRTFNNSYVIVDEAQNIS VEAMKCIL TRVGQODCKLVICGDVAQ KDIKSDSGLQLIMDIYDQYEHVPFSL VELHDNVRSAESKAFQAIFNDMGI | 249 | Phosphate starvation-inducible protein [Enterobacteria phage T5] | AAU05235.1 | 7e-96 (173/246) | phosphate starvation-inducible ATPase | PhoH-like protein | pfam025 62 | 5e-40 |
| 63 | 67539 | 67718 | 67 | MITCVPLNPKHSRQSLTIWESNMVT ELIIGYGEGITSEENWGFVGFGEGIT SHDERPDL | 59 | No significant similarity found. | | | | | |
| 64 | 67733 | 67942 | 68 | MNNVFTLNNFRTRTKTKVHPVSLAT VNKYNANYPEDERRHHAAFKIANE FPNQPLGTKELVSRMKKLHFY | 69 | No significant similarity found. | | | | | |
| 65 | 68071 | 70395 | 69 | MTQRIEYVIKRDGTKEPFMAQKLND WAKYIGIRSDVPWSPVAVAAVKNL PKGDVHSDDLQTMLIKSAESMIERD HRYDRFALELRLAQLRKNLFDSYTP PSLRFFHDHMVELGAWEDMSGWI | 774 | Putative aerobic ribonucleoside diphosphate reductase, large subunit | YP_006924.1 | 0.0 (534/776) | aerobic ribonucleoside diphosphate reductase, large subunit | Ribonucleotide diphosphate reductase subunit alpha | PRK091 03 | 9e-145 |

Fig 2S

| | | | | | | | | |
|---|---|---|---|---|---|---|---|---|
| 66 | 70492 | 71652 | SDDQFEALNEVIDHSRDELFTNAGL KQFMDKYSRRNIYTEEIYETPQFAY MGMAMAMLSQPHWSMLDAIDLYN ALSLQKINVPTPPLVGLRSADRGFA SCCLVDGTDTLDSIDAAEHVVFKMV AARAGIGYHLESRSIADPVRKGAFP HSGKLPYYRHIDRSVKANTQQSRG GSATVYTAFFDPEIIQVMEAKSNRS PDEKKIDKMDYNLKFNSILLKRFLRK ENITLMSFLYAPEVYAAFDSGDVAE FERLYIAAEKRLAGVTKRGFKGEVL PVAPVIPAAELIEFWKTVRMETGRL YTMDAGEVNRNSRYKDPVRMSNL CVEIVQPTFPIPHVVDLYRTDEELD KMDVSEYGEVSLCNLGGFALGRIK TLEEWEKISYILLKFVDTIIEIQHYPF PAMKYTALRRRNVGIGLMNAAGAM AAEGLAFEGEEARNWHREAEKAS FFLHKASVRLAKEIGPCEWFHRTHT SDGTLLIDTYKKTVDDLVSVGLEMD WESLREEIKTHGMRNSVLTASMPG ESSSVLIGVTNAVEPPRSAVTIKTS GVNKIVTVAPGLDDWDTMQSYKYA FDIDRTEHIKWLAVLQKFTDQAISAN LYYDFNKYPGGIIPGTEIIKDLLNSTK YGIKNLYYANFDVTGGSAAEQGC SSGGCTL | [Enterobacteria phage T5] | | | | | | |
| | | | MATVFNREWDHTESKLFLGQDLGI ADYVNVRYPRLEELALLQRSQFWV ETEISLEADKKQWPNLPQHIKNKTL LNLAWQTQADSIITRAPEDAILKLVS RPELEGMLIQWSYFENIHSRAYSNII RNVLPNPGEFIATVQANDEAFARLA LPVSVIDELAEIADIWLDARANLEIAE KEGTLEYTEEADFLALTEQVQQKIL EFYYAVYALEAIMFYASFACTFALA ENDILTGIAKNLQLIAKDEALHTVMA MEVLRILQNGEIPPHVVAAQANAP KILRSILETEINWAHYIFPEGEDIPGL NADLLVEYLYYNARLAFMAINIPWP EDLPVIMEDPIGWMKGWLNTKNQQ VAPQEAQITNYRVGATSQANPDDL SDEFGEFL | 386 | Putative aerobic ribonucleoside diphosphate reductase, small subunit [Enterobacteria phage T5] | YP_006922.1 | 5e-118 (225/390) | aerobic ribonucleoside diphosphate reductase, small subunit | NrdB, ribonucleotide -diphosphate reductase subunit beta | PRK091 01 | 2e-63 |
| 67 | 71652 | 72215 | 71 | MITALYAMRVDAAFGIFNPATMDAY GELPWGSIPEELEQFYRILDTYQVVI VGHNTYETAPPRLKKALEKKSMVY VVGSKAPVLIKNPPRNVRFITHLGS KIRDFCNEVEVVCIGGKALLETLAT | Putative dihydrofolate reductase [Enterobacteria phage EPS7] | YP_001837029. 1 | 1e-08 (40/122) | dihydrofolate reductase | Dihydrofolate reductase (DHFR) | cd00209 | 9e-07 |

Fig 2T

| | | | | | | | | | |
|---|---|---|---|---|---|---|---|---|---|
| 68 | 72212 | 73066 | 72 | MGCLDAYRSTIYPKAGTVPSLDHI MYLEHPILTSTPPDAVVTHIASGEN ERYRFVMEGVYL VIHYINEGKRILEEGVWLENPRTGV RCLTVIGSNFEYDVLGKKFPLTTRK AYALQAIMELIGYLRGYDSAEQFRAI GCNTWNANANENEAWLVNPNRKG TDDMGRVYGVQGRTWLRPDGSHF DQLYKIYENLRRGIDDRGEILTFWN PGEFDQGCLRPCMHTHQFSLLNG NLYLDSFQRSNDFLLGQAFNMVQC YTFLALMAQITGNRAIRANQRIVNM HIYENQYKVLMEHGQFDRKPFPAP RLEINPEIKTLEDVLTWVSKDDFKIV GYKSHDPIAYPFTA | 284 | Thymidylate synthase [Enterobacteria phage EPS7] | YP_001837028.1 | 9e-120 (204/282) | thymidylate synthase | ThyA, thymidylate synthase | PRK018 27 | 2e-82 |
| 69 | 73073 | 73306 | 73 | MGLFNRRPKITFSEREESQLKFLVQ SSGLHIDVILGMVKYKGMDALMRQ FAPKPPKENPPAKRDYNSNLLVPP AKLL | 77 | No significant similarity found. | | | | No putative conserved domains have been detected | |
| 70 | 73404 | 73679 | 74 | MSFTDAKAMAAKAKRSNDMAVIAA RRSIISNIDGSASSGKTEVDSYALN GLPIAARSQIMEDLKDAGYEVKVNH PFDQRDTESITISWGHA | 91 | No significant similarity found. | | | | No putative conserved domains have been detected | |
| 71 | 73679 | 74161 | 75 | MFHVYTDGGCRGNTRGVDNVGA WAMVVYNSSEEQIGTKSAPKRNTT NNEMELQAVLEALLWSNKNPGRP MTIYLDSTYVKNGCESWVWGWER KGWKKADGDTPLNLDQWKWIIDEL KKYRLNHNEIPTFVKVKGHSGVEG NEAADNLLNVRMTELEMEDM | 160 | Ribonuclease H [Enterobacteria phage EPS7] | YP_001837024.1 | 7e-44 (85/160) | ribonuclease H | RnaseH | cd06222 | 6e-26 |
| 72 | 74161 | 74322 | 76 | MLENLRRLVSEMKYEVLLMEPGVD RVVMKLRIARMEAQIFEAEWKALR GGDEL | 53 | No significant similarity found. | | | | | |
| 73 | 74322 | 74672 | 77 | MAPDLRDLFPNVPQYQLDLYAAFL EASKSGNPLRVYRQDRRHGKSWIL RWLKENEPLLKKLSERNSVQHRHT TKVGTSTSAQKSRQNISGGNRYEFI IFDDLVDENEKTQLLNAKN | 116 | No significant similarity found. | | | | No putative conserved domains have been detected | |

Fig 2U

| | | | | | | | |
|---|---|---|---|---|---|---|---|
| 74 | 74726 | 75136 | MAKQTSKKAVETKVATFPKTEANR KARLERHLRKHPADTQAASAVGKP APRRKKPVTKGSTSGYVSKIVGWS TPDKADTKEVLRKTQGRFGSVKPNI FGCEYSRENVRALCYGVGIKFTGK ANKPRNQKRKPAKKA | 136 | Hypothetical protein T5.089 [Enterobacteria phage T5] | YP_006917.1 | 8e-31 (83/170) | No putative conserved domains have been detected |
| 75 | 75136 | 76140 | MRNFVAKNDFNRAATHKSALDYSR VNSRELMDSCYEELEDWAADWPS MEENWDVSEDMTKPPPEVASKCD NTSRSNFNNKGNNMQNLQDRWIS VCDIESLGTPGDCKSTFIAMPFFAF VLMKDLSLDPYIVLGTPNVAQQLAL GAKVSAGTIAFWMNEARAGSAPSL SIIEALNAKDGESTVLVCNPTHESP VSKHTFMDLICPFVEAKQVIEGIIDE QGIDTRSLRHYGNGPQFDMSIYET VAAQANVFSPSDPAIVPWKFWDIS SARNPRDYFEALGGDWKALVRCA EIYAHDVIERYNLIPEGVYPSKHDPV FDALVEAYCIKTIESKLKI | 334 | Putative metallopeptidase [Enterobacteria phage T5] | YP_006915.1 | 2e-39 (96/244) | metallo-peptidase | No putative conserved domains have been detected |
| 76 | 76205 | 76666 | MKAAILMISILTSFHAQAKIDAHEIEC IAKNAYFEARGEGVKGMTAVAQVT KNRVNYGKFPSTYCKVVYQGQFS WVGKKKHKLDRKDEEWKQAKEIAR LVYYMDLPVDPTKGALYFHSKDTK PYWTKDKDFKRTSKIGNHVFYKLK SQLPNA | 153 | Spore cortex-lytic enzyme precursor [Enterobacteria phage T5] | AAX12015.1 | 2e-44 (96/146) | cell wall hydrolase | Hydrolase_2, cell wall hydrolase | pfam074 86 | 7e-23 |
| 77 | 77991 | 78317 | MNDLSMLTKIRSDIESMVSRRSELT KAKQIISGGTQKRFTLQAGDIKFDL CGSQTRDYTFEMKPCYDMVKLGI KALDKQIDQCTDAIKTLNVQFAAEC DRLKNSIKV | 108 | No significant similarity found. | | | | No putative conserved domains have been detected |
| 78 | 78320 | 78496 | MVASVHTPPYERPAPNLTPEQKQLI ARRTLEFKESLHKSVGRYSEQVHD LVVKTLKLY | 58 | No significant similarity found. | | | | No putative conserved domains have been detected |
| 79 | 78498 | 78570 | GCUUCCUUAGCUCAGAGGAUAGA GCAACGGUCUUCUAAACCGUGG GuCACAGGUUCGAAUCCUGUAGG GAGUA | | | | | tRNA1-Arg | |

Fig 2V

| | | | | | |
|---|---|---|---|---|---|
| 80 | 78725 | 84 | MAYKIEYLKKGVLTELVIDANMARN EGTKSVFYKDGSVARMINTEDIQDL YVISDEEAGFVKDPEPAEDTPTEDT PVADTTTEEPPVEGTPEDEAAV | 97 | No significant similarity found. | | No putative conserved domains have been detected |
| 81 | 79051 | 85 | GGGCCGGUAGCUUAAAGUuAAAG CAGUGGCCUCAUAAGCCAACGAg UGGGAGUUAGAGUCUCCCUGG CCCA | | | tRNA2-Met | |
| 82 | 79147 | 86 | MSTKNAIVSFVDSGIVLESTVTDIS PKRLLHRDGDILEILNKRSETMLVIP VNRLLSIKIVWED | 65 | No significant similarity found. | | |
| 80 | 79344 | 87 | MDAQLQTQYYMLLGMLEDAGPTV RGHYERHKAAFEALLKEVNENEGG KGSDSYAAFIIALQVFLINQLK | 69 | No significant similarity found. | | No putative conserved domains have been detected |
| 84 | 79564 | 88 | MLNIKRKGFFYKWLNFSSASFTYRL NDNRVTLCSLFWHSWYFLLQIGV TAIAVLFSLGMGSILSTFLGLTFELGI TPWYMLVGLSLAGLSTIIAILLAIAGI GWACAKIGDRIQEWNASKSFERAQ KEYNARDEELRFGNIYQKMRIYKKD KLCPLIRVDHGE | 164 | No significant similarity found. | | No putative conserved domains have been detected |
| 85 | 80153 | 89 | AAGGGAAUAGCCAAGUGGUuACG GCAUCGGCCUUUGACUCCCAGA UcGGUAGGUUCAACUCCUCCUUC CCUUG | | | tRNA3-Gln | |
| 86 | 80239 | 90 | GCUCCUGUCGUCUAAGCuGGUuA GGACACCACUCUUUCACAGUGG GAACACGGGUUCGAACCCCGUU GGGAGUACCA | | | tRNA4-Glu | |
| 87 | 80589 | 91 | GGGGAUGGGUCUGCUGGAgu GGACACCGCACUUGCAAUGCGG GAAuCagAACGGUUCAAAUCCGU UAUCCUCCACCA | | | tRNA5-Ala | |
| 88 | 80675 | 92 | GGGGAUGUGGCGAAAUUGGCaG CCGCGCUAGAUUUAGGUUCUAG UGGuGAAAAUAUCCGUGUGGGUU CGACCCCCUCCAUCCCUACCA | | | tRNA6-Leu | |

Fig 2W

| | | | | | |
|---|---|---|---|---|---|
| 89 | 80779 | 93 | MNIEIMQLDRKKNEFRKVHTFPSKE ALEFHKCMGLVLPESEIFDLACAN GVLYVWEITYHADPDELRKEVEQIL TGE | 78 | No significant similarity found. | | | No putative conserved domains have been detected |
| 90 | 81007 | 94 | GGAGAGUAGUGCUCAUGGGAGC AGCUGACUUGAAAUCAGUCGCC AUCGGAAACGUGAGGGUUCGA UUCCUUUAUUCUCCGCCA | | | | tRNA7-Ser | |
| 91 | 81099 | 95 | GGAAAGCUGGUGAAAUGGUaGC CACGCAUCACUGCUAAUGAUGAG UCCGCAAGGGCAUGAAGGUUCA AGUCCUUCGCUUUCCGCCA | | | | tRNA8-Ser | |
| 92 | 81444 | 96 | GGGAUAUUAUCAUAACUGGAUAA UGACCUCGAUUGUGGAUCGAGU CUaUCUUGGUUCGAAUCCAAGAU AUCCCUCCA | | | | tRNA9-His | |
| 93 | 81528 | 97 | GCACCAUUAGUUUAAUGGAUAGA AUAUAGAGCUACGAACUCUAUGG UUGAGGUUCGAUUCCUCGAUGG UGUACCA | | | | tRNA10-Arg | |
| 94 | 81732 | 98 | UGGGGUAUAGCUCAGUAGGUAG AGCGGAGGCUCUCUGAAGCCUAG GuCACAAGUUCGAUUCUUGUUGC CCCUGCCA | | | | tRNA11-Gln | |
| 95 | 81810 | 99 | UGCACCCUAGAGAGGAAGGCcgUC CUCGCCAGUCUCAUAAGCUGGA GAuCGCAAGUUCGAAUCUUGCCG GAGCAUCCA | | | | tRNA12-Met | |
| 96 | 81900 | 100 | MMRISFTERVLGTGVMLITSWDGD SWCNVTGLRKSEQTPENIAKIKKR MAEAASRPGAPRNGKR | 64 | Hypothetical protein [Bacteriophage 5] | CAE53211.1 | 2e-18 (41/63) | | No putative conserved domains have been detected |
| 97 | 82081 | 101 | MVNVEVTMTRYQGMLINTHTKEIVF LAPAFHDTYNEAEEDARIAKIHPDE EICVRQQEQ | 59 | No significant similarity found. | | | | No putative conserved domains have been detected |
| 98 | 82262 | 102 | GCUUCAAUAGCUCAGUUGGUAG AGCAAACGACCGAUAAUCGUUAG GuCACUGGUUCGAGUCCAGUUC GGAGUACCA | | | | tRNA13-Ile | |

Fig 2X

| | | | | | | |
|---|---|---|---|---|---|---|
| 99 | 82495 | 82571 | | GGUCAGUUGGCAGAGAUGGUuU AUGCACUCGCUUCAUAACGUGAGA CUaCAGUGGUUCGAGUCCACUAU UGACCACCA | | tRNA14-Met |
| 100 | 82575 | 82650 | | ACUUGCUUAGCUCAAUCGGGAG AGCAUCGUCUUUACACGGCGAG GGuAGCUGGUUCGAAACCAGCAG CAAGUACCA | | tRNA15-Val |
| 101 | 83285 | 83566 | 103 | MEKITATGIESALVVDWAGWDGDH EWMVFYSCTLQPELWTRLTDEHA MPYGIIDVEIEINKLVGTIMVHRAEG DHKEIFRKSIKLVVSTGDFI | Hypothetical protein AGC_0078 [Enterobacteria phage EPS7] YP_001837001.1 3e-09 (31/87) | No putative conserved domains have been detected |
| 102 | 83587 | 83964 | 104 | MYTRPTNGNSAVVRLMIVQDNLSN NIESLDRRIEEYRTEMLSLMREREA KIEEQLEVCEAIDRLVDGTAVFMAE APAEPTFTPVAPADMQYAILPFHLE EDGEGPSLEDVVRFLLASGFPNG GR | No significant similarity found. | |
| 103 | 83964 | 84179 | 105 | MDFIVVCGANTDCFELLNDALDKVD EHMQEGRTPTFIDLSQGKTYFYPSL DVEPTVLPIFMHSLSWDEEDD | No significant similarity found. | No putative conserved domains have been detected |
| 104 | 84374 | 84450 | | GCGGCUAUGGUucAGCGGUcA ACAUACCGGCCUGUCACGUCGG AGcCACCGGGUUCGAAUCCCGUUA GCCGCGCCA | | tRNA16-Asp |
| 105 | 84784 | 84861 | | GGGAGAAGCagUAAGUGGUAU AgGCGGUCGCCUGUUAAAGCGAAU GAcAGUGAGUUCGAAUCUCACCU CUCCCGCCA | | tRNA17-Asn |
| 106 | 85090 | 85163 | | GCAUCAUUGGCGAGUGACUAG GCAGAGGCUUGCAAACCCUCGAA GCAUGGUUAAAAUCCAUGAUGGU GCUCCA | | tRNA18-Cys |
| 107 | 85180 | 85359 | 111 | MIKYKAFVTRESQTGDSSIKFEGTT LHDTFEAALTEAETHIVSKSCYAHV WEVNTILDR | No significant similarity found. | |

Fig 2Y

| # | | | Sequence | | Similarity | | | |
|---|---|---|---|---|---|---|---|---|
| 108 | 85350 | 85425 | AGAUCGCUAGCUCAAUGGUuAGA GCACUCGCCUUUUAAGCGAUAG GuUCCGGGUUCGAGUCCCGGGC GGUCUACCA | 112 | | | | tRNA19-Lys | |
| 109 | 85601 | 85678 | GCAACUGUAGCUCAGCGaGGUgA GAGCACUGGUUUGAAAGUCCAG GGGuCGUUCGUUCAAAUCGAACC GGUUGCACCA | 113 | | | | | tRNA20-Phe |
| 110 | 86126 | 86320 | MNQKILMRYNPRALWFRWEVIVSY QIRVRNGDPENNIJVLETFSNRDAA VKFLNTIDNTLIKVY | 114 | No significant similarity found. | | | | |
| 111 | 86323 | 86661 | MDIFTTPAINLVGVGLFQATVYRIDD STDVVTFIVPEFFLEKFFEEFEQFRE EHDAYSNMEDLAAMFPTVYGYIFE GNDLLLDKSELVELNWGISFEVGSP FPRYFQGLEIR | 115 | Hypothetical protein AGC_0081 [Enterobacteria phage EPS7] | YP_001837004.1 | 3e-20 (48/53) | | No putative conserved domains have been detected |
| 112 | 86661 | 86810 | MGGYSNFIENYINSVDSWNQETLV VVLKERFNISTLEALEAIEAYLDND | 116 | No significant similarity found. | | | | |
| 113 | 86812 | 86889 | ACCCACUUGGUCCAAUCuGGUaG AGGCAUGAGGCUUAAGACUUCA GGGuUCCCGGGUUCGAGUCCCGGG AGUGGGUACCA | 117 | | | | tRNA21-Leu | |
| 114 | 87022 | 87098 | UUCCCCUUAGCUCAGUCUGGCAG AGCGGGCGCUUUUGGGAGCGUCA GGUCAAGUGUUCAAAUCACUUAG GGGAGACCA | 118 | | | | tRNA22-Pro | |
| 115 | 87104 | 87179 | GCCUCAAUAGCUCAGCCGGGAG AGCAACCGCCUUGUAAGCGGUA GGuCGUGGGGUUCGAUCCCUACU UGGGCACCA | 119 | | | | tRNA23-Thr | |
| 116 | 87472 | 87547 | GCGACUAACUGUACGGGuuACAG CGUCCGCCUUCCAAGCGGUACU GAGuGGGGGUUCGAUUCCCCUA GUCGCUCCA | 120 | | | | | tRNA24-Gly |
| 117 | 87647 | 87748 | MKAFDAELVFSLLAEMEACVDRVR ALRLSMFSS | 121 | No significant similarity found. | | | | |

Fig 2Z

| | | | | | | |
|---|---|---|---|---|---|---|
| 118 | 87867 | 88058 | 122 | MLTVKVMSPNGGEEIHDGSSVGFN PKQKSISIAGLDQHIFLKEDEVAYVM NQNGKTVSVYHGS | 63 | Hypothetical protein ykris0001_9300 [Yersinia kristensenii ATCC 33638] | ZP_04623722.1 | 5e-18 (45/60) | | No putative conserved domains have been detected |
| 119 | 88063 | 88139 | 123 | AUUCCCGAGUGUUACUGGACAG CACGCCGGUCUCCAAAACCGuGC AGUAGGAGUUCGAGUCUCCUGG GGUUUGCCA | | | | | tRNA25-Trp | |
| 120 | 88156 | 88512 | 124 | MITYSTNFMGPVSNNWVIRMGIPYT EVTEPNRFADGGQLTRKVFAKRYA GGRIDVRGTDDYFGQEIGVPIMEAE SWNELQQFLWTFSSDKVLTLEQIV QALEDETGFRIWFKEPACT | 118 | No significant similarity found. | | | | No putative conserved domains have been detected |
| 121 | 88503 | 88883 | 125 | MYIDRNQLFKFLELDLRWPLSVNP GRATGKTFEAINTAYEFAVFKGIQA VYVASGVREMARLEKKYNELQPHV KITTYSMLEPYRIGRRFSCIMFDEPS LAIKYGVNAYVVRIARENQCPVIIFG E | 126 | No significant similarity found. | | | | No putative conserved domains have been detected |
| 122 | 88885 | 89061 | 126 | VEQEFQVFVDASKRVLFIQATDEG HGLQLSFDSLEQINQIVLRAQKSLE KNTEAPPDL | 58 | No significant similarity found. | | | | |
| 123 | 89156 | 89371 | 127 | MREISKMKVTMENTEEFIAICTAYA DTLPPEGMDDHTMQLVADIYRLAE LAKEQHNRLVYVKERLEMMDKE | 71 | No significant similarity found. | | | | |
| 124 | 89375 | 89647 | 128 | MNELNELNELHYAERAIDELDFAGG YYTRHVNAMTAEGLNSKSAIAAELA VRDFVIDSLQKTISNLSENNKAALEA LDKLSNHLLALGIK | 90 | No significant similarity found. | | | | No putative conserved domains have been detected |
| 125 | 89647 | 90189 | 129 | MNKQSLRGIRVFRSSLVDSFYIWG KATRRTVEQALDGTFYDWREKERN PVFSRPGLYHDRVSKTAWYEIEVT PGVIRAFYTDWEHEKWVWDNQIAP GDRIMNYAEYKEMKRMFELYDVPR LSRPAIFIASQEYWHTVRMKRDFNK HHLRYEKEHGTLRERVAKRKAELR EKRLEKKYGES | 180 | No significant similarity found. | | | | No putative conserved domains have been detected |

Fig 2AA

| | | | | | | | | | |
|---|---|---|---|---|---|---|---|---|---|
| 126 | 90176 | 90403 | 130 | MVKASLLRFTPGVGLQYKIVGGHK FQYFTPGKLYFVELHDSRAGYKLR SDANEGIWVSFTQVKRWFTVEGYN DYE | 75 | No significant similarity found. | | | |
| 127 | 90390 | 90758 | 131 | MIMSKVVYFVKCCRDTLELVDHKM QTCKCGASSIDGVAGAYVRFLGDK SNFMRLNEFQLEVEKNRPALEAEA ERLKDFDGNIVAYNMVSGKDFWSE LAEKLNMPRQAAKALYHGFNYSPR WN | 122 | No significant similarity found. | | | No putative conserved domains have been detected |
| 128 | 90727 | 90993 | 132 | MASTTRHVGIKFSNSNRTYVYRVP SYWKYSPEIGDVVVIPGNVMFNNP RRAKVVEVHGMYGSKPEYKERKNIS YVELHDYLPKEERNGR | 88 | No significant similarity found. | | | No putative conserved domains have been detected |
| 129 | 90983 | 91288 | 133 | MDDKIAREAIELVRKRLEERNVEVP KIMLIGYGGIGGFPSFTDLERMERE SQASFLELESYAREMEHEHPIGNN FMPRSSRQEVTHGKTNSWPTPKR RGRK | 101 | No significant similarity found. | | | No putative conserved domains have been detected |
| 130 | 91285 | 91494 | 134 | MITTGFGYSHEELCKMVESAPFIKK LVEEQRPVCLHAACTKCHGTGVDK NGKMCVHALSCPCPKCSWSC | 69 | No significant similarity found. | | | No putative conserved domains have been detected |
| 131 | 91496 | 91933 | 135 | MDLGYCVVHEFMEQGLPDRICVVT SRNLEAAQSLVERLSGYYRDHERY QQKVFDLTKLYHQKALDMPTPQLD DLKQFSPEAWYSVKDASPVDYTVQ VFSHYGTRHWINRKWDSMVDYLN SELEKGAAEYKRKRAEAKVLKNSV AL | 145 | No significant similarity found. | | | No putative conserved domains have been detected |
| 132 | 91980 | 92303 | 136 | MSKLSIESIIRPLMHGYVQGSCVSE TEALNVIEEELVANGYNLHEGVIEDL FWQTAEDMEIFRCVNCGWWCPAF ERAENQIEEICRDCEPDLEGEVDEQ DNEGEDYE | 107 | Hypothetical protein T5.053 [Enterobacteria phage T5] | YP_006881.1 | 2e-05 (31/87) | |
| 133 | 92296 | 92568 | 137 | MNKITKVKTMSKRSIAAIIAFSMMYS GVSLAAERNKVEISDNGRVRVTTN GITKGAGKFRKSETRFGETKIYTNK TYGKPAVTLDRYGRQVEDEDDSDE | 99 | Hypothetical protein AGC_0054 [Enterobacteria phage EPS7] | YP_001836977.1 | 6e-04 (25/70) | No putative conserved domains have been detected |

Fig 2BB

| | | | | | | | |
|---|---|---|---|---|---|---|---|
| 134 | 92561 | 92995 | MSNLHPKLQETLDWINEECAFEEA PYCVWARAGAAPSEWCTVFDNRY RITVELSLKEDKVYAKASMTALGLS GFVEMQELCMPNTHLRVQIEQLATI RLMLPEDNINDHFHKVIENEYKLRR QRRKARREVEKTRMMCNMNPHV | 144 | Hypothetical protein AGC_0053 [Enterobacteria phage EPS7] | YP_001836976.1 | 1e-14 (43/115) | No putative conserved domains have been detected |
| 135 | 93115 | 93507 | MFTLFILAVSAWMAVGINHGLDSAK LLSAKAFEFLAKFATRKDIEAIIAKG GAKDASSVLKSFDKILELRNGKHAA ELRCMSRKTIGRLCKAIFIVQGALK GPFAKYKPDSIKRAKIFNDYCVEHH PLNR | 130 | No significant similarity found. | | | |
| 136 | 93616 | 94314 | MRIISKLKDVYDLQGTMYDAERAW YREEVKEVVNVSADFEQIIFYAEILR NRTSSGYGGVNMGTLEVRPVLICG TLRWLYGYHTGLGADAVHIQTFDP VKVKEVLEEQGYYLRMGWDMNTIE KIDAHVRNATATASAFLETFNKPIA MAWDAAKSKTDPTVNITVKTDFNF HAEDFPWQEIDPNLYRWHQTLESY IFGVLGQGEPKTESTSDRDRLIAKG FDAKVSFRNMER | 232 | Hypothetical protein AGC_0049 [Enterobacteria phage EPS7] | YP_001836972.1 | 1e-34 (92/237) | No putative conserved domains have been detected |
| 137 | 94280 | 94741 | MLKFLSGIWSGKTGAILFLAIAAGTF GGAYYITNKLTDMSSSLQSLSNRN EQLEKTVGNLQTEIRNRDRNTTTYI TNLAKNQEDLDGRINKLDAARAKE GVVAAKPKLATKVAKDKVNEFQER LSCVTGNMDSCSRLQLSHPGVGN. GQTQVAQ | 153 | Hypothetical protein AGC_0048 [Enterobacteria phage EPS7] | YP_001836971.1 | 2e-20 (56/143) | No putative conserved domains have been detected |
| 138 | 94654 | 94983 | MRNWKYGLLLSAAIIASGCAERPDP SSTVTGVEPQHLPWPASLQTCPFN FEFINEEGKYVRIPYQDWITMGKC NEQVYTYIANLTALTCTYRVSLNEY RCKPFNKETK | 109 | Hypothetical protein AGC_0047 [Enterobacteria phage EPS7] | YP_001836970.1 | 1e-19 (50/108) | No putative conserved domains have been detected |

Fig 2CC

| | | | | | | | |
|---|---|---|---|---|---|---|---|
| 139 | 94980 | 95741 | 143 | MKYVLGLIGDAGAGKDTFADMAKV WAWEVLGPEYSISKFSFAAPVYEL AAVILGVTPEKLAERRTKEIKQWFW VTQEALERTANVWKRFGIDKYADF SYVWPQFEASALYPLIAKTAPDFYQ GRETPLYPLYTSPRKMLEFVGTEL GRALVDENLWLNIVVDRITATKADIS IISDVRFDNEAALVRNFPGAQNSSIL KVHAPNNIHAIQSTHASARGVAPEF IDDVVTNNFDGLENFRKNVNAFCD ERILFI | 253 | Deoxynucleoside-5'-monophosphate kinase [Enterobacteria phage T5] | YP_006871.1 | 9e-54 (117/250) | deoxy-nucleoside-5'-mono-phosphate kinase | No putative conserved domains have been detected |
| 140 | 95751 | 96362 | 144 | MGQINNVEQKGGNKTPNYFASLVA TKAEYNIYHYHLDGPIVDVDYYRDL SVTLATMQEGDTLNLYINSPGGYV DTAVQLCNLIMNCOGTVIGHLVGPS ASAACSIFLACHGWLVHPYVMLMG HTYRGAHYGKGKNEIQHYADQFNS FFEDMMLDLYYPFFSLEEITEMIEG GKDIWLTSKEINERVDRMAAHREQ EARKAAGQ | 203 | Putative ATP-dependent Clp protease [Enterobacteria phage T5] | YP_006870.1 | 7e-51 (96/181) | ATP-dependent Clp protease | S14_ClpP_1, caseinolytic protease (ClpP) | cd07016 | 5e-19 |
| 141 | 96520 | 97182 | 145 | MDKFIQLISLLLQEAKDPASLLKRLL TLLVGLVIYLFIANTSEVMSYLKTFS TSAVLQDVKVQRTLEFPNVAREKA MILFSQTRADAVFVVKYKPEAINDY QTIIAWESNVQLDKSDVSDKAVDKT SMLYRAHLDGLNFAIDAREKRGLSK WSGTGLPPFKSANFEYVYTCPYFN LNNIYSGYVAVAWEKYPLQDEDMG MFNDYMAKICASPQRSLGRSI | 220 | Putative holin [Enterobacteria phage T5] | YP_006869.1 | 1e-82 (144/220) | holin | Bacteriophage T holin | pfam11031 | 8e-47 |
| 142 | 97179 | 97592 | 146 | MSFRFGNRSLQQLDTVDPKLKALAI RALELSPHDFTIIQGKRTVQQSAQN IANGTSFLKDPSKSKHVTGKAIDFA PYINGKIDWNDLEAFWAIVGAFKKA ANEMNIAVRFGADWNNSGDYRDEI QRGTYDGGHVELL | 137 | Lysozyme [Enterobacteria phage T5] | YP_006868.1 | 8e-57 (104/137) | lysozyme | No putative conserved domains have been detected |

Fig 2DD

| | | | | | | | |
|---|---|---|---|---|---|---|---|
| 143 | 98142 | 98546 | 147 | MSDRFYTQMCEHFKVSPYELNIAL WDRESPEFKKIAKKSEGVMSNGKK MTRIDLNNALTKLLGVNIEGQKLSM PTLTTILEKVKAGDVKKVAVPEGRL KKPYQEAIIEAFGEKLDLDTATVKT MKALLESINNV | 134 | Hypothetical protein T5.038 [Enterobacteria phage T5] | YP_006866.1 | 1e-37 (86/141) | | No putative conserved domains have been detected | |
| 144 | 98539 | 98823 | 148 | MSKKIVFLKGSSCVPCKQFEPVFDK LTAEFNLPVEKRTDDVDSLRKFGLR TVPAVVLVDVENGREEAHHILSGAT LRSAVVSKAIQDFIDYVEE | 94 | Putative thioredoxin [Enterobacteria phage T5] | YP_006865.1 | 6e-21 (48/91) | thioredoxin | TRX_family | cd02947 | 8e-04 |
| 145 | 98925 | 99329 | 149 | MTKQAYLILNNGFAVGTTFVDLGYT KEEWQALDAAQKNQLVNEAAWEY AEAYVEAVDDELVIVVSLGAVGCDA HVHTDFQSEEEWDELDLTHQNALI NEAFWEVVDCYVAFCKDDDEANT CTNYGYEHDDVECA | 134 | Hypothetical protein AGC_0039 [Enterobacteria phage EPS7] | YP_001836962.1 | 3e-21 (49/103) | | No putative conserved domains have been detected | |
| 146 | 99329 | 99691 | 150 | MQKFSRDWSSDMARKNRAAAYYN KKIQLDKLIKGITYNVERGFSGIKVD ARSLDYSCILWAKQNGYAFKRIGNE ILIAWEPEGLVQYIYDPYRGEYVR DHRQQPTDFSLPKRYYLETRY | 120 | No significant similarity found. | | | | No putative conserved domains have been detected | |
| 147 | 99691 | 100521 | 151 | MNVHETVTVPDNANIFFIGDIHGEY DMMMGALKLAGYEEGRDYVFCVG DLIDRGPKNLQVLAKFLYNPKFRSV RGNHDEFMIQDDYANWMYNGGS WTITEGFDTDTMKGIAEDMDSKMP YIMTVEHRGKRYGVVHAGIPLRYQ AQGMGVTVPVWDDIVHEHESTPDL RRLGVLLWDRDVIQEVGFNLYRSG EKHPYFDRYASFSEECAVDVPEIVG VDYTFHGHTGVPFPIRWKNRVYLD TGGTFNGRMTVASPVLGQLYTFTT DRDDPCGSADII | 276 | Putative serine/threonine protein phosphatase [Enterobacteria phage EPS7] | YP_001836961.1 | 3e-98 (176/283) | serine/threonine protein phosphatase | PP2Ac, protein phosphatase 2A homologues, catalytic domain | cd00144 | 2e-08 |
| 148 | 100532 | 100765 | 152 | MKLFKDLEEGEVFVVAGGFELQKC VAMLDNGNSVFTDDANISVTIAPDT ETWKPKEFWEIHKDRPLDDLLDDIL FTA | 77 | No significant similarity found. | | | | No putative conserved domains have been detected | |

Fig 2EE

| | | | | | | |
|---|---|---|---|---|---|---|
| 149 | 100774 | 101142 | 153 | MKLESRYIVFKQSDAAKYLTSTAIR EINDSLSLIYKGREADGKVGFPNYIV LEEDWPEYPIAKEALEGRIVLEEFN KRAEKKRGAKAAEDHYKQHQSTEL LRGISPFCAGWNDYMRRLVIEE | 122 | No significant similarity found. | | No putative conserved domains have been detected |
| 150 | 101145 | 101264 | 154 | MYTGMGNDMAKMFIGLLILAALVGA AIVGGIWALVAFVF | 39 | No significant similarity found. | | |
| 151 | 101328 | 101756 | 155 | MKNAMIELNANMESLRHAVNTARA SFNLLMRDESIPLSARVKAFEEFAD ELLHMGDYLSDSPFNEDRRDYQHA YCNRGEIVYLTDVLESVLEYANSFM RTPDEWEDASNDYVLDEIQKNWPE IKKLVEEHIHSEVYAYRIDW | 142 | No significant similarity found. | | No putative conserved domains have been detected |
| 152 | 101838 | 102143 | 156 | MAKNTISYTTGKTADEQANTLTKDE MVAVLVILLDMSGFEGQLAKLSLPA LRALYEGTNKNAAAYNLAKNEARW AKEHQQVAERRAESFERDLKREKA KKK | 101 | Hypothetical protein T5.032 [Enterobacteria phage T5] | YP_006860.1 | 2e-23 (52/81) | |
| 153 | 102143 | 102424 | 157 | MVLEILSGLLIAALVTGTGLAVWVSI LRENNRRMRLTNNGLHEKLMDQV QDADEFSAAAERLLVRLAKIEEIIGQ DSTMSKTTKMRLITEIKK | 93 | No significant similarity found. | | No putative conserved domains have been detected |
| 154 | 102421 | 102669 | 158 | MISPIVAALYLVVVGYLSGKYHGFG LKGTIKAAMLVPLYPLAILLTGYYAC VLRIFGRGKVNYDNCTALLDDIENTI KKEEK | 82 | No significant similarity found. | | No putative conserved domains have been detected |
| 155 | 102666 | 103007 | 159 | MNLNSKERQVLVDALRQVDHDLL CDEDIVESIALIAKIELAEKDSWRPL SELPPLGLAIVVQRADGAPFNTVMV RRDLAKSYSPDIITLHTKITNEPFEF NTRHYYWRLTNA | 113 | Hypothetical protein T5.028 [Enterobacteria phage T5] | YP_006856.1 | 7e-08 (40/111) | |
| 156 | 103000 | 103227 | 160 | MLNQLRIYNFLDCNFQWWRELPSR FLGWALFLSMVVSVFHNVPATFYM EAIQPVTVFIYEMYLVAINGWKDGRI N | 75 | No significant similarity found. | | No putative conserved domains have been detected |

Fig 2FF

| | | | | | | |
|---|---|---|---|---|---|---|
| 157 | 103211 | 103678 | 161 | MAASTEVLNQYFNREHQEFSDLFI QMFVNANNALDYRFFNEFHETTFS HQDINSALKELIGSKVIPFRQTANAE TLELSVVWGLFKKAYEFGKYQNAR HWIYEVYLNTEVILPRQMMLGWIAK QRPERNAKSFAPINDGNLYHASEK FDAPKSVA | 155 | Hypothetical protein AGC_0027 [Enterobacteria phage EPS7] | YP_001836950. 1 | 7e-32 (65/147) | No putative conserved domains have been detected |
| 158 | 103701 | 104027 | 162 | MLLVEGLTEEDICLNSFYNCKTHVM QALDEERVELSKFMVNIATAQVHW QTQGLSADDILKHTLNAIAEYGKAR GEALLASKKEFDKSESMLKMAIDIH MEGIDGTIH | 108 | No significant similarity found. | | | No putative conserved domains have been detected |
| 159 | 104039 | 104326 | 163 | MAKKRVVVNFLEEDSGDCEYGCW NTGYGVEVMVDGKCVHRQEAWAS CTNNSSVDFDVLAHVLQGIKTKEGY PVKADHIDFGDPSDYPEEFLDLFT | 95 | No significant similarity found. | | | No putative conserved domains have been detected |
| 160 | 104378 | 104566 | 164 | MKSIDNYLRGENPVDQAAVTVEKV RKECFILTQRGGGNRPNRVYLNWT QSKDLYERLKREFE | 62 | No significant similarity found. | | | |
| 161 | 104566 | 105042 | 165 | VEELRQKINQELVWEAKSFPINQFL KRDGSINHNKIKQLRPDFRQDAKNL IFINRALDAHGVFFGYEKLVFHSLN QLVEIWCPDHQDYFMQTARSHLEG NGCCKCRHRMVTRVTDYGSYTVP AYYHKFSIDGDSIIWYNNSSKLIKPL EVKDEIRFPE | 158 | ORF022 [Enterobacteria phage T5] | AAX11959.1 | 2e-50 (91/153) | No putative conserved domains have been detected |
| 162 | 105020 | 105421 | 166 | MKYDSLNNPSTNYLTDQSVSEIKFH PNYSPDSSKPSVAAISFRFRNLRFT FVGEEDKMISIIDKVKAYSELSGSDT VKFEALTSLLLTSGATVGKFELIQPH VSALTNTRNFWDQANVESLIKWDS ATEFYNK | 133 | No significant similarity found. | | | No putative conserved domains have been detected |
| 163 | 105434 | 105943 | 167 | MLFCTVDFEEANETYIVYGMSESKV RILWNQFQLEVPDDISKTPKDFFHLI DIKAVKARKKLTPYVFPGAVFVHEL TAYTNVVLKKSRQHPGYLTMLTYK VGAIHDGELVVRVDARLQOEVEEMI RQCCQNKAELKQRARLFDMAAPSEA VAAYHGFYKEIAESDEDFFM | 169 | No significant similarity found. | | | No putative conserved domains have been detected |

Fig 2GG

| | | | | | | |
|---|---|---|---|---|---|---|
| 164 | 105956 | 168 | MNEKYEVWTPVGENCSYLLRTLCT REDGTSFSEYLSECHAKAQQDNPL FKIRGEDILKVNGVPYTPVDSFAAL QVFKEHREREHRRMIERLTGREPF SHPRWNEET | 106 | No significant similarity found. | | No putative conserved domains have been detected |
| 165 | 106276 | 169 | MSRVEKLQHIYNLVKKADQKKLSEL SEEEYQAVLFCCSAMPAKLDGVLA KSDIHNGKETTFQPPYKWLASNIQQ MVGKVTGFSNRKTPNIFIDITPRTPE FTKDWRDALDSFPSWKVFYKPDDE TYAHLPFLKHPGYTVEDPSSGVNF KDFKCTDENIAYGLMRTSVRIAMDH ELDKQDLAVIALCKDRYIKVKRIAEK LSVLSCFETIRDCEPEGEYPKGSLY WKDVKHLGLSEEAVFLGLVVTGRF LRLQEK | 254 | No significant similarity found. | | No putative conserved domains have been detected |
| 166 | 107102 | 170 | VGYSRDPFYRLNSLQLHRLPHRGL QDIVIHSVYIIDDASEFSAKLLEKAAH KKFKPMRVNFGDKFDGHTEWFDV EPHVIEKFFLSVGAKQVPIDKLIAQE QKIRKSTKK | 109 | No significant similarity found. | | T5orf172 domain / pfam105 44 / 1e-05 |
| 167 | 109330 | 171 | MRTLRGGSPKSRSHNTYQLNVIRD GQKKGGDGGGGEWGFRVIMVIIMT LVFLQSCQ | 56 | No significant similarity found. | | |
| 168 | 109640 | 172 | MLQKFTPVANLPMVRGGARNLLDG SKCASIGHILGVYRSNMESRTSRAF EHSRDYVLANPGAAIVIFHDDQYLV DSCPIDLIVSTTTDAYLYKASEGKQ ASRRFCYHESELLAFTDARAWIKNL CDHLELPPARISSEMMIFVLDKDGSI LLPCDPYDIDIEEGARTGNYRYDGE LEEVAPAVTENVVNPNNFETGALQ MNTIKSTATAIVAANKNAAVNAAKL EAGSIVLKKVSGIAASKAPFMVRGY VDTAVGRVVIANLLNFAVSQYAPNN RKAVIAADAAMQAAMLELVQSFNV GEMIDEVLKGVNLSSLIESDVAE | 321 | Hypothetical protein T5.011 [Enterobacteria phage T5] | YP_006839.1 3e-39 (116/324) | No putative conserved domains have been detected |

Fig 2HH

| | | | | | | |
|---|---|---|---|---|---|---|
| 169 | 110672 | 173 | MERLTATFEGEKMTIANVWQRLRQ NGDRGNFAIFIEPKNLDNLARQIDR RDCYPDTDDMLGIPLRIIGVYGYGF DICIGDSSFEIDCESGATEIEVFLINL GSLTFLDTPPAEPEPEKLEVKTSVIV SSLTMDELADIVSTYDEIHADAIKEL NNRLDTFRDKL | 164 | No significant similarity found. | | No putative conserved domains have been detected |
| 170 | 111218 | 174 | MFHVKSCVPGINYTVEAEEGLYLE GGRIESQEVAAVLKCDTNVCGTSW TDLHFLGRGIDVDSLSWEKACEHA ESMLNEDDWDDDDSDEKYANAGV EGSFYMYWPGHSCNLVNGGSPLH SVLERAIYLGYIQIVDGKAVINLRELK TFIYIPDAETILHIEEGLKSGWKVSG VVYL | 175 | Hypothetical protein AGC_0009 [Enterobacteria phage EPS7] | YP_001836932. 1 | 2e-09 (43/137) | No putative conserved domains have been detected |
| 171 | 111742 | 175 | MIYIYVNKYFLAHYKTMESVIQYVSR QNARHIDEVATLKIGLRGDAINISWP LLILICRDLVAGKPVSVSALGESYPL SDDLDLYDLLTKYKTERLFYRGGSV CSSGETIETVFR | 115 | No significant similarity found. | | No putative conserved domains have been detected |
| 172 | 112942 | >113073 | 176 | MLKENVMSSEIVNEFTVADAEHFIE TYLNVYDVDLAFIHKDGQI | 44 | No significant similarity found. | | |

Fig 2II

Table 3 - Features of phage F394/08 gene products and assignment of putative functions.

| orf | Start position | Stop position | SEQ ID NO.: | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| 1 | <2 | 268 | 177 | NPEQGQAAAAESTPADPAANVS RETKPEDLIKNDVAPAELTPAFYV VAEGRAITSKRGILAAGEAVEARD FVGGEETLNSLLERGLVE | 88 | No significant similarity found. | | | | No putative conserved domains have been detected | | |
| 2 | 265 | 720 | 178 | MNIRDLAAQDFLNIVNDKNSGFG VPVVLIAPDGNAQPLSGLTTDISS YIDPETGVLVAGRVASVTFANKAI RAAGFAEMPVAVADSNKRPWVV CFRDPEGIPYLFKVVKAMPDRAIS GIVLELEVYKRSIYFNGAYKFDGT TLYDGVLDLL | 151 | Hypothetical protein orf10T [Vibrio parahaemolyticus phage VP16T] | AAQ964 77.1 | 4e-17 (51/129) | | No putative conserved domains have been detected | | |
| 3 | 717 | 1394 | 179 | MNIEGFKKLQSPINKLDSFEIVRD QIAAILFLELENQKAIAGRAQIDPA RFDMKVYKERSNPWDLFDDGEN KPIINVWFSNSDFDYTNSSTVDK QKTTAIFNIDCIATAISQETATGQT LGDEMASLEVQRVAKVIRNILMS DTNTYLQLRGLVWSRRVLSLNIF QPSAENGMMQNLCAARLVLQAT FSEFSPQYEPQELEILSVTVHNCD GQILFNKEIAKNGN | 225 | Hypothetical protein orf11C [Vibrio parahaemolyticus phage VP16C] | AAQ965 42.1 | 3e-35 (87/218) | | No putative conserved domains have been detected | | |
| 4 | 1384 | 2886 | 180 | MAISTAVDISAVARVLGIKTNFKNL RDGRVVILPQRIALIGQGSTGMVF ATSKRQVTSANEVGSLYGYGSPL HLAAKQLFPNNGDGVGTIPVTVY PLSDADGSQAATGSIELLGTQLE SGAYRVVVNGIRSEQFSILINEAG QTVLNRVAAAINSVLDMPVRATA DSELQKVTLVSKWKGLSANAISV QVDGDLGQGIEFAVTQPAGGLIN PSVSGALSQFGNVWETMVLNCL NIQDTEALSAYSDFGEGRWGALV RKPLIVFTGNTEADVNSAVSVPD ARKRDRTNVQLVAPDSIDLPFVV ASRQLARIVKIANENPACDYGSQ VADGINPGEDGKQWLYNVRDMA VKKGSSTIEIRDNQVFIGDVVTFY HPEGEENPPYRYVCDIVKLQNIIF NLNLIFAVPEWDGAPLIPNDQPTT NPRAKKPSMAVAAIASLVDSLGL | 500 | Putative tail protein orf12C [Vibrio parahaemolyticus phage VP16C] | AAQ965 43.1 | 4e-120 (228/50 1) | tail sheath protein | Mu-like_GpL, bacteriophage Mu tail sheath protein (GpL) | pfam 0627 4 | 3e-26 |

Fig. 4A

| | | | | | | | | |
|---|---|---|---|---|---|---|---|---|
| 5 | 2894 | 3271 | 181 | NAIISDAAFTKKNTFAQINEQNPK RLDVSTTVKLSGNTNILSVDLNFG FYFGNSVIVG MSVGGSIESLTLDGRTFSVAADA DSTRNLGGTDNEVEMNGDGTYR IVKTRVPSKLDGITVAIDDVRGDA EYLQELKDRKEGFPYSITYASGVI YQGTGTIVGETGISSQNATASITIS GSALTKQ | 125 | Hypothetical protein orf13T [Vibrio parahaemolyticus phage VP16T] | AAQ964 80.1 | 7e-28 (65/123) | | 2-C-methyl-D-erythritol 4-phosphate cytidylyl-transferase | PRK1 3385 | 0.010 |
| 6 | 3328 | 3774 | 182 | VEHIENTENQTLWGLPVKVAREV AEAEFIRFCDAMDVDYNTDRMTD EDAKDFNESKGLLLLDALQIGVLEI DSDGMAVVYPKKGDIKQIKFNEL CGADYVAMDNKKDTQSFAKMFA MMGSITKLPPATFSKLKKFDAKV CLSIAKLFLV | 148 | Hypothetical protein orf14T [Vibrio parahaemolyticus phage VP16T] | AAQ964 81.1 | 2e-07 (41/133) | | No putative conserved domains have been detected | | |
| 7 | 4072 | 5565 | 183 | MQSGISRFTRRAESGLRRVSDMT WNISKVSGAAAAIGGAFMAAAG GIALFVAETNRANSEINEMSKAM GVSALSARAADSLLTPLGMNWE NYTDLIEELGNKMGELKNTGEMK TFQEAIGLTNIKMKELKALKPEQQ FTRIMDSLAKMEDQQIKAQFIADEI FGGEGNKFVSALKARGLTIMTSLI ENYKKYNFYNEQGEKATAAFNAA LTPLTTTANSAKSQIAALTGGAMV PYIQKATEWAAANKELINSKIEVF AKGLADSLVMVVVVNFSEIVTWVK RVAIGIGIFLALTAVLKTFVLIMTAV NLVMMMNPIGLIIIAVVALIAVIAYLI NKFFGLQGVIAAANGVLMGIGAAI LVAMGPIGWLIGAAVLIWKNWGV LSGFFSGLWAGIVSVFQGAQNIIM GIINGIMGAIDNVINKAVSMGSAV KGFFSFGGGGDQKQAAAAGG RVASPQERTAKSVTENNSHSTVT IQDKTGRAKMSGKPGNGVRLVKT GTM | 497 | Hypothetical protein orf16C [Vibrio parahaemolyticus phage VP16C] tail tape measure protein [Phage PY100] | CAJ2846 8.1 | 2e-05 (72/316) | tail tape measure protein | No putative conserved domains have been detected | | |
| 8 | 5569 | 6801 | 184 | MSWEDRLKEAAYTAPGGTRATF LVEDVSRSFDKKTNGFTFPDASG TYVQDSGVSGFKYPLTIYFSGPD CDVEAEAFEALLRETGIGRLEHPL YGVINVVPFGTITRTDAIKTEANQ TKIELEFWETNLLIYPLPQADQLS AVFEAISDVKAALSGDVLDSIDVT DASALARFKNKITGALSKVKTALG KIKNLADLPGGLMDKVNGLISPGL | 410 | Hypothetical protein orfi7T [Vibrio parahaemolyticus phage VP16T] | AAQ964 84.1 | 4e-59 (153/419) | | Mu-like prophage DNA circulation protein | COG 4228 | 8e-08 |

Fig. 4B

| | | | | | | | | |
|---|---|---|---|---|---|---|---|---|
| 9 | 6794 | | EFISDVKAQLGDVVNSFFELATLP EQIVDSFKEKIAVYKDLFSELTSFE GIPPSNEEYEAACTGVTVTLSGLV VDLVESEFNTQSEALEAAEDLLAI FDDVTGWIEEKAQGLGRTDSNAV YQRLHSAVMTAASYLVQQSFTLK KERKLVLNRSRTIIDLCAELYGEV DSALDFFITSNDLSGAEILEIPKGR EVFYYV | | | | | |
| | 7990 | 185 | MSDVSMMIHGTRFHFWSGVRISL NIDAVATISFNAPFDHEAPGFKRN FAPFGFSPVAIDVDDQRLFTGTM LDVSPVISEDGKKEISVNAYAKCG VLQDCTAPPESMPLEFNKLNLLDI ARKMASYFGVGVVFNADPGPAF DRVACDPDKKVLEFLADLAKQRG FVIGSDENGNLLFSKSSIGGIVAKL EQGVSPLLSVSPTFNPQEYYSHIT GLSPVEVAKPAAKSTAKVKKDAA TPEKAGQGSEKATDKAGQAEIKK EPKKEEKTKKEKQKPKPTTYKKF TAIDEAPVYRPLVFKIDDAEGATD VETATKAKMARMLGNMCTYAITV STWFDASGDLWRPNTKIKLKAPD SMIYDFFEFDIKSVELSADENSQQ ANLTLCLPGSFTGEPPEIFPWEL | Putative tail protein orf18C [Vibrio parahaemolyticus phage VP16C] | 398 | AAQ965 49.1 | 2e-57 (130/39 6) | tail protein | Mu-like tail protein gpP | COG 4379 | 2e-17 |
| 10 | 7978 | 186 | VGIVATVLSNDGKDLKVDRGNGD NVTAQQFGPSGDDAPPLKNDYS VLGSAKGSGNASAVAYRDQKAE NYIAKAGEKRIYSRDESGAVKAEV YLKADGTAEIKNASGLFVMEPGG DVVINGVRITKAGVIQTPGGASMS SDFTNAGGITLGDHAADTSLHKP | Hypothetical protein orf19C [Vibrio parahaemolyticus phage VP16C] | 161 | AAQ965 50.1 | 4e-08 (38/105) | | No putative conserved domains have been detected | | |
| 11 | 8480 | 187 | MSFFDVHLFDSVDGGNVTDDLET RDGLETAYYLSLFGGNALDDGRP QNLSTWWGNIGENEAAKQYKSE AAFLLRTVPPNTANLKRIEAAASR DLAWLIPEYVNKIQVKAFMPKLNA VNLTVSLDGLDPLQFRTNWGEKV KEPVYRLLPPKVSRNNGVNLEGT AETKTKLILIRADGSRLSTLVDGS GNWKFDFYPLYGGERARMYVEG VGGKISAIVTVIGVLPLRYDGMAIY DGTHKYNGVRLN | Hypothetical protein orf21T [Vibrio parahaemolyticus phage VP16T] | 245 | AAQ964 88.1 | 7e-17 (51/124) | | Mu-like protein gp46 | COG 4381 | 5e-05 |
| 12 | 9217 | 188 | MSTPTTKEISNRILSKLETTFGQS LPKSFTRVLSTVLGGVFVILYKYG GFIALQMFVSTASAKDTDFNGKTI | Hypothetical protein orf22T [Vibrio parahaemolyticus | 387 | AAQ964 89.1 | 4e-68 (159/39 | baseplate protein | P2 baseplate J-like protein | pfam 0486 | 3e-12 |

Fig. 4C

| | | | | | | phage VP16T] | | | | |
|---|---|---|---|---|---|---|---|---|---|---|
| | | | | | NPLREWGRLIGAGDPNPAVNAIL TRIVVEKPGEILPAGTQLVNSGNG VTYITQEDIELVEGAQDIEVLAASD TSGNSCAGKAGNLNAGDVLTFA NPLGSVGRYSTVVTTIREGLDAE AIETYRARVVSRFQLRAQGGAMV DYKIWGESVSGVSRIYPYTSDLP GQVDIYVDVLEGVASQAILNQVK NAVEFDANNGLAQNRPLNALVNY LPMEFVEFNVTISGLSVEGALSVR AEIRAALEHYFNIRAPYIVGLSTDS RADRITLAAASGVVDDVVNKAGG IFNDMQLFKGQTPISFYMLGIGEK ATLVNVEYL | | | | | |
| 13 | 10382 | 11101 | 189 | MNMFKHLLPSGRAWNLTAEKPL KAFFRCLDVLRTDAVNYFNLLFLD INPKTTRLLDDQWEQQFGINRGFL TEAQRRERVAAAWRDVGGQSPA YIQEVLRNNGFDVYIHEWFDPAD RGEVGEKQPITPRNPLSIMSAQY AEVLPVVDCGEPLALCGEEFAHA GNYLGLVGYPLVNKFVYDADKYG YTVPDPAYWYHFFYVCGPNFG DVAQVEATRRAEFEALILRIKPAH LWAGVIVRYV | 239 | Hypothetical protein orf23T [Vibrio parahaemolyticus phage VP16T] | AAQ964 90.1 | 2e-45 (101/242) | | Uncharacterized protein conserved in bacteria (DUF2313) | pfam 1007 6 | 1e-09 |
| 14 | 11103 | 11705 | 190 | MSLVFNEKFPGKTAGATQNYPY GEARNVSGPGNGDGTPWDAALV NDIFGLLQGLLVRANIQPNGQSDT ALNSQYLQALLALFMPKQTPISGK LEQNGYLTIPFPVVINGQTVEREF TIQWGSKDWSSYPGEIQDSIVFE KPFKTACFGVFPIRKMSQHSAYG DGGVKPISVSKTGFTVSLQAYGG SVGHLLGYYWFAVGV | 200 | Putative tail-fiber protein orf24C [Vibrio parahaemolyticus phage VP16C] | AAQ965 55.1 | 1e-13 (46/108) | tail-fiber protein | No putative conserved domains have been detected | | |
| 15 | 11765 | 12151 | 191 | MEPISTGGTAAFLKVYGVWLAVV TALVFVATVVLMMRLPRSPQEFL VGIITTVVSSLMGGSFLILYFDLQI WANSAYGLMVIGGLYFVAGIPGW ALVRWVFNFIDAREGSTLLDIFRE FNEEFRGGKK | 128 | Hypothetical protein ACICU_01067 [Acinetobacter baumannii ACICU] | YP_0018 45726.1 | 2e-33 (66/121) | | No putative conserved domains have been detected | | |
| | | | | | | Hypothetical protein PAJU2_gp73 [Pseudomonas phage PAJU2] | YP_0022 84407.1 | 2e-07 (27/75) | | | |
| 16 | 12148 | 12696 | 192 | MSKIIAICAGHSDKDPGAVNGKRT EAAIVLDMRKMVASYLEKAGVKY LTDGKGGVNQPLAEAIKVAKQASI AVEFHCNAATSKKATGVEVLSAE | 182 | N-acetylmuramoyl-L-alanine amidase [Psychrobacter arcticus 273-4] | YP_2637 37.1 | 1e-44 (88/173) | N-acetylmur amoyl-L-alanine | N-acetylmuramoyl-L-alanine amidase or MurNAc-LAA | cd026 96 | 7e-20 |

Fig. 4D

| | | | | | | | amidase | |
|---|---|---|---|---|---|---|---|---|
| | | | | | | | | endolysin |
| | | | | | PlyB054 [Listeria phage B054] | YP_0014 68737.1 | 5e-07 (46/171) | |
| 17 | 12697 | | KNKALAKQIAAKINGVLNIPLRGE SGWKSEGSGQHSRLGFISSGGG LIVELFFISNDDDLAKWDAKKWLV AKEVAAVLIEQVKKAEAA | | | | | | |
| | | 12954 | MAALTIFNAISEVTSFAGVAREIFD TAANAMDAAQNEKKGGGNKKV WVMAYMESFINDLGENWERWAK AIFSFIDFAKSIFNSKR | 85 | No significant similarity found. | | | No putative conserved domains have been detected |
| 18 | 13318 | 13079 | MRNTADKSTIDFIEETTGDAYKPV KGCGTVRGYKAGCACNNCHKAQ IGRMADKIVKAALRTRIKSSEPTH QPKEQAWNF | 79 | No significant similarity found. | | | |
| 19 | 13809 | 13393 | MTKTELKTAIIEFSALTTLQVAGQF SIEELTGLKTHLNGQOREALLMDKA PAHIKGEKEAKINAQLSDVNNLIK KANKAIGLIQVNQAELKQSKVKQ DTHFLSTFHDVAQSYLTNELYAD LKQKALNVMRIAKANGKND | 138 | No significant similarity found. | | | No putative conserved domains have been detected |
| 20 | 14092 | 13865 | MSETTNLFNPDALDANFFYENSG QALAAALDPIEKCVLEKALKYSKY NIAEVSRILGINRLTVIKMKKHGL TEI | 75 | No significant similarity found. | | | |
| 21 | 14306 | 14076 | MKQPVIQRQQLSNFSQETANHG AKIKEILSTLFFCFMLAALSYMFIIK QADEIDKQAEFVAEYNAQFKEYP NERNH | 76 | No significant similarity found. | | | No putative conserved domains have been detected |
| 22 | 14582 | 15553 | VKKFNTKFKQNLDDANNNAFIPN SFQITNAFVDNIMDKISDAAVKIYLI TVRKTTGWGKQIDSISLSQYEAY SGKSRPTVVKCLKELVKVGLLVE HTGTRYGNSYSVALVNSIGFELLS ASKKILLVKSFNYTSKKSLLPLVKI FNTQKQLSKNTNQKQINKRDWFS LKTLKDELFKTGLQIEAEDLTAAK WFDREKTAFENYAPNQNLSDPQ KMYYFVDWLLKAKRKYDAAERQ QAAKAKAEGKNQNQNPEDTKTE NDPFKLSTKQISFFASQLAHLPSF AKYCTGNKGFKEFEMWIASMLN NPENVKKWNKYLNELGYLIG | 323 | Hypothetical protein ACICU_02758 [Acinetobacter baumannii ACICU] | YP_0018 47417.1 | 9e-48 (136/365) | |
| 23 | 15572 | 15802 | MKISNFHFQMQILLLISKNTVLDFE GLKEKLAPSITDNALTECLEELLM WGWVQVQKGLYMVSGVAYQIM | 76 | No significant similarity found. | | | No putative conserved domains have been detected |

Fig. 4E

| | | | | GDICQC | | | |
|---|---|---|---|---|---|---|---|
| 24 | 15843 | 16067 | 200 | MEKYKYSESNAVLSPHLNCGLTS VSRVGSSGQAKHKPHKRSEIADQ AEKEICKNWALRQQAFLNNSVSN AVLGG | 74 | No significant similarity found. | |
| 25 | 16069 | 16590 | 201 | MNKFIHEGKPTAQQVREALAMY AKDIKRPEFSLIVQRELIESFRNDT AHALKSAVAFYFKNRVIQRPGLVL ASGKDQALIVESCENKALKRHLV AVSGYSSQFLQMVIDHKTPLSAV AARDLKQALPKAEKLYKAECKEK DAKLKKNICGFVACYRNGCHCTK CTTAYKKYR | 173 | No significant similarity found. | | No putative conserved domains have been detected |
| 26 | 16721 | 16912 | 202 | MGVSIINLVLLVGVCLLLTNIALNC LFHTENKTYLVYACGFSAASVAG AIAGVIGCLAYGVTV | 63 | No significant similarity found. | |
| 27 | 16912 | 17187 | 203 | MKNKSILMGLFVAAAGVVFYMGA DSACNQKAVIDPGALMSLGGITV ENKKASLVRVCDTPVKENLVSFV LIKDGLRVGGVVDKSHVALIGE | 91 | No significant similarity found. | | No putative conserved domains have been detected |
| 28 | 17188 | 17355 | 204 | MSLGKRPAGATHIESDGTYWKN EDADWYFWRDLWGWCQYVGPK NRNFLNKFSVLG | 55 | Hypothetical protein ACICU_02216 [Acinetobacter baumannii ACICU] | YP_0018 46875.1 | 4e-04 (23/49) | No putative conserved domains have been detected |
| 29 | 17355 | 17540 | 205 | MDLYIGQIVGHSSPTWVVQGKLKI TKINEGKRSGLKIITATDESGKEFT AVYGVFFSVDRY | 61 | No significant similarity found. | |
| 30 | 17561 | 17968 | 206 | VRNENFEDYLKQTDDYAVLLNNY GSSLFIHENGVYRALPVRVAYAA WVSGGDRWGEVQHLKGKIKKMA ERAAETADFYHTKIEKLESSTVKK AGLLDMAEQWDGLELRGRDLEL NRVQESIYKRCAYLLRVAVNG | 135 | No significant similarity found. | | No putative conserved domains have been detected |
| 31 | 17961 | 18461 | 207 | MGNRWTLSGKVKGLKDLPESITA AQFREMIERGQVKNTPQAPKKR RSGKVSSPGEATLAQALKALKIEF VQEYRFCEYRKWRADFHIPGTNL LIEVEGGVRSGGRHVRPQGYIND TEKYNEAAKLGFVVLRFDTETVS RGTAINEIESYLERRGYFQNKGLT CEES | 166 | Conserved hypothetical protein [Acinetobacter calcoaceticus RUH2202] | ZP_0605 7626.1 | 6e-29 (68/112) | No putative conserved domains have been detected |

Fig. 4F

| 32 | 18448 | 18720 | 208 | VKKVKFKYDWRAVPDHINWLAT YEGGEMAWGYVNKPYRKENAGI WYETGGEWRHRVPVAPYRGHW TQSLEKRPSKAQLVEWVLNGAVV V | 90 | No significant similarity found. | | No putative conserved domains have been detected |
|---|---|---|---|---|---|---|---|---|
| 33 | 18896 | 20953 | 209 | MAENSFIQPIARKDAIALIGRDELV EGGPEGAANKQAIALANNIKYLM GLIPENWGVEKTEYGLDEVVRLS NGDVVKSVIDENINNPNENLSGW SFVTSNSVNTISDLLSIKNPKNGM KVYVLGYHKPDNFALLSPYEGGG LFIYSGNKAAENDGGVVLNGWIR QYYGDVDISWFGAKQGQDASPFI EAALKVKMSIVIRGEYKLETICGIP RQNNYAAKVIRIKGENQASLTVN CPDGAVFTSLDAKANPTSLSNIFT AKIDVFGINFVGTTVANSVLFNGD RLYNINIHHNNFKTNITIVKAYLKR EASRQYTQSVSINHNHLAEIHRVI ESDKSYNFDFAYNMCEACKGGM YIGVDAPYDPSGISITIHRNLWEA SGVLLKTNGGIIAGSVSKNYFEAN VYQDAAIDKCLIYINRSGTGAGYS GGLTFENNLFSGTSSIPDYVDVR VLGQSTETSGNSKSATTRPPVFI GNWSNSYMLTNMAQAILIGNKCS NREKMLNAYSPQEARVTYYSGY FTKQLANILTDKKLNLLKVNTSAV HAIGSSQANFKTTLDVIVFFKTSG AVGTAMATFKLDLFVYESVGLGA GNVPKANLKAVMYNFMQSTADD KITPTVNMFSAISDPLINVVDNSD GTYSIELSSFTNKSSPNWGFVSE LHIEYTAQATLIASHTSSYSAANLL TIS | 685 | No significant similarity found. | | No putative conserved domains have been detected |

Fig. 4G

| | | | | | | | | |
|---|---|---|---|---|---|---|---|---|
| 34 | 21027 | 21707 | 210 | MFDIDTKQLHGLERRLERLNRRG LPYATRQTMNDLAFESRAVARAE LPTRMVLRNKHAINSIQVTKATSL NISQQAAHVGSTADYMATQETG GIKTKQGGAAVSIPTTTAAGQGR NAKPRTRLPRAALKMGAIHLKRIA ASRNAKNRKQRNAIAMATSDKYV FLDLGRRKGIFRKDKGGGVTMLH DLTRASVQIPKNEWLKPATEAAE RKLPGFYGRALEFQLRRF | 226 | Hypothetical protein orf62C [Vibrio parahaemolyticus phage VP16C] | AAQ965 93.1 | 7e-29 (86/232) | No putative conserved domains have been detected |
| 35 | 21993 | 22844 | 211 | MVKKLISRSDFAAKAGVSGAAISK ACKGPLLDAVEGKFIDLNHKSAIA YLESKKNGKTTPALEGIDSLYEEA LEVCREAGRCSQTLLRDKLMIGS DRARKLVALIQNANIQDFEKPAAE KVKREEKARPHTRGTAAKKQQAI QEDDEELFELLDRNVAQYADMTL RDIVRKFGTATRFAEYLRAMKEIS MIEDREIKIAQTKGELVHRDLVSQ LIIEPIDSAHVKLMRDGSKTIAVRM AAMHGSGADINEMQLVTSELIAS FIKPVKAKVNKIATELKRGAEA | 283 | Hypothetical protein orf2T [Vibrio parahaemolyticus phage VP16T] Likely small subunit of terminase | AAQ964 69.1 | 2e-07 (35/121) | small terminase subunit | Ftsk_gamma, directs oriented DNA translocation and forms a winged helix structure | smart 0084 3 | 0.005 |

Fig. 4H

| | | | | | AAQ964.70.1 | 4e-127 (252/65 6) | large terminase subunit | Phage terminase large subunit (GpA) | pfam 0587 6 | 1e-69 |
|---|---|---|---|---|---|---|---|---|---|---|
| 36 | 22847 | 24826 | 212 | MNFIGMDWLCDKVENLTEYIKHV TPSQFNEENRYLPESVTSIPGFIR YDVNPFMREIVDCFDINSPVREV NLKKGVQITYSTVLESGALYYMG HVKTLPIMYMTADKELAKARIENN FIPMLAQSDMAHIVRSSDEGNSR KTGKTDNHIQFEGGGYLVPFGAI NANKMRSFSIAVMLKDEIDAWPD RVGKDGDPDKLSDDRCSAYWER RKIFRGSTPLIKGSSKIEKAYLRG DQRKYHVLCKKCSFPQELRWST PDGVGGFKWDTDEDGILKLDSVR YCCQQCGEPHFEHDKERLFSEK FGAKWIPTARPVEPGIRSYHLPAL YSPFGMQPWYKCVIAYLDAFDPV ERKVKDIELYQVFYNNVLAEPFEI QGAKVRFETVSHHRRTVYRLGHI PNRYAVQYAGSPILFLTCQVDVH KSFLAVSVMGWAKDAKCFVIDYL RIEGEDFSDSAEPGWGKLRELIE EKQYIADDGKKYRVALTFIDSGYA NDTVVKFCSEYSSSVVPILGRDR PSKNQAIKEFADFKTQEGTTGFRI IVDHYKDRLAPVLRREWDEMGG GLQPVYHFNAPVDLSDKSLKELT VETRKEKTDASGNTSYFWHRPG NARNELWDLLCYGHAAVEIFAWS LCVKNMEQKEVDWAWFWEFLET EAPYFEQGEPVASE | Putative large terminase subunit orf3T [Vibrio parahaemolyticus phage VP-16T] | | | | | |
| 37 | 25079 | 24870 | 213 | MQYENNLEKLKGNKPEGATIVAV KGDRIAYFKEAEQKGRLLTFNRIM WVKTWFTPDHLNLKHFDFIAVL | No significant similarity found. | | | | | |
| 38 | 25316 | 25092 | 214 | MNNQSFNNWRGHKIEIVQAGATI QQHGYPVQITDQNTIAFDGKIYMT QNTYNSIAKNMPQCQTPNFNNQ GLNIF | No significant similarity found. | | | | | |
| 39 | 25582 | 25334 | 215 | MIDKKYLVFGGWVRSKHDKQSH YVAPRMVAYLYNVNPHECIFITDK TELNPRTHLPYGLNENHNLIKLGP QTNGKYNLPATN | No significant similarity found. | | | No putative conserved domains have been detected | | |

Fig. 41

| | | | | | | | | |
|---|---|---|---|---|---|---|---|---|
| 40 | 25770 | 25579 | 216 | MGQSEARQKQKSDYEKKRVIKN FSLLKERDKHLIEYIETVPNVGDL VRDLLNQHLKNEAVSKK | 63 | No significant similarity found. | | No putative conserved domains have been detected | |
| 41 | 26098 | 25883 | 217 | MLMIGNTQVKTPRELTKPLKKILG PEYKVKRDVWLMVEGKNLNEAK RIIESIGLFANDMGGFLTVFMAEE M | 71 | No significant similarity found. | | No putative conserved domains have been detected | |
| 42 | 26286 | 26540 | 218 | LDQAFLKERIEATKRQIVAYEDAV NQLSSGAVQSYSLNTGQTTQNV TRFDVARLNGDIDGLYNRLATLEA RLNGSGSTLVRPGW | 84 | No significant similarity found. | | No putative conserved domains have been detected | |
| 43 | 26544 | 28217 | 219 | MNYDFSRGLVKVPTVGLKTEFKY SGATIAPPPMQGAKSDAIEINALG GGFNHSAFTGEKFIGGFGPTSLF TMDYWTLRKRSEQLFSENLYAA GLIERLVTNEINTGLTPEACPDERI LGLKPGDLEDWTELVENRFSIWA NSSEYCDFYGQNSLGEIQRIARR EALICGDVLVVLRQNQSTKMPQV QLVSGSLIRTPPDIPRKGHKIKHG VELDTQGRQCAYWVLQDDGTYK RLPAFGEKSKRRIAWMMYGAQR RLGELRGQPLLSIVLQSLKEIDRY RDAAQRKAVVNSILAMFIEKTQDK MSTLPITGGAIRRDKVTDNSNTAA PRSFEIASQVPGVVLQELQAGEK PVGFHSQGTDINFPAFEEAVISAV AWCKQIPPEILKLSFSSNYSASQA AINEFKIYLNMVWNEWGANFCQP IYTEFLISEALLGKIDAPGFLDAWR DPVKMDIFGAWLWCDWFGSIKP STDMRKMGQGLALAVEOGWTTIN AQASRQMFGTKFTKNIARQRRER ELQASLLRPMLELQKEYGISAEHL VNVAHAIGGTISAQTEETEEI | 557 | Putative capsid protein orf5T [Vibrio parahaemolyticus phage VP16T] | AAQ964 72.1 | 4e-96 (186/48 7) | portal protein | Portal_lambda, phage portal protein, lambda family | TIGR 0153 9 | 1e-25 |
| 44 | 28217 | 29368 | 220 | MDWFLTPEALKEIQELHARGLVL TAEQMTEFNALYSDDFPGSRIFQ KVGTVAQVNIAGVLTKEPNWMYR YYGGGNTAYSEIISAINEAERDPAI KEIILAIDSPGGQTNGLCSAMDAIK NTKKTVLAVVEGQAASAAYGLAS QANKIIAADRGCMVGSVGAAASIV | 383 | Putative protease orf6C [Vibrio parahaemolyticus phage VP16C] | AAQ965 37.1 | 1e-46 (137/36 8) | Clp_prote ase | Clp_protease_like superfamily | cd003 94 | 1e-07 |

Fig. 4J

| | | | | | | |
|---|---|---|---|---|---|---|
| 45 | 29414 | | VSENVVDIASTNAPKKRPDVTTD AGKAVIRETLDQIESIFIADIAAGR KVTADKVKLEFGQGGMYVAAHA LERGMIDEIKTADSSATTNAKSSA TYTASEENSTMDAATLKAQFPAV YTAIYNEGKTAENERVSAHLTLGE ASGDMQTAISAINDGSELTASIQA KYMAANMKRGQVAGRETDDTAA ANALDGVKPGATATDANAVTNM VAKNLGVA | | | |
| | 29803 | 221 | MMQVTQHTNSSINWGEVACQDD TLTLGANATLKEGTILARAATGKLI PFVKGGADGAGVPVAIAMHEIKT VAAGDVSVRAGISGQVRKNNLVI HADGNATNIDGAVTDALRSYGIV AFTVNSTNKPDNQ | 129 | Hypothetical protein orf7T [Vibrio parahaemolyticus phage VP16T] | AAQ964 74.1 | 1e-06 (38/106) | No putative conserved domains have been detected |
| 46 | 29818 | 30903 | 222 | MTTSTIAGVYTQVAPKPLFLSGFF KAPPQNHFNTESVELDIERDSOQ VAAVVQSLGSDYNKNETGEFTNK KFTPPVYKEGFSLNAFDLLKREA GQSGFNTPSEQIRGNLITRFIKGA RKVEAKILRGIELQASQILQTGNLL LKDQEGKDAFKIDYKPKATHFVN VANVWTGANADPMKDLESLSEVI QTDGLVIPDIIIMGASALAAAKGNE KFIKNFDSRNISGNVLADMQITAR GGIYQGTLRVGNAVCELYTYGVG YQASSSAVATPFLNTNKVLMLSS ESQLDALFGAVPNIADILGVSLRE QLLPELPTRFDSNSTDLFTNVYLS ASGEQLMGGVASRPILVPTAIDSF GCLTVA | 361 | Hypothetical protein orf8C [Vibrio parahaemolyticus phage VP16C] | AAQ965 39.1 | 4e-57 (133/347) | No putative conserved domains have been detected |
| 47 | 30912 | >31076 | 223 | MNPLQWGFFLLNLEIFDVTKTDLI NAIKAIDSNAKTSGLDKDELQALL TELQAKA | 55 | No significant similarity found. | | | |

Fig. 4K

Fig. 5B

| orf | Putative function | orf | Putative function | orf | Putative function |
|---|---|---|---|---|---|
| 105 | Protease inhibitor | 169 | postulated decoy of host sigma70 or sigmaS | 228 | I-TevI homing endonuclease |
| 107 | EndoVII packaging and recombination endonuclease VII | 171 | DNA helicase | 229 | thymidylate synthase |
| 108 | anaerobic ribonucleotide reductase subunit | 175 | DexA exonuclease A | 232 | ribonucleotide reductase A subunit |
| 109 | anaerobic nucleotide reductase subunit | 178 | MotB modifier of transcription | 233 | ribonucleotide reductase B subunit |
| 113 | glutaredoxin | 179 | modifier of suppressor T4 tRNAs | 234 | endonuclease II |
| 126 | alpha-glucosyl-transferase | 180 | RNA metabolism moderator | 235 | RNA ligase |
| 127 | recombination endonuclease subunit | 184 | DNA topoisomerase subunit | 236 | inhibitor of host transcription |
| 130 | recombination endonuclease subunit | 186 | membrane-associated affects host membrane ATPase | 241 | dN 3'phosphatase |
| 132 | RNA polymerase binding protein | 187 | rIIB protector from prophage-induced early lysis | 248 | dCMP deaminase |
| 133 | sliding clamp DNA polymerase | 189 | endonuclease IV | 251 | head assembly cochaperone |
| 134 | clamp loader subunit, DNA polymerase accessory protein | 196 | Nucleoid disruption protein | 252 | rIII lysis inhibition accessory protein |
| 135 | clamp-loader subunit | 197 | acridine resistance protein | 261 | DNA ligase |
| 136 | RegA translational repressor protein | 198 | DNA topoisomerase subunit | 263 | adenosyltribosyl-transferase packaged protein |
| 138 | DNA polymerase | 201 | activator middle promoter | 264 | Alt RNA polymerase ADP-ribosylase |
| 140 | immunity to superinfection membrane protein | 206 | inhibitor of McrBC restriction nuclease | 266 | base plate-tail tube initiator |
| 141 | dCMP hydroxymethylase | 208 | AsiA anti-sigma 70 protein | 267 | base plate |
| 142 | Endodeoxyribonuclease | 209 | holin | 268 | baseplate hub subunit, tail length determinator |
| 144 | RecA-like recombinase protein | 210 | tail fiber protein | 269 | base plate distal hub subunit |
| 145 | head vertex assembly chaperone | 211 | tail fiber protein | 270 | base plate hub subunit |
| 146 | DNA primase-helicase subunit | 212 | hinge connector long tail fiber | 271 | base plate hub assembly catalyst |
| 147 | discriminator of mRNA degradation | 213 | tail fiber hinge | 272 | baseplate hub subunit |
| 151 | spackle periplasmic protein, lysis regulation | 214 | proximal tail fiber subunit | 273 | baseplate wedge subunit |
| 154 | primase | 215 | Ribonuclease H | 274 | recombination, repair and ssDNA binding protein |
| 156 | dCTP pyrophosphatase | 216 | dsDNA binding protein | 277 | RNA-DNA and DNA-DNA helicase, ATPase |
| 159 | small outer capsid protein | 217 | late promoter transcription accessory protein | 278 | RNA-DNA and DNA-DNA helicase |
| 162 | affects phosphorylation of host sigma32 | 218 | loader of Orf146 DNA helicase | 279 | minor capsid protein |
| 163 | postulated decoy of host sigma32 | 219 | ssDNA binding, DNA repair, recombination and pre-synthesis | 280 | outer capsid protein Hoc |
| 167 | adenylribosylating enzyme | 225 | dihydrofolate reductase | 283 | RnlB RNA ligase 2 |
| 168 | adenylribosylating enzyme | 227 | thymidylate synthase | | |

Table 5 - Features of phage F488/08 gene products and assignment of putative functions.

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 1 | 1232 | <3 | 224 | MAKINELLRESTTTNSNSIGRPNL VALTRATTKLIYSDIVATQRTNQP VAAFYGIKYLNPDNEFTFKTGAT YAGEAGYVDREQITELTEESKLT LNKGDLFKYNNIVYKVLEDTPFA DIEESDLELALQIAIVLLKVRLFSD AASTSKFESSDSEIADARFQINK WQTAVKSRKLKTGITVELAQDLE ANGFDAPNFLEDLLATEMADEIN KDILQSLITVSKRYKVTGITDTGFI DLSYASAPEAGRSLYRMVCEMV SHIQKESTYTATFCVASARAAAIL AASGWLKHKPEDDKYLSQNAYG FLANGLPLYCDTNSPLDYVIVGV VENIGEKEIVGSIFYAPYTEGLDL DDPEHVGAFKVVVDPESLQPSIG LLVRYALSANPYTVAKDEKEARII DGGDMDKMAGRS | 410 | Gp24 precursor of head vertex subunit [Enterobacteria phage RB14] | YP_002854509.1 | 0,0 (410/410) | precursor of head vertex subunit | Major capsid protein Gp23 | pfam07068 | 5e-13 |
| 2 | 2881 | 1316 | 225 | MTIKTKAELLNKWKPLLEGEGLP EIANSKQAIIAKIFENQEKDFQTA PEYKDEKIAQAFGSFLTEAEIGG DHGYNATNIAAGGTSGAVTQIGP AVMGMVRRAIPNLIAFDICGVQP MNSPTGQVFALRAVVGKDPIAS GAKEAFHPMYGPDAMFSGQGA AKKFAALKASDTLEVGTIYTHFFQ ETGTVVLQATAAKQIDSGASDAD KLDAEIKKQMEAGVLVEIAEGMA TSIAELQEGFNGSTDNPWNEMG FRIDKQVIEAKSRQLKAAYSIELA QDLRAVHGMDADAELSGILATEI MLEINREVVDWINYSAQVGKSG MTLTPGSKAGVFDFQDPIDIRGA RWAGESFKALLFGIDKEAVEIAR QTGRGEGNFIIASRNVVNVLASV DTGISYAACGLATGFNTDTTKSV FAGVLGGKYRVYIDQYAKQDYFT VGYKGPNEMDAGIYYAPYVALTP LRGSDPKNFQPVMGFKTRYGIGI NPFAESAAQAPASRIQSGMPSIL | 521 | Major capsid protein (g23) [Enterobacteria phage T4] | AAA32503.1 | 0,0 (503/521) | major capsid protein | Major capsid protein Gp23 | pfam07068 | <1,0e-180 |

Fig. 6A

| | | | NSLGKNAYFRRVYYKGI | | | | | |
|---|---|---|---|---|---|---|---|---|
| 3 | 3709 | 2900 | 226 | MLKEQIAEAQKIDASVALDSIFE SVNISPEAKETFGTVFEATVKQH AVKLAESHIAKIAEKAEEEVEKNK EEAEEKAEKKIAEQASKFLDHLA KEWLTENKLAVDKGIKAELFESM LGGLKELFVEHNVVPEESVDVV AEMEEELQEHKEESARLFEELNK RDAYINYVQREVALSESTKDLTE SQKEKVSALVEGMDYSDAFSSK LSAIVEMVKKSNKDESTITESINT PDTEAAGLNFVTEAVEDKSAQG AEDIVSVYAKVASRF | 269 | Gp22 prohead core scaffold protein [Enterobacteria phage RB51] | YP_0028541 29.1 | 9e-147 (268/269) | prohead core scaffold protein | No putative conserved domains have been detected |
| 4 | 4378 | 3740 | 227 | MNEPQLLIETWGQPGEIIDGVPM LESHDGKDLGLKPGLYIEGIFMQ AEVVNRNKRLYPKRILEKAVKDYI NEQVLTKQALGELNHPPRANVD PMQAAIIIEDMWWKGNDVYGRA RVIEGDHGPGDKLAANIRAGWIP GVSSRGLGSLTDTNKGYRIVNE GFKLTVGVDAVWGPSAPDAWVT PKEITESQTAEADTSADDAYMAL AEAMKKAL | 212 | Prohead core protein protease [Enterobacteria phage T4] | AAA32501.1 | 1e-120 (212/212) | prohead core protein protease | Peptidase_U9, prohead core protein protease | pfam0342 0 | 1e-104 |
| 5 | 4803 | 4378 | 228 | MLLIPETHELVLENVEALIPEAQG RFDELSSALNKDDINTIVENMLD DETDLAVALASINENMPLNEFIVK HVSARGEITRTKDRKTRERNAFQ TTGLSKAKRRQIARKATKTKIANP AGQSRAQRKRKKALKRRKALGL S | 141 | Gp68 prohead core protein [Enterobacteria phage T4] | NP_049784.1 | 8e-75 (141/141) | prohead core protein | No putative conserved domains have been detected |
| 6 | 5042 | 4803 | 229 | MEGLIEAIKSNDLVAARKLFAEA MAARTTDLIKEEKIAIARNFLIEGE EPDDEDDDEDEDSDDKDDKKDK DSDEDEDE | 79 | Gp67 prohead core protein [Enterobacteria phage RB51] | YP_0028541 26.1 | 2e-19 (50/51) | prohead core protein | No putative conserved domains have been detected |
| 7 | 6616 | 5042 | 230 | MKFNVLSLFAPWAKMDERNFKD QEKEDLVSITAPKLDDGAREFEV SSNEAASPYNAAFQTIFGSYEPG MKTTRELIDTYRNLMNNYEVDNA VSEIVSDAIVYEDDTEVVALNLDK SKFSPKIKNMMLDEFSDVLNHLS FQRKGSDHFRRWYVDSRIFFHKI IDPKRPKEGIKELRRLDPRQVQY VREIITETEAGTKIVKGYKEYFIYD TAHESYACDGRMYEAGTKKIPK AAVVYAHSGLVDCCGKNIIGYLH RAVKPANQLKLLEDAVVIYRITRA | 524 | Gp20 portal vertex protein of head [Enterobacteria phage T4] | NP_049782.1 | 0.0 (524/524) | portal vertex protein of head | Bacteriophage T4-like capsid assembly protein (Gp20) | pfam0723 0 | <1,0e-180 |

Fig. 6B

| | | | Sequence | | | | | | |
|---|---|---|---|---|---|---|---|---|---|
| 8 | 7191 | 6700 | PDRRVWYVDTGNMPARKAAEH MQHVMNTMKNRVVYDASTGKIK NQQHNMSMTEDYWLQRRDGKA VTEVDTLPGADNTGNMEDIRWF RQALYMALRVPLSRIPQDQQGG VMFDSGTSITRDELTFAKFIRELQ HKFEEVFLDPLKTNLLLKGIITED EWNDEINNIKIEFHRDSYFAELKE AEILERRINMLTMAEPFIGKYISH RTAMKDILQMTDEEIEQEAKQIE EESKEARFQDPDQEQEDF | | | | | | |
| | | | MFVDDVTRAFESGDFARPNLFQ VEISYLGQNFTFQCKATALPAGIV EKIPVGFMNRKINVAGDRTFDD WTVTVMNDEAHDARQKFVDWQ SIAAGQGNEITGGKPAEYKKSAIV RQYARDAKTVTKEIEIKGLWPTN VGELQLDWDSNNEIQTFEVTLAL DYWE | | | | | | |
| | | 231 | | 163 | Gp19 tail tube protein [Enterobacteria phage T4] | NP_049781. 1 | 1e-91 (163/163) | tail tube protein | T4-like virus tail tube protein gp19 | pfam0684 1 | 1e-83 |
| 9 | 9287 | 7308 | MTLLSPGIELKETTVQSTVNNS TGTAALAGKFQWGPAFQIKQVT NEVDLVNTFGQPTAETADYFMS AMNFLQYGNDLRVVRAVDRDTA KNSSPIAGNIEYTISTPGSNYAVG DKITVKYVSEDVETEGKITEVDAD GKIKKINIPTAKIIAKAKEVGEYPT LGSNWTAEISSSSSGLAAVITLG KIITDSGILLAEIESSAETAMTAVDF QANLEKYGIPGVVALYPGELGDK IEIEIVSKADYAKGASALLPIYPGG GTRASTAKAVFGYGPQTDSQYAI IVRRNDAIVQSVVLSTKRGEKDIY DSNIYIDDFFAKGGSEYIFATAQN WPEGFSGILTLSGGLSSNAEVTA GDLMEAWDFFADRESVDQLFI AGSCAGESLETASTVQKHVVSIG DARQDCLVLCSPPRETVVGIPVT RAVDNLVNWRTAAGSYTDNNFN ISSTYAAIDGNYKYQYDKYNDVN RWVPLAADIAGLCARTDNVSQT WMSPAGYNRGQILNVIKLAIETR QAQRDRLYQEAINPVTGTGDG YVLYGDKTATSVPSPFDRINVRR LFNMLKTNIGRSSKYRLFELNNA FTRSSFRTETAQYLQGIKALGGIY EYRVVCDTTNNTPSVIDRNEFVA TFYIQPARSINYITLNFVATATGA | 659 | Gp18 tail sheath monomer [Enterobacteria phage RB51] | YP_0028541 23.1 | 0.0 (654/659) | tail sheath monomer | Phage tail sheath protein | pfam0498 4 | 8e-95 |

Fig. 6C

| | | | | | | | | | |
|---|---|---|---|---|---|---|---|---|---|
| 10 | 11151 | 9319 | 233 | DFDELTGLAG<br>MEQPINALNDFHPLNEAGKILIKH<br>PSLAERKDEDGIHWIKSQWDGK<br>WYPEKFSDYLRLHKIVKIPNNSD<br>KPELFQTYKDKNKRSRYMGLP<br>NLKRANIKTQWTREMVEEWKKC<br>RDDIVYFAETYCAITHIDYGVIKV<br>QLRDYQRDMLKIMSSKRMTVCN<br>LSRQLGKTTVVAIFLAHFVCFNK<br>DKAVGILAHKGSMSAEVLDRTKQ<br>AIELLPDFLQPGIVEWNKGSIELD<br>NGSSIGAYASSPDAVRGNSFAMI<br>YIDECAFIPNFHDSWLAIQPVISS<br>GRRSKIIITTTPNGLNHFYDIWTA<br>AVEGKSGFEPYTAIWNSVKERLY<br>NDEDIFDDGWQWSIQTINGSTLA<br>QFRQEHTAAFEGTSGTLISGMKL<br>AVMDFIEVTPDDHGFHRFKGPE<br>PDRKYIATLDCSEGRGQDYHAL<br>HIIDVTDDVWEQVGVLHSNTISHL<br>ILPDIVMRYLVEYNECPVYIELNS<br>TGVSVAKSLYMDLEYEGVICDSY<br>TDLGMKQTKRTKAVGCSTLKDLI<br>EKDKLIIHHRATIQEFRTFSEKGV<br>SWAAEEGYHDDLVMSLVIFGWL<br>STQSKFIDYADKDDMRLASEVFS<br>KELQDMGDEYAPVIFVDSVHSAE<br>YVPVSHGMSMV | 610 | Gp17 terminase subunit [Enterobacteria phage RB51] | YP_0028541<br>22.1 | 0,0<br>(608/610) | terminase large subunit | Terminas e_6, terminase -like family | pfam0323<br>7 | 1e-67 |
| 11 | 11629 | 11135 | 234 | MEGLDINKLLDISDLPGIDGEEIK<br>VYEPLQLVEVKSNPQNRTPDLE<br>DDYGVVRRNMHFQQQMLMDAA<br>KIFLETAKNADSPRHMEVFATLM<br>GQMTTTNREILKLHKDMKDITSE<br>QVGTKGAVPTGQMNIQNATVFM<br>GSPTELMDEIGDAYEAQEAREK<br>VINGTTD | 164 | Gp16 terminase DNA packaging enzyme, small subunit [Enterobacteria phage T4] | NP_049775.<br>1 | 1e-91<br>(164/164) | terminase DNA packaging enzyme, small subunit | No putative conserved domains have been detected | | |
| 12 | 12456 | 11638 | 235 | MFGYFYNSSFRRYATLMGDLFS<br>NIQIKRQLESGDKFIRVPITYASK<br>EHFMKLNKWTSINSQEDVAKV<br>ETILPRINLHLVDFSYNAPFKTNIL<br>NQNLLQKGTTSVVSQYNPSPIKM<br>IYELSIFTRYEDDMFQIVEQILPYF<br>QPHFNTTMYEQFGNDIPFKRDIKI<br>VLMSAAIDEAIDGDNLSRRRIEW<br>SLTFEVNGWMYPPVDDAEGLIR<br>TTYTDFHANTRDLPDGEGVFES<br>VDSEVVPRDINPEDWDGTVKQT | 272 | Gp15 tail sheath stabilizer and completion protein [Enterobacteria phage T4] | NP_049774.<br>1 | 1e-157<br>(270/272) | tail sheath stabilizer and completion protein | No putative conserved domains have been detected | | |

Fig. 6D

| | | | FTSNVNRPTPPEPPGPRT | | | | | |
|---|---|---|---|---|---|---|---|---|
| 13 | 13268 | 236 | MATYDKNLFAKLENRTGYSQTN ETEILNPYVNFHYKNSQILADVL VAESIQMRGVECYYVPREYVSP DLIFGEDLKNKFTKAWKFAAYLN SFEGYEGAKSFFSNFGMQVQDE VTLSINPNLFKHQVNGKEPKEGD LIYFPMDNSLFEINWVEPYDPFY QLGQNAIRKITAGKFIYSGEEINP VLQKNEGINPEFSELELNPVRNL NGIHDINIDQYAEVDQINSEAKEY VEPYVVNNRGKSFESSPFDND FMD | 256 | Head completion [Enterobacteria phage RB32] | YP_803104.1 | 3e-146 (255/256) | head completion protein | No putative conserved domains have been detected |
| 14 | 14199 | 237 | MSGYNSQNPKELKDVILRRLGAP IINVELTPDQIYDCIQRALELYGEY HFDGLNKGFHVFYVGDDEEKYK TGVFDLRGSNVFAVTRILRTNIGS ITSMDGNATYPWFTDFLLGMAGI NGGMGTSCNRFYGPNAFGADL GYFTQLTSYMGMMQDMLSPIPD FWFNSANEQLKVMGNFQKYDLII VESWTKSYIDTNKMVGNTVGYG TVGPQDSWSLSERYNNPDHNLV GRVVGQDPNVKQGAYNNRWVK DYATALAKELNGQILARHQGMM LPGGVTIDGQRLIEEARLEKEALR EELYLLDPPFGILVG | 309 | Gp13 neck protein [Enterobacteria phage RB14] | YP_0028544 96.1 | 0.0 (309/309) | neck protein | Superantigen-like protein | PRK13345 | 0.004 |
| 15 | 15688 | 238 | MIELKDLPFVDSVPDEGGQERISW IKNGEEILGASTKYGNDGSMNRP IVSVFKNVEVLDENIGILKTAIETS QKDIKTIQGVLDVSGDIEALSQIS VNKNDISNLKTLTNEHTDILTGTN NTVDKIIADIGPFNDEENSVYRTI RNDLLWIKQELGQYSGGDINGLP VVGNASTGMKHRIITNSTLLSSQ GIRLSELENKFTESDVGSLTVEV GKLRDELGNKPVDFGPNIYNRLN TIDDKQTLINSDIAEIKSSIGYPEN VSIITEINNKSSIESINNELNQSE GVKQRLTAIETSIGSDDIPSSIKG KIKNHTTSIESLNGIVGENTSSGL RANVSWLNQIVGTDSSGGQPSP SGSLLNKVSVLEGEVSVLNNNV QNIQVEIGNNRTGIKGQVIELTSLI NGNNPDGSTVEERGLTNSIKTNE TNIAAVTHEVNTAKDNISSLQSSV QALQEAGYIPEAPKDGQAYVRK | 485 | Fibritin neck whiskers [Enterobacteria phage RB14] | YP_0028544 95.1 | 0.0 (480/485) | fibritin neck whiskers | Fibritin C-terminal region | pfam07921 | 6e-25 |

Fig. 6E

| | | | | DGEWVLLSTFLSPA | | | | | |
|---|---|---|---|---|---|---|---|---|---|
| 16 | 17248 | 15698 | 239 | MSNNTYQHVSNESKYVKFDPVG SNFPGTVTTVQSALSKISNIGVN GIPDATMEVKGIAMIASEQEVLD GTNNSKIVTFPATLATRLLYPNATE TKYGLTRYSTNEETLEGSDNNSS ITPQKLKYHTDDVFRNRYSSESS NGVIKISSTPAALAGVDDTTAMT PLKTQKLAIKLISQIAPSEDTASES VRGVVQLSTVAQTRQGTLREGY AISPYTFMNSVATQEYKGVIRLG TQSEINSNLGDVAVTGETLNGRG ATGSMRGVVKLTTQAGIAPEGD SSGALAWNADVINTRGGQTING SLNLDHLTANGIWSRGGMWKNG DQPVATERYASERVPVGTIMMF AGDSAPPGWIMCHGGTVSGDQ FPDYRNVVGTRFGGDWNNPGV PDMRGLFVRGAGTGGHILNQRG QDGYGKDRLGVGCDGMHVGGV QAQQMSYHKHAGGWGEYNRSE GPFGASVYQGYLGTRKYADWD NASYFTNDGFELGGPRDALGTL NREGLIGYETRPWNISLNYIIKVH Y | 516 | Gp12 short tail fibers [Enterobacteria phage RB14] | YP_0028544 94.1 | 0.0 (509/516) | short tail fibers | Phage short tail fibre protein gp12, middle domain | pfam0908 9 | 9e-29 |
| 17 | 17904 | 17245 | 240 | MSLLNNKAGVISRLADFLGFRTK KNDISVMNNQPVGAVTISQIAKG FYDSNVESAINDVRNMAEQQVG AVLINISGVSPTGVQQTDYWSFE GTVTDTSAKPGDPVINNMFGIPV KATNGMTSIEFTSAVRTALQEMV VKFIAIDSFEDHPTIGNKIQVKYLD NQEHILEQYSDKGITFKQEIISPS KPGYGTWQLLGAQTVTLDSHTQ PTVFYFERIA | 219 | Gp11 base plate wedge completion tail pin [Enterobacteria phage RB14] | YP_0028544 93.1 | 3e-124 (217/219) | base plate wedge completion tail pin | GP11 baseplate wedge protein | pfam0867 7 | 1e-89 |
| 18 | 19709 | 17904 | 241 | MKQNINIGNVVDDGTGDYLRKG GIKINENFDELYYELGDGDVPYS AGAWKTYNASSGQTLTAEWGK SYAINTSSGRVTLQLPKGTVNDY NKVIKARDVFATWNVNPVTLVAA SGDTIKGSSSSVEINVQFSDLELV YCAPGRWEYVKNKQIDKIISSDIS NVARKEFLVEVQGQTDFLDVFH GTSYNVNNIRVKKHRGNELYYGD VFSENSDFGSPGENEGELIPLDG FNIRLRQPCNIGDTVQIETFMDG VSQWRSSYTRRQIIKVLDSKLTSK | 601 | Gp10 base plate wedge completion tail pin [Enterobacteria phage RB14] | YP_0028544 92.1 | 0.0 (590/601) | base plate wedge completion tail pin | Bacteriop hage T4 gp9/10-like protein | pfam0788 0 | 3e-79 |

Fig. 6F

| | | | | | | | | | |
|---|---|---|---|---|---|---|---|---|---|
| | 20575 | | TSLEGSIYVTDLSAMKSIPFSAFG LIPGEPINPNSLEVRFNGILQQQA GTAGYPLFLCEGANSDTQEGCIS LGGEWKESNTDYSIEYEDGKPV SLLFDRKFESGDIIVITWFNNDLG TLLEKDIIELTDDRYVSKGSSTE VTGDVALTDFDKIGWPNVEKVD SYTRTYNSISSIFDSIYPVGSIYEN AINPNNPVTYMGFGSWKLFGKG QVLVGWNDDVTDPNFALNNNDL DSSGNPSHTAGGTVGTTSVTLE NANLPATKTDERVLIEDENGSVII GGCQYDPDETGPIYTKYREDYA TTNSSHTPPTNISNIQPSITVYRW IRIA | | | | | | |
| 19 | 19709 | 242 | MFIQEPKKLIDTGEIGNASTGDIL FDGGNKINSDFNAIYNAFGDQRK MAVANGTGADGQIIHATGYYQK HSITEYATPVKVGTRHDIDTSTV GVKVIIERGELGDCVEFINSNGSI SVTNPLTIQAIDSIKGVSGNLVVT SPYSKVTLRCISSDNSTSVWNYS IESMFGQKESPAEGTWNISTSGS VDIPLFHRTEYNMAKLLVTCQSV DGRKIKTAEINILVDAVNSEVISSE YAVMRVGNETEEDEIANIAFSIKT NYVTATISSSTVGMRAAVKVIAT QKIGVAQ | 288 | Gp9 base plate wedge completion tail fiber socket [Enterobacteria phage RB14] | YP_0028544 91.1 | 2e-165 (287/288) | base plate wedge completion tail fiber socket | Bacteriop hage T4 gp9/10- like protein | pfam0788 0 | 9e-95 |
| 20 | 21643 | 243 | MNDSSVIYRAIVTSKFRTEKMLN FYNSIGSGPDKNTIFITFGRSEPW SSNENEVGFAPPYPTDSVLGVT DMWTHMMGTVKVLPSMLDAVIP RRDWGDTRYPDPYTFRINDIVVC NSAPYNATESGAGWLVYRCLDV PDTGMCSIASLTDKDECLKLGGK WTPSVRSMTPPEGRGDAEGTIE PGDGYWEYLFEIPPDVSINRCT NEYIVVPWPEELKEDPTRWGYE DNLTWQQDDFGLIYRVKANTIRF KAYLDSVYFPDAALPGNKGFRQI SIITNPLEAKAHPNDPNVKAEKDY YDPEDLMRHSGEMIYMENRPPII MAMDQTEEINILFTF | 334 | Gp8 baseplate wedge subunit [Enterobacteria phage T4] | NP_049766. 1 | 0.0 (332/334) | baseplate wedge subunit | Bacteriop hage T4, Gp8 | pfam0921 5 | 5e-162 |
| 21 | 24734 | 244 | MTVKAPSVTSLRISKLSANQVQV RWDDVGANFYYFVEIAETKTDS GENLPSDQYRWINLGYTANNSF FFDDADPLTSYIIRVATAAQDFEQ | 1032 | Gp7 base plate wedge initiator [Enterobacteria phage RB14] | YP_0028544 89.1 | 0.0 (1022/1032 ) | base plate wedge initiator | Fibronecti n type 3 domain | cd00063 | 0.009 |

Fig. 6G

| | | | | | | | |
|---|---|---|---|---|---|---|---|
| 22 | 26713 | 24731 | 245 | SDWVYTEEFETFATNAYTFQNMI EMQLANKFIQEKFTLNNSNYVNF NNDTIMAALMNESFQFSPSYVDV SSISNFIIGENEYHEIQGSIQQVC KDINRVYLMESEGILYLFERYQP VVKVSNDKGQTWKAVKLFNDRV GYPLSKTVYYQSANTTYVLGYDK IFYGRKSTDVRWSADDVRFSSQ DITFAKLGDQLHLGFDVEIFGTYA TLPANVYRIAEAITCTDDYIYVVA RDKVRYIKTSNAPIDSDPLSPTYS ERLFEPDTMTITGNPKAVCYKMD SIGDKVFALIIGEVETLNANPRTS KIIDSADKGIYVLNHDEKTWKRVF GNTEEERRRIQPGYANMSTDGK LVSLSSSNFKFLSDNVVNDPETM VKYQLIGAVKYEFPREWLADKHY HMMAFIADEKSDWETFTPQPMK YYAEPFFNWSKKSNTRCWINNS NRAVVVYADLKYTKVIENIPETSP DRLVHEYWDDGDCTIVMPNVKF TGFKKYASGMLFYKSSGEIISYY DFNYRVRDTVEIIWKPTGVFLKA FLQNQEHETPWSPEEEHGLADP DLRPLIGTIMMPDSYLLQDSNFEA FCEAYIQYLSDGYGTQYNNLRNL IRNQYPREEHAWEYLWSEIYKR NIYLNADKRDAVARFFESRSYDF YSTKGIEASYKFLFKVLYNEEVEI EIESGAGTEYDIIVQSDSLTEDLV GQTIYTATGRCNVTYIERSYSNG KLQWTVTIHNLLGRLIAGQEVKA ERLPSFEGEIIRGVKGKDLLQNNI DYINRSRSYYVMKIKSNLPSSRW KSDVIRFVHPVGFGFIAITLLTMFI NVGLTLKHTETIINKYKNYKWDS GLPTEYADRVAKLTPTGEIEHDS VTGEAIYEPGPMAGVEYPLPDDY NAENNNSIFQGQLPSERRKLMS PLFDASGTTFAQFRDLVNKRLKD NIGNPRDPENPTQVKIDE MANTPVNYQLTRTANAIPEIFVG GTFAEIKONLIEWLNGQNEFLDY DFEGSRLNVLCDLLAYNTLYIQQ FGNAAVYESFMRTANLRSSVVQ AAQDNGYLPTSKSAAQTEIMLTC TDALNRNYITIPRGTRFLAYAKDT SVNPYNFVSTEDVIAIRDKNNQY | 660 | gp6 base plate wedge [Enterobacteria phage RB14] | YP_0028544 88.1 | 0,0 (657/660) | base plate wedge | No putative conserved domains have been detected |

Fig. 6H

| | | | | | | | |
|---|---|---|---|---|---|---|---|
| 23 | 27015 | 26722 | 246 | FPRLKLAQGRIVRTEIIYDKLTPIII YDKNIDRNQVKLYVDGAEWINW TRKSMVHAGSTSTIYYMRETIDG NTEFYFGEGEISVNASEGALTAN YIGGLKPTQNSTIVIEYISTNGAD ANGAVGFSYADTLTNITININENP NGDPDFVGADGGGDPEDIERIR ELGTIKRETQQRCVTATDYDTFV SERFGSIIQAVQTFTDSTKPGYA FIAAKPKSGLYLTTVQREDIKNYL KDYNLAPITPSIISPNYLFIKTNLK VTYALNKLQESEQWLEGQIIDKID RYYTEDVEIFNSSFAKSKMLTYV DDADHSVIGSSATIQMVREVQNF YKTPEAGIKYNNQIKDRSMESNT FSFNS

| | | | | | | | | |
|---|---|---|---|---|---|---|---|---|
| 26 | 29846 | 29256 | 249 | RSRQMALENMAFQMGVGGVAK FNTMLTAMLAGDWEKAYKAGRD SLWYQQTKGRASRVTMIILTGNL ESYGVEVKTPARSLSAMAATVA KSSDPADPPIPNDSRILFKEPVSS YKGEYPYVHTMETESGHIQEFD DTPGQERYRLVHPTGTYEEVSP SGRRTRKTVDNLYDITNADGNFL VAGDKKTNVGGSEIYYNMDNRL HQIDGSNTIFVRGDETKTVEGNG TILVKGNVTIVVEGNADITVKGDA TTLVEGNQTNTVNGNLSWKVAG TVDWDVGGDWTEKMASMSSIS SGQYTIDGSRIDIG | | | | |
| | | | | MLFTFDPIEYAAKTVNKNAPTIP MTDIFRNYKDYFKRALAGYRLRT YYIKGSPRPEELANTIYGNPQLY WVLLMCNDNYDPYYGWITSQEA AYQASIQKYKNVGGDQIVYHVNE NGEKFYNLISYDDNPYVWYDKG DKARKYPQYEGALAAVNTYEDA VLENEKLRQIKIIAKSDINSFMNDL IRIMEKSYGNDK | | | | |
| 27 | 30346 | 29894 | 250 | MAYSGKWVPKNISKYRGDPKKIT YRSNWEKFFFEWLDKNPEIIAW GSETAVIPYFCNAEGKKRRYFM DIWMKDSSGQEFFIEIKPKKETQ PPVKPAHLTTAAKKRFMNEIYTY SVNTDKWKAAQALAEKRGIKFRI LTEDGLRALGFKGA | 196 | Base plate wedge completion [Enterobacteria phage RB32] | YP_803091. 1 | 3e-109 (193/196) | base plate wedge completion | No putative conserved domains have been detected |
| 28 | 31170 | 30346 | 251 | MAIFQIINESTPQVPKVKQSLNEK KWIQIGLEYKKAKAKGMTGKQFA EERGIKYSTFTSAMSKYASGIKT AEKIQKLESKPMNKLNKQEROLL MINSFRQTLRDKIRNEGAAINNKT RKWFAETIKQVKGHKVVRPQPG RIYAFAYDAKHKETLPYWDKFPLI IYLGLGKHNLMYGLNLHYIPPKA RQQFLEELLKQYANTPTITNKTKL KIDWSQVKGFRGADQMIKAYIPG NIMGSLVEIAPKDWANVVLMPLQ QFVSKGKRFSANKVWSNI | 150 | Head completion [Enterobacteria phage RB32] | YP_803090. 1 | 5e-83 (150/150) | head completion | No putative conserved domains have been detected |
| 29 | 31277 | 31807 | 252 | MSQALQQIFNQANTTNFVVSIPH SNTTSAFTLNAQSVPIPGIRPVT DTVTGPFGLGRAQRPGATFEYD PLIVRFIVDEELKSWIGMYEWML GTSNYLTGENTAQKTGPEYITLYI | 274 | Gp2 DNA end protector protein [Enterobacteria phage T4] | NP_049754. 1 | 3e-158 (274/274) | DNA end protector protein | No putative conserved domains have been detected |
| | | | | | 176 | Gp3 tail completion and sheath stabilizer protein [Enterobacteria | NP_049753. 1 | 2e-98 (175/176) | tail completion and sheath stabilizer protein | No putative conserved domains have been detected |

Fig. 6J

| | | | LDNSKTEIVMSINFYKPWVSDLS EVEFSYTEDSDPALVCTATIPYTY FQVEKDGKIIAEV | | phage T4] | | | |
|---|---|---|---|---|---|---|---|---|
| 30 | 31857 | 253 | MKLIFLSGVKRSGKDTTADFIMS NYSAVKYQLAGPIKDALAYAWG VFAANTDYPCLTRKEFEGIDYDR ETNLNLTKLEVITIMEQAFCYLNG KSPIKGVFVFDDEGQESVNSVAF NKIIDVINNIEDQWSVRRLMQALG TDLIVNNFDRMYWVKLFALDYLD KFNSGYDYYIVPDTRQDHEMDA ARAMGATVIHVVRPGQKSNDTHI TEAGLPIRDGDLVITNDGSLEELF SKIKNTLKVL | 241 | dNMP kinase [Enterobacteria phage RB32] | YP_803086.1 | 2e-139 (240/241) | dNMP kinase | No putative conserved domains have been detected |
| 31 | 32582 | 254 | MSEQTIEQKLSAEIVTLKSRILDT QDQAARLMEESKILQGTLAEIAH AVGITGDTIKVEEIVEAVKNLTAE SADEE | 76 | Chaperone long and short tail fiber assembly [Enterobacteria phage RB32] | YP_803085.1 | 1e-32 (75/76) | chaperone long and short tail fiber assembly | No putative conserved domains have been detected |
| 32 | 32819 | 255 | MEFKDFSTGLYVAAKFSELTLDA LEELQRSLRVPNPVPREKIHSTIC YSRVNVPYVPSSGSFEVASSGH LEVWKTQDGSTLVLVLDSEYLRC RHMYARALGATHDFDDYTPHITL SYNVGPLSFSGDVQIPVVLDREY KEPLKLDWADDLK | 151 | Hypothetical protein RB32ORF142c [Enterobacteria phage RB32] | YP_803084.1 | 5e-84 (151/151) | | No putative conserved domains have been detected |
| 33 | 33341 | 256 | MKTFKEFATKTTITESSHGMEVK LGMALAEAERLFSRIKELAAAVD PSSFKGDQTKVKALLALCSDAGE IAKNGSKMKKRLEDLK | 85 | Hypothetical protein RB32ORF141c [Enterobacteria phage RB32] | YP_803083.1 | 1e-40 (85/85) | | No putative conserved domains have been detected |
| 34 | 33663 | 257 | MEIKMKTYQEFIAETADVKVEFIY TGKKDKMGEMPHGVLRDALDNF GQLAAEDYGDKIVVTGPAAVIEK WAAENKSIFRKK | 81 | Ip6 [Enterobacteria phage T6] | CAA84458.1 | 2e-37 (76/77) | | No putative conserved domains have been detected |
| 35 | 33967 | 258 | MKRCELIRNVAIAISASAFSFSMF VGFICGLLTTAENVFSLVVAFLIG LIAIVMDKISKGE | 61 | Trna.4 conserved hypothetical predicted membrane protein [Enterobacteria phage T4] | NP_049748.1 | 2e-25 (61/61) | | No putative conserved domains have been detected |
| 36 | 34550 | 259 | MNVEYYVADYENNPSKDEDNR LGVDAFDSPAAAWQWVERTDIP YRYIEVVDHAGNKYPKEAYVASG KVNFLLFAGDNYYPRGGYTDLIA KAFSEDELRDIIKENENKPMDSN | 132 | Trna.3 conserved hypothetical protein [Enterobacteria phage JS10] | YP_002922485.1 | 3e-67 (127/133) | | No putative conserved domains have been detected |

Fig. 6K

| | | | RFDWWQIVNANTHTIVDEG | | | | No putative conserved domains have been detected |
|---|---|---|---|---|---|---|---|
| 37 | 34553 | 34840 | MILYAKVSSIENGYKYDQDAAKA LIDDYGILTCFEVEKVYIDRSSSQ VKLVKEERKFNTVNFDFFIETEK GPLEYDIFKNPLGLECIVNMYYY KW | 95 | tRNA.2 hypothetical protein [Enterobacteria phage RB51] | YP_0028540 96.1 | 1e-46 (91/95) | |
| 38 | 34938 | 35010 | UGGGAAUUAGCCAAGUUGGUA AGGCACUGGAUUUGAUUCCA GGAUgCAAAGGUUCGAGUCCU UUAUUCCCAG | 261 | | | | tRNA1-Gln |
| 39 | 35012 | 35095 | GCGAGAAUGGCCAAAUUGGUa AAGGCACAGCACUUAAAAUGC UGCGGAAUGAUUUCCUUGUGG GUUCGAGUCCCACUUCUCGCA | 262 | | | | tRNA2-Leu |
| 40 | 35104 | 35174 | GCGGAUAUCGUAUAAUGGUAU UACCUCAGACUUCCAAUCUGA UGAUGUGAGUUCGAUUCUCAU UAUCCGCU | 263 | | | | tRNA3-Gly |
| 41 | 35188 | 35261 | CUCCGUGUAGCUCAGUUUGGU AGAGCGUCUGCUUUGGGAGCA GAAUGUCGUAGGUUCAAAUCC UGCCACGGAGA | 264 | | | | tRNA4-Pro |
| 42 | 35264 | 35350 | GGAGGCGUGGCAGAGUGGUU UAAUGCACCGGUCUUGAAAAC CGGCAGUCGCUCCGGCGACU CAUAGGUUCAAAUCCUAUCGC CUCCG | 265 | | | | tRNA5-Ser |
| 43 | 35359 | 35431 | GCUGAUUUAGCUCAGUAGGUA GAGCAACUCACUGUAAUGAG AAGGUCGGGGUUCGAUUCC GUCAAUCAGCA | 266 | | | | tRNA6-Thr |
| 44 | 35436 | 35507 | GGCCCUGUAGCUGGAAGGUU CAAGCAAGCGACUCAUAAUCG CCAGAUGGUGUAGGUUCAAUUCCA CCCAGGGCCA | 267 | | | | tRNA7-Met |
| 45 | 35520 | 35603 | GGGGAGUUAUcCCGUAGAGGU AGCGGUGGGACUGUAAAUCC AUUGUCAUUCgGACUcGGGUG GUUCGACUCCACCACUCCCCA | 268 | | | | tRNA8-Tyr |
| 46 | 35611 | 35682 | GGAUGUGUAGCUCAAUGGCAG AGCGCCUGCUUUAAGCGAU UGGUUAUAGGUUCGAAUCCUA UCACGUCCG | 269 | | | | tRNA9-Asn |

Fig. 6L

| # | | SEQ ID | Sequence | | Description | Accession | E-value (identity) | | Notes |
|---|---|---|---|---|---|---|---|---|---|
| 47 | 35800 | 270 | GUGGCCGUAGUUCAGUUGGU AGAACUCGAGAUUGUGAUUCU CGUAGUCAUGGGUUCGACUCC CAUCGGUCACC | | | | | tRNA10-His | |
| 48 | 35872 | 271 | CGGGGCAUAGCUCAGAAGGAA GAGCAAGGACCUUCUAAGUCC UAGGUCGUAGGUUCGAUCCCU ACUGCCUCGA | | | | | tRNA11-Arg | |
| 49 | 35952 | 272 | MKGNVYLVVHDLTFYFNHDTVI SERVINLLYQHADYVYVENEYGH WQFLKNRSFGLDGYEYFDRKDL LDTIPLSTQYQNHKSLHKCRLIRN AESAYEAIDLWRKRREYIDSLKE Y | 116 | Hypothetical protein RB51ORF141 [Enterobacteria phage RB51] | YP_0028540 94.1 | 8e-60 8111/116) | | No putative conserved domains have been detected |
| 50 | 35974 | 273 | MKSYTQFLNEAVLNEASSTEIQA VAKAAIAAGKYSYKDASDESRFQ FARDMKAEGFTGNAVSMAWKSL VATGAAFAKASGKPAPKADPKA AQEKNIVKGIIAKYEAILKELLVIKT EGQKLARAYSFKDNPHVHSLEY VEDIQKIIKDRIWSAKQIK | 157 | Hypothetical protein RB51ORF140 [Enterobacteria phage RB51] | YP_0028540 93.1 | 1e-83 (154/157) | | No putative conserved domains have been detected |
| 51 | 36708 | 274 | MKTYAEFLTEAAKLPSEADLTKV FFQLDPKDRGDFLKWKAKAIEM YNIDNSSFTMSQENKFNKAFFKI SKKLASGAQVPKSVLATPERAPV KISKNMFDTKKYVNALNKALDAL DDAKKAARDLQDVYTDFDRKTK GSISNSERNSVSVYSDSLDVLGD AYTEIKNRINTASKLKAAAEAIISK LGK | 187 | Hypothetical protein RB14ORF136 [Enterobacteria phage RB14] | YP_0028544 72.1 | 5e-100 (183/187) | | No putative conserved domains have been detected |
| 52 | 37307 | 275 | MDNYGELFNFFMKCVSEDFGRT VNDIKVIGPDHPMFETYAVMGNE DGQWYTVKVVINMFTAEGVVKL SSKVYHDNDEIAEEYFNNMK | 87 | Hypothetical protein RB32ORF131c [Enterobacteria phage RB32] | YP_803073. 1 | 2e-44 (87/87) | | No putative conserved domains have been detected |
| 53 | 37870 | 276 | MNTLKKIVEFIRTKLGSAMAKNLS VEEQYTAAAKLLDKIKDLKTASV KSINEEKRIRELVIEKNRQAESKE REIRKLLSEGQDVTMHAKLGLLY RRTAEQLTTKADGYAEMRIEIAK KVVELDDARQELAVKLEYIRETR AANALGISTADDVVEIAALTKVDI EDTLARVETFNGNISGVETTSAD VQEYINSLK | 197 | Conserved hypothetical protein e.6 [Enterobacteria phage T4] | NP_049742. 1 | 6e-105 (194/197) | | No putative conserved domains have been detected |
| 54 | 38100 | 277 | MKMQSDFNSMFEEFQRQVDVP DQLLNALKRMAEGRNYYWGSSY | 202 | Hypothetical protein RB32ORF128c | YP_803070. 1 | 4e-112 (197/202) | | No putative conserved domains have been detected |

Fig. 6M

| | | | | | | | | |
|---|---|---|---|---|---|---|---|---|
| 55 | 39683 | 40075 | 278 | ETDESLSGRFSRGKKKSLIRPGILI NSIESIHSLTCDFDVEFTDFISPE WTVCYLNDDFDYLGVYSLSDAW FKRNLQKSNLFYIDTTVKFQGKK YFFTLIVDSETKHENKRILSKKNIL TIVDDLFDKFVENPNFESDLLLEK FVKECREYVKTITIPSK [Enterobacteria phage RB32] | | | | |
| 55 | 39683 | 40075 | 278 | MSKPSLYLPSKPVKYEPKRQIIST DVLIGPVILISFVILLIIGGVLDVMT DIDSGEILVLMLILPLIVPLLVPVN WVGYWYQGRHYRKRVRDWKA QCKKIKKEHQLKLDMYEFDEIMK FVKESRCKSQN | 130 | Hypothetical protein RB32ORF127c [Enterobacteria phage RB32] | YP_803069.1 | 2e-64 (123/130) | | No putative conserved domains have been detected |
| 56 | 40057 | 40419 | 279 | MQKPKLNKVKYSFPEALLILAVS VFTALAGSLIGLLIDCFILNDGTVI ITEVWSELRFTIAISLFSFFGTMLY FHYDNFKINWQRKKDYKIQLKEY NSYMSYIEKESMEEFVSDCRKIK | 120 | Conserved hypothetical, predicted membrane protein e.3 [Enterobacteria phage T4] | NP_049739.1 | 1e-49 (98/120) | | No putative conserved domains have been detected |
| 57 | 40416 | 40904 | 280 | MILKTRWYDLDDGDDGISVDRV DWSGCSEDTKKRLIREFRMGYQ AVKPSTVTDDKFVCIHNGRAKLT NAEWFTDKIMILWYIISLPVSSFV FYFFIKNPMDRIGDWILLTILVNIF TASILSGIWYTFIEMPWRLRRCQ KIFDEKKYTQNLNNFITECRKLK | 162 | Hypothetical protein e.2 [Enterobacteria phage RB51] | YP_0028540 86.1 | 3e-85 (152/162) | | No putative conserved domains have been detected |
| 58 | 40901 | 41341 | 281 | MKTLSAGIIFMTEDKDLFMGRVT GSRKPGMMAHRWDIPKGRVES SDLNALEAAKRECLEETGFSNYN PDLLEDLGVFKYSSNKDLQLFYY TIPVEHEMFRNCHCESYFENKD GVMIPEMDAFALIPRTQWQYYM GPSLYRIMNSLF | 146 | Nudix hydrolase [Enterobacteria phage RB51] | YP_0028540 85.1 | 1e-83 (144/146) | nudix hydrolase | NUDIX domain | pfam0029 3 | 5e-10 |
| 59 | 41378 | 41872 | 282 | MNIFEMLRIDEGLRLKIYKDTEGY YTIGIGHLLTKSPSLSVAKSELDK AIGRNCNGVITKDEAEKLFNQDV DAAVRGILRNAKLKPVVDSLDAV RRCALINMVFQMGETGVAGFTN SLRMLQQKRWDEAAVNLAKSR WYNQTPNRAKRVIATFRTGTWD AYKNL | 164 | Soluble lysozyme [Enterobacteria phage RB32] | YP_803066.1 | 2e-92 (164/164) | soluble lysozyme | Bacteriop hage_T4-like_lysoz yme | cd00735 | 7e-64 |
| 60 | 41932 | 42348 | 283 | MTRINLTLVSELADQHLIAEYREL PRVFGIVRKHVANGKRVKDFKIS SKFILGSGHVTFFYDKLEFLRKR QSDIITECLKRGFSIKDTEVPDISD IPVEWKNDYNPCKSAIKLSQQRL | 138 | Endonuclease V [Enterobacteria phage RB51] | YP_0028540 83.1 | 1e-74 (135/138 | endonuclease V | Pyrimidin e dimer DNA glycosyla | pfam0301 3 | 2e-69 |

Fig. 6N

| | | | DEKILMKPHWYKYYGKNIYI | | | | | |
|---|---|---|---|---|---|---|---|---|
| 61 | 42494 | 43033 | 284 | MRTFLTGPYLSLMNAFTHHSDA RVEEICKNEYIPPFEDLLKQYCTL RLDGGRQSGKSTAVTNFAANWL YDGGTVIVLSNTSAYAKISADNIK KEFSRYSNDDIRFRLFTDSVRSFI GNKGSKFRGLSLSRILYIIDEPVK SPDMDKIYSVHIDTVHCCCNIKC CIGGITRPQFFVIGMQ | 179 | Hypothetical protein RB32ORF122c [Enterobacteria phage RB32] | YP_803064.1 | 1e-100 (176/179) | Endoribo nuclease RegB T4-bacteriop hage encoded | pfam10715 | 4e-11 |
| 62 | 43030 | 43359 | 285 | MMTDTQLFEYLYFSPKTIKNKLV NHFEILAKNNILSEFYPKQYKLQK GVFKGCRVLCTAPNARLMNKIPY FTMEFIDGPFKGLITQSLMAYDS EPPLIKEQSWINLFFN | 109 | Unnamed protein product [Enterobacteria phage T4] | CAA28221.1 | 3e-57 (108/109) | REGB_T 4, Endoribo nuclease RegB T4-bacteriop hage encoded | pfam10715 | 1e-12 |
| 63 | 43366 | 43728 | 286 | MKAYQILEGTHKGTIYFEDGIQA RIIVSKTFKEDSFVDPEIFYGLHA REIEIEQQPTVKIEGGQHLNVNVL RRETLEDAVKHPEKYPQLTIRVS GYAVRFNSLTPEQQRDVIARTFT ESL | 120 | Hypothetical protein vs.6 [Enterobacteria phage RB51] | YP_0028540 79.1 | 2e-63 (119/120) | Automom ous glycyl radical cofactor GrcA | PRK11127 | 1e-41 |
| 64 | 43728 | 43949 | 287 | MAKIIIEGSEDVLNAFAEWFSNS GEQQFNEAWNMGDINGIYPTTEI SVQGYGIHEPIRLVEYDLGTGEE VKYD | 73 | Hypothetical protein RB32ORF119c [Enterobacteria phage RB32] | YP_803061.1 | 1e-33 (70/73) | No putative conserved domains have been detected | | |
| 65 | 43942 | 44208 | 288 | MIEDIKGYKPHTDDKISKVNAIKD AEVRLGLIFDALYDEFWEAFDSC EDDELAKNYAESLDQLTIAKMKL KEASMWACRAVFQPEEKY | 88 | Hypothetical protein vs.4 [Enterobacteria phage RB14] | YP_0028544 57.1 | 4e-42 (84/88) | No putative conserved domains have been detected | | |
| 66 | 44208 | 44486 | 289 | MAQLSAGFGYEYYTAPRRVSVA PKKIQSLDDFQEVVRNAFQDYAR YLKEDSQDCLEEDEIAYYEQRLE QLKNLHEVRAEVSKSMNKLIRFK E | 92 | Conserved hypothetical protein vs.3 [Enterobacteria phage T4] | NP_049727.1 | 3e-46 (91/92) | REGB_T 4, Endoribo nuclease RegB T4-bacteriop hage encoded | pfam10715 | 3e-05 |
| 67 | 44546 | 45007 | 290 | MTINTEVFIRRNKLRRHFESEFR QINNEIREASKAAGVSSFHLKYS QHLLDRAIQREIDETYVFELFHKI KDHVLEVNEFLSMPPRPDIDEDF IDGVEYRPGRLEITDGNLWLGFT VCKPNAKFKDPSLQCRMAIINSR | 153 | Site-specific RNase [Enterobacteria phage RB32] | YP_803058.1 | 8e-86 (153/153) | REGB_T 4, Endoribo nuclease RegB T4-bacteriop | pfam10715 | 2e-39 |

Fig. 60

| | | | RLPGKASKAVIKTQ | | | | | | hage encoded | | |
|---|---|---|---|---|---|---|---|---|---|---|---|
| 68 | 45015 | 45560 | 291 | MRKALLAGLLAISMMAHSSEHTF SNVQLDNMRYAYOFGEQFSKD GKYKTHKNIHKSGLGHIMAAILW QESSAGVNLKSKPKHHAYGMFQ NYLPTMRARVKELGYNMTDAEIK RMLNKRSNSASWAYIELSYWLNI HKGDIRKAISSYNSGWNVKAGS KYASEVLEKANYLKNNKLLEIVN D | 181 | Conserved hypothetical protein vs.1 [Enterobacteria phage T4] | NP_049725.1 | 6e-101 (180/181) | | REGB_T 4, Endoribo nuclease RegB T4-bacteriop hage encoded | pfam1071 5 | 2e-27 |
| 69 | 45553 | 45894 | 292 | MTKILVLCIGLISFSVLADTSYTEI REYNRTAADYCGKNKACQAEF AQKLIYAYKDGERDKSSRYKNDT LLKRYAKKWNTLECSVAEEKDK AACHSMVDRLVDSYNRGLSTR | 113 | Modifier of valyl-tRNA synthetase [Enterobacteria phage RB51] | YP_0028540 073.1 | 5e-59 (112/113) | modifier of valyl-tRNA synthetase | No putative conserved domains have been detected | | |
| 70 | 45891 | 46370 | 293 | MIVKYIKGDIVALFLQGNIIAHGCN CFHTMGSGVAGQLARAYPKILEI DKTTTEYGSRDKLGDMSIVFKHS PTGFGICYNLYTQYEPGPNLDYG ALVNCMIELNLQAETLLFKPVIYIP RIGCGIAGGDWDKVSKLIDMFTP DIDLIVDYESTLPASV | 159 | Tk.4 conserved hypothetical protein [Enterobacteria phage JS98] | YP_0015952 33.1 | 5e-84 (148/159) | | Macro domain, Poa1p_lik e family | cd02901 | 5e-21 |
| 71 | 46342 | 46554 | 294 | MKVHYPHPFDPKNKVEIIRQWER ICRTKCPINSPHDVDKDYIGTFVE YTFIDRKGRKQHVEEYCLKVTWL | 70 | Hypothetical protein tk.3 [Enterobacteria phage RB51] | YP_0028540 71.1 | 6e-33 (67/70) | | No putative conserved domains have been detected | | |
| 72 | 46551 | 46757 | 295 | MSQTSILKNAHCEKCEWPVVFAL CNDEMACDFDYWCYCSNKGCIN HKGEGFYSGFYPYPDFVKEGKP K | 68 | Hypothetical protein RB32ORF111c [Enterobacteria phage RB32] | YP_803053.1 | 6e-33 (67/68) | | No putative conserved domains have been detected | | |
| 73 | 46754 | 46927 | 296 | MNSFELQYEVLRELDNLIELAVN KGFAIGIGQKDTGHLTMEIFKQK RIILKLLEINI | 57 | RB32ORF110c hypothetical protein [Enterobacteria phage RB51] | YP_0028540 69.1 | 2e-23 (56/57) | | No putative conserved domains have been detected | | |
| 74 | 46924 | 47109 | 297 | MSLSKEQKDKLFELIHELLDEHT EANTFYDEYGPLSPEQQEEFAD RFDKKENELIAYVNML | 61 | Hypothetical protein tk.2 [Enterobacteria phage RB51] | YP_0028540 68.1 | 2e-26 (60/61) | | No putative conserved domains have been detected | | |
| 75 | 47119 | 47700 | 298 | MASLIFTYAAMNAGKSASLLTAA HNYKERGMGVLVLKPAIDTRDSV CEVVSRIGIKQEANIITDDMDIFEF YKWAEAQKDIHCVFVDEAQFLKT EQVHQLSRIVDTYNVPVMAYGL RTDFAGKLFEGSKELLAIADKLIE | 193 | Thymidine kinase [Enterobacteria phage RB32] | YP_803049.1 | 5e-110 (192/193) | thymidine kinase | Thymidin e kinase | PRK04296 | 2e-77 |

Fig. 6P

| | | | | LKAVCHCGKKAIMTARLMEDGT PVKEGNQICIGDEIYVSLCRKHW NELTKKLG | | | | |
|---|---|---|---|---|---|---|---|---|
| 76 | 47743 | 47955 | 299 | MLQLTEKQLRNLTVLQLDEIRRE VGNIISALRREVSLNQSPADYTRL RNFEKYLDKVKAVHRHKVNTGQ K | 70 | Conserved hypothetical protein rI.1[Enterobacteria phage T4] | NP_049718. 1 | 1e-32 (70/70) | | No putative conserved domains have been detected |
| 77 | 47968 | 48261 | 300 | MALKATALFAMLGLAFALSPPIEA NVDPHFDKFMESGIRHVMLFE NKSVESSEQFYSFMRTTYKNDP CSSDFECIERGAEMAQSYARIMN IKLETE | 97 | Membrane protein, rI lysis inhibition regulator [Enterobacteria phage T4] | NP_049717. 1 | 2e-49 (94/97) | lysis inhibition regulator, membrane protein | No putative conserved domains have been detected |
| 78 | 48258 | 48644 | 301 | MKFSDFSQSGKPSKADEYLGLL MAAQAYFHSAHFETKSYARHKA YDFIFSELPDLIDKFGEQYLGYSG RKYTPSIPDASKLPTDTIKMIDRIL DQSNSIYKEMPPAIQSTIDDITGM FYQSKYLLSLE | 128 | MobD.6 hypothetical protein [Enterobacteria phage T4] | NP_049716. 1 | 5e-68 (128/128) | | No putative conserved domains have been detected |
| 79 | 48740 | 48929 | 302 | MKIEALNQEGNIYVIINGDFFVDM DEVTSEELVELLKKRYDMCDEAA THMACAIFSLSYVVE | 62 | MobD.5 hypothetical protein [Enterobacteria phage T4] | NP_049715. 1 | 4e-27 (60/62) | | No putative conserved domains have been detected |
| 80 | 48928 | 49131 | 303 | MTRIEQADKIKELVALIRKADEEL SDFAWFSAGIANKGIEKFEAKVD NALEALDMFLDEIIDHNTRV | 67 | Hypothetical protein RB32ORF102c [Enterobacteria phage RB32] | YP_803044. 1 | 1e-26 (61/67) | | No putative conserved domains have been detected |
| 81 | 49134 | 49328 | 304 | MLTREQFEKIIKLARDIEIDSYQLA VEHCEGYSYDGIEAAKKDLDKSK AKLVQYLEMIRWNNEN | 64 | MobD.3 hypothetical protein [Enterobacteria phage RB51] | YP_0028540 61.1 | 2e-29 (64/64) | | No putative conserved domains have been detected |
| 82 | 49318 | 49491 | 305 | MKTEKQMFLMKLIEEYANAVSDY ECSSRERGTAFAKEELKIMVDAH TKLQNFIENVI | 57 | mobD.2a hypothetical protein [Enterobacteria phage RB14] | YP_0028544 39.1 | 5e-25 (56/57) | | No putative conserved domains have been detected |
| 83 | 49656 | 49841 | 306 | MTSEQAFKLKELIETYSKAVHTA TVIDESAFSGHANKIKYKTLMEEA KVNLDSYIETLIGE | 61 | Hypothetical protein RB14ORF101 [Enterobacteria phage RB14] | YP_0028544 37.1 | 1e-25 (59/61) | | No putative conserved domains have been detected |
| 84 | 49843 | 50109 | 307 | MGFPKLEVGDLVLTKLWNGVQS VEICQYRGATGNLMYTIYNPEILL ECHLERFIKDTDSMPYSVSIVRK SDTKEYSKILEQIRANKKD | 88 | Hypothetical protein RB14ORF100 [Enterobacteria phage RB14] | YP_0028544 36.1 | 7e-42 (83/88) | | No putative conserved domains have been detected |
| 85 | 50111 | 50644 | 308 | MKRLVLEVSPLFGELAIEKVNNM YRLTQEDDMLYFTPSEIIHLTQIE | 177 | Hypothetical protein RB32ORF098c | YP_803040. | 1e-96 (169/177) | | No putative conserved domains have been detected |

Fig. 6Q

| | | | | | | | | |
|---|---|---|---|---|---|---|---|---|
| 86 | 50651 | | YPYTDKIVSINDEHKIHFYSSCPG FNIKSESMCLSVIHWDSFIDKIKY FYSNERKHSLKWLKNCNAIITN ACNQNDETLLNVSKCYEEGDVL TIRQIDDFRSHIVTFTKDEAIALKT YLDSVIPTMISK | | [Enterobacteria phage RB32] | | | have been detected |
| | 51172 | 309 | MFISSSGLIRVEFKNDIFLSQGD DIIKMSYDEIKICHALESHGKEN ATIDIGDLWVTLYEVSEGFNIEDE NNILAIDKRSDLFDVLKVYEQSN GGRKAVLVYQKPHSCGTASIISNI EDETDTYMCVLKAGGDRHPDFI SIRQNNGEISLSKSEAEAMIKYLT TVTPSMKG | 173 | Hypothetical protein RB32ORF097c [Enterobacteria phage RB32] | YP_803039.1 | 4e-93 (166/173) | No putative conserved domains have been detected |
| 87 | 51175 | 310 | MIINENSWHYKLFKMFNDEWKR PKTLCAYFWSIVIPTFFVSFFGCT ILAGLTIICAEIIQKWLIFGSLWTLI PSAFILAILLVLLIIGSFVIPAQLHE KYKDYKWKKDYALHVENIDRAY KGLPPIQPKKSIIVEFLKARKAKV CPVIEYKAE | 153 | RB32ORF096c hypothetical protein [Enterobacteria phage RB51] | YP_0028540 56.1 | 8e-63 (139/153) | No putative conserved domains have been detected |
| 88 | 51636 | 311 | MKTVMKSYFGSHLYGTSTPESD VDFKEIFVPPARDILIGNVKEHMS KNTNNTSSKNTKDDIDHELYSLK YFFKLAADGETVALDMLHTPPEL VVKSDLPDVWKFIQDNRSRFYTT NMKSYLGYVRKQASKYGVKGSR LAALRDVLKVVNQIPEGWVDYQ EDCGSIKQRRTKVEDIKHRLPENE FCEWVFHNHEKTGPQTFYTVLG RKYQTTLSLIELKQSLNKLDAEY GERARKAEANEGIDWKALSHAC RGGLQLLEIYKTGDLVYPLQDAP FILDVKLGKHPFKTVQEFLEDVV DQVEAASTEASKNGMQQKVDM SFWDDFLEKVYLENHRSYYK | 336 | Hypothetical protein RB32ORF095c [Enterobacteria phage RB32] | YP_803037.1 | 0.0 (335/336) | Nuc-transf. Predicted nucleotidy l-transferas e | pfam1012 7 | 2e-06 |
| 89 | 52764 | 312 | MKITPIEVKKLIDTEEISECFESFL EDATEDNAVYLAQKIIETYLEKNQ | 49 | No significant similarity found. | | | |
| 90 | 52910 | 313 | MTYVYDVLMNHGWKLRGHPTK NCHMFTDGDIEELHEMAEAIGMK RSWFQDKRIKHYDLHARRQKA VELGAVEVSRREAVKIWRTLK | 87 | No significant similarity found. | | | No putative conserved domains have been detected |
| 91 | 53243 | 314 | MKTVTINKGIYFGKEISGTFELLG EWFPDNAPVDAQGDGKVFEID GKRRGVWVYKSDISYDGVKVEE VKESYEDMKTRINKRFNVMGMM | 322 | Hypothetical protein RB32ORF094c [Enterobacteria | YP_803036.1 | 0.0 (319/322) | No putative conserved domains have been detected |

Fig. 6R

| | | | | | | | |
|---|---|---|---|---|---|---|---|
| | | | | TNGIINGNIRSLIISGAAGIGKTYS LDKALNKANDNGYIEYKSINGKIS GIGLYEQLWNNREENSVLLIDDV DVFSDMDILNLLKAALDTGETRK VCWSTASSYLEEKGIEREFEFKG TIVFITNVDIDRELDRGTKLAPHL QALVSRSVYLDLGVHTNEEIMVR VEDVILSTDMMQKRGLSDEETYK ALSWMKVNVNRLRNVSLRTALY LADFIMTDKNGWEEIAEVTLLK | | phage RB32] | |
| 92 | 5413 | 54615 | 315 | MLYSKAREIYETKIKEAVFKFATT MRWTNDWEYSKNHKPMVTRK AHMLVLIDREQIKAREALQNHKK AAFEWFMDNTAPETKKAVSAWF SGKNCERSFF | 100 | NrdC.9 conserved hypothetical protein [Enterobacteria phage T4] | NP_04970.1 | 8e-52 (98/100) | No putative conserved domains have been detected |
| 93 | 54676 | 55203 | 316 | MNAKDIFNLVNYNDGKFKSEAQ SKFFNDISIGGEITVDGGQIYKSR WNWIVIIDEIGIVEIYKNTNKNRTL HWSRDTNEQYKKDKASKLSRVT QEDIEFIKKDILMYDNLIAEEQAVI DKFDEIKASREIPDFMKESVNER YTLISERIETYKKQRAERQNTLRK FEERLKTVLA | 175 | NrdC.8 hypothetical protein [Enterobacteria phage RB14] | YP_0028544 28.1 | 9e-96 (175/175) | No putative conserved domains have been detected |
| 94 | 55259 | 55666 | 317 | MKQLIIKRLNLLICCLCIAIAYGYY AINDYMHYKDYDVTVVNTITGTQ GKGSSLSFIAVYELKDGYRFSEYI SPEMYSSIEKGDNITVSLRPFDV KQTLFDNIVWFFGMVLVQSVCG AYIVCSILFCIFSKIEIE | 135 | NrdC.7 conserved hypothetical, predicted membrane protein [Enterobacteria phage T4] | NP_049705. 1 | 9e-66 (122/133) | No putative conserved domains have been detected |
| 95 | 55674 | 56561 | 318 | MSVVINNVNAVIKSLVNKKLNEW TVLRRGEPDKFFHRFNPTLDLNV IDRDVHAEILDKFKVDIGFGLDKH LQRTNGSGMGLSNRIMKALNKIG ALSRINASEILRNYNKGYDLYGRL MPKLSFDQMIADLWENQRRLLA LGARLAKGLDKQMIFKTNNTEDL KCFKFSTRGDDYYIRARSTDYVN MGHHLCLAFEVLKEAGTLEYVS GAKCPIGSNCILIYRPDESSSTKL PTKPVPVRSNEKHSEQIAYFNKQ IEELNISIQQYDDEIFRLSGLSSKA KSEREKLIKIVDLLKS | 295 | NrdC.6 hypothetical protein [Enterobacteria phage RB32] | YP_0028544 26.1 | 8e-170 (291/295) | No putative conserved domains have been detected |
| 96 | 56570 | 57598 | 319 | MKTRSQIEDMVRNASYTRDVMT FLCENNLDPDKVNRVIHHFKYTN SSEWVRNFSKAGYITQMTAREQ LTDFCKTIDYKNPLIVQGVGQSK | 342 | Hypothetical protein RB32ORF088c [Enterobacteria phage RB32] | YP_803030.1 | 0.0 (335/342) | |

Fig. 6S

| | | | | | | | | |
|---|---|---|---|---|---|---|---|---|
| | | | VDLSSGFFNPNHYRIEWRFIALF RKQLKQILSTASRLKGSDINLKNL KFDGYTLQMEVRPLKENNRTARI SFKPNTKNSLSICECLKSQLTEAF KYMDVVAAVQSKILPRFERNWE HTTTYELDMIVSFKYEFLRKDEIV QEKKQEVQDTLNLNLSNYLSND PKFWMYSSNIDACKLNKYSFLP TENSNFKPVEKWHADAIEKSLKA VDDELVKATNEVLEAEKALEQAQ SRVQNLTKQRSKLNNALNALN | | | | | |
| 97 | 57656 | 320 | MTRNEYIKSFNSVIDDKAIPMFG QNSVLSIINQWLNSVDASIVSSTK FIHEIRKISSRVDKDVIKTFKESR LLSYLVNRDILGNFGKEIKRTKDV VGYNWFGDVNSYHLNIKEDPENI FTRRWISNFRLFKKQILKSASKLC YGDYRQIHPLASDMIIIKEYELDK NKVSIFVNYGFFTPETNQKNINKF FSIASTITRQLETALLCMETVENIH TYPFKNICGWEGYKLVISLREVK CAYSPTDKEIYQQKCDEIVNTPK EETTLEELMECLDDSPEPIEIRPE VIALEKAYKEVLEISNKAQKEYEQ AKRIWEESVNRLDRLEQALQLIK | 333 | NrdC.4 conserved hypothetical protein [Enterobacteria phage T4] | NP_049702. 1 | 0.0 (330/333) | | No putative conserved domains have been detected |
| 98 | 58710 | 321 | MKTRKHYIDYFDSLITKHRNYQIG HRAVINNILRDFLDYIGWENHICK DTQNAYSHSLGSLLEWFKRSRL LSSVIAVNNVKKFMYPSYIETNVS NASVVTFNIINDVKRTYLEEWFS KDSKEKFASEFSHEFNNNVNML FKHSRRLFCHGDNRTINVNVKD WVTAKFTPSSQNGQFELSIIICAP HEIYKNLPYMKPREANKHNETIS SLAYNLRVILSDMDVVKSFDDNT NYGLSLFETKFVIKLKDPSEFKPT PKSNHGNDTMKEEREYLSARLIE VEKQIEEHTKVLKALTAKANGLR NAIEVLK | 308 | Hypothetical protein RB32ORF086c [Enterobacteria phage RB32] | YP_803028.1 | 1e-180 (307/308) | | No putative conserved domains have been detected |
| 99 | 59633 | 322 | MKKRLLEDIAASSNSSLIKIIMAGE EDDMEMRGKIHGCDDLDFKPPA WDAIMAMVERRERASKNVPNCP ECGTEQVQLINWRKPELEYKCR QCKHKFSKHAPEMVKLPDSTEF FKELVSVQPMPNNILD | 129 | NrdC.2 hypothetical protein [Enterobacteria phage RB14] | YP_0285442. 2.1 | 1e-70 (129/129) | | tRNA synthetas es class I (K) | pfam0192 1 | 0.002 |
| 100 | 60267 | 323 | MTKRKEYMEAAEKAVRELAIAYY NEHGKFPDRYSVLKSALTRSYK | 80 | NrdC.1 hypothetical protein | YP_0028544 | 2e-39 | | No putative conserved domains |

Fig. 6T

| | | | | | | | | | have been detected | |
|---|---|---|---|---|---|---|---|---|---|---|
| | | | NMLSEVSDIIYKHKEQTGQSLDY DETFKQVLGIKE | | [Enterobacteria phage RB14] | 21.1 | (80/80) | | | | |
| 101 | 60269 | 60532 | 324 | MFKYGYDSNIHKCVYCDNAKR LLTVKKQPFEFINIMPEKGVFDDE KIAELLTKLGRDTQIGLTMPQVFA PDGSHIGGFDQLREYFK | 87 | NrdC thioredoxin [Enterobacteria phage T4] | NP_049698.1 | 8e-45 (87/87) | NrdC thioredoxin | GRX_GR Xb_1_3_li ke, Glutaredo xin (GRX) family | cd03418 | 2e-07 |
| 102 | 60529 | 60744 | 325 | MMLEGTDYIHDYRGSAVYVGDE VAVYYGYGTLMTAKVIQIKNNRA KLEVYYSNGEKSISKWKYGDCM VKLG | 71 | RB32ORF082c hypothetical protein [Enterobacteria phage RB51] | YP_0028540 42.1 | 2e-33 (71/71) | | No putative conserved domains have been detected | | |
| 103 | 60747 | 60917 | 326 | MIYDINVSRTPSMVTIPAEELDRL QKIEELLWEIESDLPSGLESWIDY EELNKLRG | 56 | Hypothetical protein RB32ORF081c [Enterobacteria phage RB32] | YP_803023.1 | 6e-23 (55/56) | | No putative conserved domains have been detected | | |
| 104 | 60883 | 61056 | 327 | LIMKNLISFGVKPWWAARWETV EPEPEEPVYIDEETVYYNEPTINDL IDMEMGHDYSR | 57 | Hypothetical protein RB32ORF080c [Enterobacteria phage RB32] | YP_803022.1 | 6e-24 (54/55) | | No putative conserved domains have been detected | | |
| 105 | 61040 | 61525 | 328 | MITVDKWFRINRVDTGLCNYWP ELSAGTVFKVRELAKECEDDIEP DTGIHEIELSDGKIINIYDKPITYWC LWNNTESVENGEIEEVVERTSQD VQKPKAAFQGERISYALAKLAAQ ENNDGYEGNLMQAAAEYIEWLE TQISFSDQKIRQYKRLHQMFYNT | 161 | Inhibitor of host Lon protease [Enterobacteria phage T4] | YP_0028540 38.1 | 4e-86 (155/161) | protease inhibitor | PinA peptidase inhibitor | pfam1046 5 | 3e-66 |
| 106 | 61562 | 61738 | 329 | MKTELVYTEKLNGGKVWKLFIKG HSTDPHMTTCVGTYSRPTKKMI RQYKRLHRMFYNT | 58 | Hypothetical protein RB32ORF078c [Enterobacteria phage RB32] | YP_803020.1 | 9e-27 (58/58) | | No putative conserved domains have been detected | | |
| 107 | 61782 | 62255 | 330 | MLLTGKLYKEEKQKFYDAQNGK CLICQRELNPDVQANHLDHDHEL NGPKAGKVRGLLCNLCNAAEGQ MKHKFNRSGLKGQGVDYLEWLE NLLTYLKSDYTQNNIHPNFVGDK SKEFSRLGKEEMMAEMLQRGFE YNESDTKTQLIASFKKQLRKSLK | 157 | Gp49 EndoVII packaging and recombination endonuclease VII [Enterobacteria phage T4] | NP_049692.1 | 1e-87 (157/157) | EndoVII packaging and recombination endonuclease VII | Recombin ation endonucl ease VII | pfam0294 5 | 3e-20 |
| 108 | 62252 | 64069 | 331 | MTIEKEIEGLIHKTNKDLLNENAN KDSRVFPTQRDLMAGIVSKHIAK NMVPSFIMKAHESGIIHFHDIDYS PALPFTNCCLVDLKGMLENGFKL GNAQIETPKSIGVATAIMAQITAQ VASHQYGGTTFANVDKVLSPYV KRTYAKHIEDAEKWQIADALNYA | 605 | Anaerobic ribonucleotide reductase subunit [Enterobacteria phage RB14] | YP_0028544 13.1 | 0,0 (599/605) | anaerobic ribonucleotide reductase subunit | RNR, class III, Ribonucle otide reductase (RNR) catalyzes | cd01675 | 2e-159 |

Fig. 6U

| | | | | | | | |
|---|---|---|---|---|---|---|---|
| 109 | 64066 | 332 | QSKTEKDVYDAFQAYEYEVNTLF SSNGQTPFVTITFGTGTDWTER MIQKAILKNRIKGLGRDGITPIFPK LVMFVEEGVNLYKDDPNYDIKQL ALECASKRMYPDIISAKNNKAITG SSIPVSPMGCRSFLSAWKDSTG NEILDGRNNLGVVTLNLPRIALDS YIGTQFNEQKFTELFNERMDLCF EALMCRISSLKGVKATVAPILYQE GAFGVRLKPDDIIELFKNGRSS VSLGYIGIHELNILVGRDIGQEILT KMNARLKQWAERTGFAFSLYST PAENLCYRFCKLDTEKYGSVKD VTDKGWYTNSFHVSVEENITPFE KISREAPYHFIATGGHISYVELPD MKNNLKGLEAVWDYAAQHLDYF GVNMPVDKCFTCGSTHEMTPTE NGFVCSICGETDPKKMNTIRRTC GYLGNPNERGFNLGKNKEIMHR VKHQ | | | the reductive synthesis | |
| | 64536 | | | | | | |
| | 64529 | 333 | MIKLNYIMDTINDMIFHFGPEFYS QYSLVLINAWLIN | 37 | Hypothetical protein RB32ORF074c [Enterobacteria phage RB32] | YP_803016.1 | 4e-13 (37/37) | | No putative conserved domains have been detected |
| 111 | 64652 | 334 | MYKFRKGLADFLTTVTFFLFMAV GAIFLIPPFIAIFFVISLISPEKGLSSS EFNERLDKITNKLNAVLDKKA | 71 | Gp55.8 hypothetical protein [Enterobacteria phage RB14] | YP_0028544 11.1 | 8e-32 (71/71) | | No putative conserved domains have been detected |
| 112 | 64870 | 335 | MISFERYVVESWNGFDMFGNDY YFYECSLNPSFWAGREQDLEEIN ARADLLGELPTTYFTFDESGFVI QVYFPEENSGEDSVNPPYWAYQ GIISRGTKLELKE | 103 | Hypothetical protein RB51ORF079 [Enterobacteria phage RB51] | YP_0028540 32.1 | 6e-54 (103/103) | | No putative conserved domains have been detected |
| 113 | 65153 | 336 | VEQNSNLKNKIEVYGIPDEVGRC PGCQSVTKLLKELNAPFTFYKVL TNNGKIEYDRPLIVSLAKRAGFTS LNIRYPVIFINDSRQKNIKHFKETL | 107 | Glutaredoxin [Enterobacteria phage RB51] | YP_0028540 31.1 | 1e-55 (106/107) | glutaredoxin | Glutaredo xin | pfam0046 2 | 7e-04 |



| | | | | | | | | | | |
|---|---|---|---|---|---|---|---|---|---|---|
| 109 | 64066 | 332 | QSKTEKDVYDAFQAYEYEVNTLF SSNGQTPFVTITFGTGTDWTER MIQKAILKNRIKGLGRDGITPIFPK LVMFVEEGVNLYKDDPNYDIKQL ALECASKRMYPDIISAKNNKAITG SSIPVSPMGCRSFLSAWKDSTG NEILDGRNNLGVVTLNLPRIALDS YIGTQFNEQKFTELFNERMDLCF EALMCRISSLKGVKATVAPILYQE GAFGVRLKPDDIIELFKNGRSS VSLGYIGIHELNILVGRDIGQEILT KMNARLKQWAERTGFAFSLYST PAENLCYRFCKLDTEKYGSVKD VTDKGWYTNSFHVSVEENITPFE KISREAPYHFIATGGHISYVELPD MKNNLKGLEAVWDYAAQHLDYF GVNMPVDKCFTCGSTHEMTPTE NGFVCSICGETDPKKMNTIRRTC GYLGNPNERGFNLGKNKEIMHR VKHQ | | | | | | the reductive synthesis | |
| | 64536 | 332 | MNYDRFYPCDFVNGPGCRTVLF VTGCLHKCEGCYNKSTWNARN GIPFTGETLEQIECLNNDYIEGL TITGGDPLYPDNRDVIHCIVQTVK NLYPNKSIWLWTGYKFEDIKQLE MLKYVDVIIDGKYEKNLPTKKLW RGSDNQRLWSNTDGVWKHD | 156 | Anaerobic nucleotide reductase subunit [Enterobacteria phage RB32] | YP_803017.1 | 3e-87 (155/156) | anaerobic nucleotide reductase subunit | NrdG, anaerobic ribonucle oside-triphosph ate reductase activating protein | TIGR0249 1 | 4e-55 |
| 110 | 64529 | 333 | MIKLNYIMDTINDMIFHFGPEFYS QYSLVLINAWLIN | 37 | Hypothetical protein RB32ORF074c [Enterobacteria phage RB32] | YP_803016.1 | 4e-13 (37/37) | | No putative conserved domains have been detected | |
| 111 | 64652 | 334 | MYKFRKGLADFLTTVTFFLFMAV GAIFLIPPFIAIFFVISLISPEKGLSSS EFNERLDKITNKLNAVLDKKA | 71 | Gp55.8 hypothetical protein [Enterobacteria phage RB14] | YP_0028544 11.1 | 8e-32 (71/71) | | No putative conserved domains have been detected | |
| 112 | 64870 | 335 | MISFERYVVESWNGFDMFGNDY YFYECSLNPSFWAGREQDLEEIN ARADLLGELPTTYFTFDESGFVI QVYFPEENSGEDSVNPPYWAYQ GIISRGTKLELKE | 103 | Hypothetical protein RB51ORF079 [Enterobacteria phage RB51] | YP_0028540 32.1 | 6e-54 (103/103) | | No putative conserved domains have been detected | |
| 113 | 65476 | 336 | VEQNSNLKNKIEVYGIPDEVGRC PGCQSVTKLLKELNAPFTFYKVL TNNGKIEYDRPLIVSLAKRAGFTS LNIRYPVIFINDSRQKNIKHFKETL | 107 | Glutaredoxin [Enterobacteria phage RB51] | YP_0028540 31.1 | 1e-55 (106/107) | glutaredoxin | Glutaredo xin | pfam0046 2 | 7e-04 |

Fig. 6V

| | | | ISLGYDRDIIED | | | | | | |
|---|---|---|---|---|---|---|---|---|---|
| 114 | 65634 | 337 | MVVVDKEIKKGQYYFINGNVRV TYVNGFEVYYLILKLHKQMICDR AVFSSVAKEIKLHG | 60 | Gp55.6 hypothetical protein [Enterobacteria phage RB14] | YP_0028544 07.1 | 2e-26 (60/60) | | No putative conserved domains have been detected |
| 115 | 65809 | 338 | MGKTYRRKDLKVRDYDYFGKRK APDGVSHKDMVENIFRSDKWRR MKGIDSEVKDELNRQLRSEVRKL KKSVYIDDDFDYNTSQRVAKRKS NECYRYS | 97 | Gp55.5 conserved protein of unknown function [Enterobacteria phage T4] | NP_049684. 1 | 6e-48 (96/97) | | No putative conserved domains have been detected |
| 116 | 66110 | 339 | MNIKRMLFKQGLYTLNATPKGDT TKWSVNDWIKFIDENGNWEI | 43 | Gp55.4 conserved hypothetical protein [Enterobacteria phage T4] | NP_049683. 1 | 2e-16 (42/43) | | No putative conserved domains have been detected |
| 117 | 66242 | 340 | MNPESKLSQRIAEERAKFFQNM KHNGIEDEVFLNIWFWNNKYAAC EGALSLSVAMMYEGWKGAKKFS | 66 | Gp55.3 hypothetical protein [Enterobacteria phage T4] | NP_049682. 1 | 1e-31 (66/66) | | No putative conserved domains have been detected |
| 118 | 66495 | 341 | MTIQIKNAINSYAYDKVVSLLEKG DIVTPQILDKWEKELHQTMKQND QKIGRNTVRELLVQYILSEFDVKA FGVESKAYQKHEISDKTIRRMKN QRKKKFADLKITKV | 108 | Gp55.2 hypothetical protein [Enterobacteria phage T4] | NP_049681. 1 | 6e-56 (108/108) | Hypotheti cal protein | PHA02100 | 0,003 |
| 119 | 66824 | 342 | MNEALINDLRLAGYEVNTNGIGL TQIEGNGFILEYEFSQWWLYANY GELIEYVDQFDSLDAALEAAKLM NV | 71 | Gp55.1 hypothetical protein [Enterobacteria phage T4] | YP_0028544 02.1 | 2e-32 (71/71) | | No putative conserved domains have been detected |
| 120 | 67036 | 343 | MKLINISIAIENFGIFYVDQYMKIS FFPNKTGVGYWESHVSELNESE YVSTHKKFLDFLYRADINDHYIDI HEFKKMMEKVFQAYCLLR | 89 | Hypothetical protein RB14ORF65 [Enterobacteria phage RB14] | YP_0028544 01.1 | 2e-41 (81/89) | | No putative conserved domains have been detected |
| 121 | 67384 | 344 | MSETKPKYNYVNNKELLQAIIDW KTELANNKDPNKVVRQNDTIGLA IMLIAEGLSKRFNFSGYTQSWKQ EMIADGIEAASIKGLHNFDETKYKN PHAYITQACFNAFVQRIKKERKE VAKKYSYFVHNVYDSRDDDMVA LVDETFIQDIYDKMTHYEESTYRT PGAEKKSVVDDSPSLDFLYEAN D | 185 | Gp55 Sigma factor for T4 late transcription [Enterobacteria phage T4] | NP_049679. 1 | 7e-106 (185/185) | | No putative conserved domains have been detected |
| 122 | 67925 | 345 | MRLTINLSGFLEEIPEVEAIPYLLK MYLREVLALDIDIDPENPYDTAFK SNGVELNYRYHLTDDDFYFILEK | 72 | A-gt.5 hypothetical protein [Enterobacteria phage T4] | NP_049678 | 2e-33 (72/72) | | No putative conserved domains have been detected |

Fig. 6W

| | | | | | | | |
|---|---|---|---|---|---|---|---|
| 123 | 68145 | 346 | MTDKPEINDEVEKLISSIEEKNRL EAERKANKLLSKNKRELNRLYKH AQIAAENNNFAQYEYAIKKSRDIL KQPYNDELISILWKTTRSQIEDMI DAYTRKIQAS | 105 | A-gt.4 conserved hypothetical protein [Enterobacteria phage T4] | NP_049677.1 | 8e-53 (105/105) | | No putative conserved domains have been detected |
| 124 | 68431 | 347 | MLTHVKFKRLKINAGFTESLNGH LCVKISEKEYHDSSIKEVNPPIVR ADPNMKVWVDSYQVKKWWQL | 67 | Hypothetical protein RB32ORF062c [Enterobacteria phage RB32] | YP_803004.1 | 2e-32 (67/67) | | No putative conserved domains have been detected |
| 125 | 68638 | 348 | MNTQTSEIDYNKIRSSKEEMMRR FKESHDKAKAEGTIKYKRIKFKSS NEPLYGVLCG | 57 | A-gt.2 hypothetical protein [Enterobacteria phage RB51] | YP_0028540 19.1 | 2e-24 (55/57) | | No putative conserved domains have been detected |
| 126 | 68878 | 349 | MKVCIFMARGLEGCGVTKFSLE QRDWFIKNGHEVTLYYAKDKSFT RNCAHDYKSFSIPVLLAKEYDKT LKLVNDCDILIINSVPATSVEEDTI NNYKKIIDNIKPSVRVVVYQHDHS SLSLRRNLGLEETIRRADVIFSHS DNGDFNKVLMKEWYPETVSLFD DIEEAPTVYNFQPPMDIAKVRST YWKDVSEINMNINRWIGRTTTW KGFYQMFDFHEKHLKPAGLSTIM EGLERSPAFIPIKEKGIPYEYYRL HQVDQIKIAPNLPTQILDRYVNSE MLERMSKSGFGYQLSKLDKKYL QRSLEYTHLELGACGTIPVFWKS TGENLKFRVDNTPLTSHDSGIIW FDENDMESTFERIKELSSDRTLY DREREKAYEFLYQHQDSSFCFK EQFDIITK | 400 | Alpha-glucosyl-transferase [Enterobacteria phage RB51] | YP_0028540 18.1 | 0.0 (399/400) | alpha-glucosyl-transferase | No putative conserved domains have been detected |
| 127 | 70257 | 350 | MKILNLGDWHLGVKADDEWVQS IQLDGIKQAIEYSKKNGITTWIQY GDIFDVRKAITHKTMEFAREIVQ MLDDAGITLHTIVGNHDMHFKNT LTPNASTELLAKYPNVKVYDKPT TVDFDGCLIDLIPWMCEENTGEIL EHIKTSSASFCVGHWELNGFYFY KGMKSHGLEPDFLKTYKEVWSG HFHTISEAANVRYIGTPWTLTAG DENDPRGFWMFDTETERMEFIP NNTTWHRRIHYPFKGKIDYKDFT NLSVRVIVTEVDKNLTKFESELEK VVHSLRVVSKIDNSVESDDSEEV EVQSLQTLMEEYINAIPDITDSDR EALIQYANQLYVEATQ | 339 | Gp47 recombination endonuclease subunit [Enterobacteria phage RB51] | YP_0028540 16.1 | 0.0 (337/339) | recombination endonuclease subunit | Exonuclease SbcD | TIGR0061 9 | 5e-05 |

Fig. 6X

| | | | | | | | |
|---|---|---|---|---|---|---|---|
| 128 | 71273 | 351 | MTFDEFKNVMMSQHFECEVKDD IGHKEIIEYWFEPLEVEDNCIKKV TVCTDWAVSFNFNILDNDTPKSL RDMAVSCIKDAYCEVFDI | Hypothetical protein RB32ORF057c [Enterobacteria phage RB32] | YP_802999.1 | 1e-43 (87/87) | | No putative conserved domains have been detected |
| 129 | 71517 71723 | 352 | VKFSTFDINDEFIANIDYTEEDSR YVGIIYITSKTAQGVVCMAEFDEY FLDYDDMIEWSKRYIKRNLL | Hypothetical protein RB32ORF056c [Enterobacteria phage RB32] | YP_802998.1 | 9e-32 (68/68) | | No putative conserved domains have been detected |
| 130 | 71762 73402 | 353 | MSVGGNPIDIQLDKVQKTLITGR NGGGKSTMLEAITFGLFGKPFRD VKKGQLINSTNKKELLVELWMEY DEKKYYIKRGQKPNVFEITVNGT RLNESASSKDFQAEFEQLIGMSY ASFKQIVVLGTAGYTPFMGLSTP ARRKLVEDLLEVGTLAEMDKLNK ALIRELNSQNQVLDVKKDSIIQQI KIYNDNVERQKKLTGDNLTRLQN MYDDLAKEARTLKSEIEEANERL VNIVLDEDPTDAFNKIGQEAVLIK SKIDSYNKVINMYHEGGLCPTCL SQLSSGDKVVSKIDKVSECTHS FEQLSTHRDNLKVLVDEYRDNIK TQQSLANDIRNKKQSLITTVDKA KKVKAAIEKASSEFIDHADEIALL QEELDKIVKTKTNLVMEKYHRGIL TDMLKDSGIKGAIIKKYIPLFNKQI NHYLKIMEADYVFTLDEEFNETIK SRGREDFSYASFSQGEKARIDIA LLFTWRDIAEKVSGVKINTLILDE VFDSATDVEGVKAISTILDSLKNT NVFVISHRDHDPQAYGQHLQMK KVGRFTVMV | Gp46 recombination endonuclease subunit [Enterobacteria phage RB14] | YP_0028543 90.1 | 0.0 (545/546) | recombination endonuclease subunit | ABC_sbc CD, SbcCD, and other Mre11/Ra d50 (MR) complexe s are implicated in the metabolis m of DNA ends | cd03279 | 6e-08 |
| 131 | 73458 73646 | 354 | MEYSTGQHLLTIPEIKRYILRNNF SNEEHIVTESMLRNAFKAEYTKI MSNRNEAWTVTDYYD | Gp45.2 conserved hypothetical protein [Enterobacteria phage T4] | NP_049668.1 | 4e-29 (62/62) | | No putative conserved domains have been detected |
| 132 | 73656 74045 | 355 | MTKITVNYTVDVKDIQPKHVRSE SNPQNQNKIRRAWVLSLSDNAM EVIQNKIKSAPARHAYYEAIDREV SNKWIELMRKHTTESLNAGAKFI MTSCGERLEDEYCGNADERLIV AAQIVAETIAADFNR | RNA polymerase binding [Enterobacteria phage RB14] | YP_0028543 88.1 | 5e-71 (129/129) | RNA polymerase binding protein | Phage RNA polymera se binding, RpbA | pfam1078 9 | 5e-35 |
| 133 | 47101 74787 | 356 | MKLSKDTTALLKNFATINSGIMLK SGQFIMTRAVNGTTYAEANISDVI DFDVAIYDLNGFLGILSLVNDDAE ISQSEDGNIKIADARSTIFWPAAD | Gp45 sliding clamp DNA polymerase [Enterobacteria phage RB32] | YP_802993.1 | 2e-129 (228/228) | sliding clamp DNA polymerase | Gp45 sliding clamp, C terminal | pfam0911 6 | 5e-46 |

Fig. 6Y

| | | | | | | | | |
|---|---|---|---|---|---|---|---|---|
| 134 | 74839 | 357 | PSTVVAPNKPIPFPVASVVTEIKA EDLQQLLRVSRGLQIDTIAITVKE GKIVINGFNKVEDSALTRVKYSLT LGDYDGENTFNFIINMANMKMQ PGNYKLLLWAKGKQAAKFEGE HANYVVALEADSTHDF | | | | | |
| | 75798 | 357 | MITVNEKEHILEQKYRPSTIDECIL PAFDKETFKSITSKGKIPHIILHSP SPGTGKTTVAKALCHDVNADMM FVNGSDCKIDFVRGPLTNFASAA SFDGRQKVIVIDEFDRSGLAESQ RHLRSFMEAYSSNCSIIITANNID GIIKPLQSRCRVITFGQPTDEDKI EMMKQMIRRLTEICKHEGIAIAD MKVVAALVKKNFPDFRKTIGELD SYSSKGVLDAGILSLVTNDRGAI DDVLESLKNKDVKQLRALAPKYA ADYSWFVGKLAEEIYSRVTPQSII RMYEIVGENNQYHGIAANTELHL AYLFIQLACEMQWK | NP_049665. 1 | 0,0 (319/319) | Gp44 clamp loader subunit, DNA polymerase accessory protein [Enterobacteria phage T4] | The AAA+ (ATPases Associate d with a wide variety of cellular Activities) superfami ly | cd00009 | 5e-06 |
| | | | | | | | Rfc, replicatio n factor C small subunit | PRK00440 | 1e-24 |
| 135 | 75800 | 358 | MSLFEDDIQLNEHQVAWYSKDW TAVQSAADSFKEKAENEFFEIIGA INNKTKCSIAQKDYSKFMVENAL SQFPECMPAVYAMNLIGSGLSD EAHFNYLMAAVPRGKRYGKWAK LVEDSTEVLIIKLLAKRYQVNTND AINYKSILTKNGKLPLVLKELKGL VTDDFLKEVTKNVKEQKQLKKLA LEW | YP_0028540 07.1 | 2e-105 (187/187) | Gp62 clamp-loader subunit [Enterobacteria phage RB51] | clamp-loader subunit | | No putative conserved domains have been detected |
| 136 | 76365 / 76733 | 359 | MIEITLKKPEDFLKVKETLTRMGI ANNKDKVLYQSCHILQKKGLYYI VHFKEMLRMDGRQVEMTEEDE VRRDSIAWLLEDWGLIEIVPGQR TFMKDLTNNFRVISFKQKHEWKL VPKYTIGN | NP_049663. 1 | 5e-66 (122/122) | RegA translational repressor protein [Enterobacteria phage T4] | RegA translational repressor protein | Translat_r eg, bacteriop hage translatio nal regulator | pfam0181 8 | 6e-46 |
| 137 | 76735 / 76956 | 360 | MTAITPQEYMASLKEKYNLSATE TLFDLPENLQLKFQVEFQKLVHP EQKHFTAVVKSINADGMIIFTRQI VLI | YP_0028543 83.1 | 5e-34 (71/73) | RB32ORF047c hypothetical protein [Enterobacteria phage RB14] | | | No putative conserved domains have been detected |

Fig. 6Z

| | | | | | | | | | |
|---|---|---|---|---|---|---|---|---|---|
| 138 | 77035 | 79731 | 361 | MKEFYISIETVGNNIVERYIDENG KERTREVEYLPTMFRHCKEESK YKDIYGKNCAPQKFPSMKDARD WMKRMEDIGLEALGMNDFKLAYI SDTYGSEIVYDRKFVRVANCDIE VTGDKFPDPMKAEYEIDAITHYD SIDDRFYVFDLLNSMYGSVSKW DAKLAAKLDCEGGDEVPQEILDR VIYMPFDNERDMLMEYINLWEQ KRPAIFTGWNIEGFDVPYIMNRV KMVLGERSMKRFSPIGRVKSKLI QNMYGSKEIYSIDGVSILDYLDLY KKFAFTNLPSFSLESVAQHETKK GKLPYDGPINKLRETNHQRYISY NIIDVESVQAIDKIRGFIDLVLSMS YYAKMPFSGVMSPIKTWDAIIFN SLKGEHKVIPQQGSHVKQSFPG AFVFEPKPIARRYIMSFDLTSLYP SIIRQVNISPETIRGQFKVHPIHEY IAGTAPKPSEEYSCSPNGWMYD KHQEGIIPKEIAKVFFQRKDWKK KMFAEEMNAEAIKKIIMKGAGSC STKPEVERYVKFSDDFLNELSNY TESVLNSLIEECEKAATLANTNQL NRKILINSLYGALGNIHFRYYDLR NATAITIFGQVGIQWIARKINEYLN KVCGTNGEDFIAAGDTDSVYVC VDKVIEKVGLDRFKEQNDLVEFM NQFGKKKMEPMIDVAYRELCDY MNNREHLMHMDREAISCPPLGS KGVGGFWKAKKRYALNVYDME DKRFAEPHLKIMGMETQQSSTP KAVQEALEESIRRILQEGEEESVQ EYYKNFEKEYRQLDYKVIAEVKT ANDIAKYDDKGWPGFKCPFHIR GVLTYRRAVSGLGVAPILDGNKV MVLPLREGNPFGDKCIAWPSGT ELPKEIRSDVLSWIDYSTLFQKSF VKPLAGMCESAGMDYEEKASLD FLFG | 898 | Gp43 DNA polymerase [Enterobacteria phage RB14] | YP_0028543 82.1 | 0.0 (898/898) | DNA polymerase | DNA polymera se family B | pfam0013 6 | 4e-70 |
| 139 | 80293 | 79913 | 362 | MKIAILVIALGLTGCVAQGPVVNQ SDVGKIVNCSSKFYNPNVKCYKE APKQTVEQMQANFDEAIRPDES AQAYRNSDVITREEKIENYCAEL WANWANNYQWRTGKNAPMEY VVNSYNSCVKNLTK | 126 | Imm,1 hypothetical protein [Enterobacteria phage RB51] | YP_0028540 02.1 | 3e-68 (126/126) | | | No putative conserved domains have been detected |
| 140 | 80552 | 80301 | 363 | METLVAGSIFMVLVSGVLAIIIYML | 83 | Immunity to | YP_802986.1 | 1e-38 | immunity to | | No putative conserved domains |

Fig. 6AA

| | | | | | | | | | have been detected | |
|---|---|---|---|---|---|---|---|---|---|---|
| 141 | 80706 | | | PWFIALMRGSKSTVGIFFTSLLFN WSIIGWFITFIWSIAGETKKSAQP NQVIIIREKE | | superinfection membrane protein [Enterobacteria phage RB32] | | (83/83) | superinfection membrane protein | |
| 142 | 81446 | | 364 | MISDSMTVEEIRLHLGLALKEKDF VVDKTGVKTIEIIGASFVADEPFIF GALNDEYIQRELEWYKSKSLFVK DIPGETPKIWQQVASSKGEINSN YGWAIWSEDNYAQYDMCLAELG QNPDSRRGIMIYTRPSMQFDYN KDGMSDFMCTNTVQYLIRDKKV NAVVSMRSNDCWAGYRNDYAW QKYVLDKLVSDLNAGDPSRQYK AGSIIWNVGSLHVYENQFYLVDH WWNTGETTHIAKKDYTGKWK | | Gp42 dCMP hydroxymethylase [Enterobacteria phage RB51] | YP_0028539 99.1 | 2e-136 (235/246) | dCMP hydroxy-methylase | TS_Pyrim idine_HM ase, Thymidyl ate synthase and pyrimidin e hydroxy-methylas e | cd00351 | 2e-16 |
| 143 | 81437 | | 365 | MEVNVPHVYKYKHPKTKKWYIG SHDGHNPNYDGSGVVWQHVKK KYGIKSFNKEILYEGPMFRQVEEI ILTCLDAANCPDSYNLKNEAWG GSFPGKLNGMYGKKLSPEERYK CGNAFRGIKRPDHSKRMKGEGN PMYGKNEQAYGIINRAKENSGKT YEEIFGVEKAKIIKETMSKNRKGK PHNLIEKICPHCGLKGRGPNMTR YHFDKCKALK | | Endodeoxyribonucl ease [Enterobacteria phage T4] | CAA93271.1 | 7e-66 (51/147) | endodeoxy-ribonuclease | No putative conserved domains have been detected | | |
| 144 | 82075 | | 366 | MIQFVIPSYQRVGAVSALDMFPT DYEPHIVVREHEEKAYTDAYGSK AKIVTIPDDVNGIAGTRKAITDMY AGQRIWMIDDDTTIRMSSMRKR DDRRCVDKVNQLTREQFYELIQY VEDAMDCGYYHGHARLPIFKITS SWGNYRENSYGFTNTWYDLGK LTTEQIGYGKIDLCEDMYAFLNLI NQGYPHLALFKYLVVSGKAQAP GGCSSIRSNSKHNRALEQINREF PEQARWKTSNIEKRKSLGEEDE PLKVLRMCVSRKEKSEAFHKFN AIHPIAVD | | RB32ORF041c hypothetical protein [Enterobacteria phage RB14] | YP_0028543 77.1 | 5e-167 (278/280) | | No putative conserved domains have been detected | | |
| 145 | 82917 | | 280 | | | | | | | | |
| 146 | 82996 | 84177 | 367 | MSIADLKSRLIKASTSKMTAELTT SKFFNEKDVIRTKIPMLNIAISGAI DGGMQSGLTIFAGPSKHFKSNM SLTMVAAYLNKYPDAVCLFYDSE FGITPAYLRSMGVDPERVIHTPIQ SVEQLKIDMVNQLEAIERGEKVIV FIDSIGNMASKKETEDALNEKSV ADMITRAKSLKSLFRIVTPYFSIKN | 393 | RecA-like recombinase protein [Enterobacteria phage RB32] | YP_802982.1 | 0,0 (393/393) | RecA-like recombinase protein | RecA is a bacterial enzyme which has roles in homologo us recombin | cd00983 | 1e-13 |

Fig. 6BB

| | | | | | | | | | | | |
|---|---|---|---|---|---|---|---|---|---|---|---|
| | | | | IPCVAVNHTIETIEMFSKTVMTGGTGVMYSADTVFIIGKRQIKDGSDLQGYQFVLNVEKSRTVKEKSKFFIDVKFDGGIDPYSGLLDMALELGFVVKPKNGWYAREFLDEETGEMIREEKSWRAKDTNCTTFWGPLFKHQPFRDAIKRAYQLGAIDSNEIVEAEVDELINSKVEKFKSPESKSKSAADLETDLEQLSDMEEFNE | | | | | | ation, DNA repair, and the induction of the SOS response. | | |
| 145 | 84170 | 84508 | 368 | MSKDDLDLEIIDESPSSEGEEERKERLFNESLKIIKSAMENVIQEIVIKLEDGSTHIVYVTKLDWVDGKVVMDFAVLDQERKAELAPHVEKCITMQLQDAFNKRSKKKFKFF | 112 | Gp40 head vertex assembly chaperone [Enterobacteria phage T4] | NP_049655.1 | 7e-45 (104/107) | head vertex assembly chaperone | No putative conserved domains have been detected | | |
| 146 | 84518 | 85945 | 369 | VVEIILSHLIFDQAYFSKVWPYMDSEYFESGPAKNTFKLIKSHVNEYHSVPSINALNVALENSSFTETEYSGVKTLISKLADSPEDHSWLVKETEKYVQQRAMFNATSKIIEIQTNAELPPEKRNKKMPDVGAIPDIMRQALSISFDSYVGHDWMDDYEARWLSYMNKARKVPFKLKILNKITKGGAETGTLNVLMAGVNVGKSLGLCSLAADYLQLGHNVLYISMEMAEEVCAKRIDANMLDVSLDDIDDGHISYAEYKGKMEKWREKSTLGRLIVKQYPTGGADANTFRSLLNELKLKKNFVPTIIVDYLGICKSCRIRVYSENSYTTVKAIAEELRALAVETETVLWTAAQVGKQAWDSSDVNMSDIAESAGLPATADFMLAVIETEELAAAEQQLIKQIKSRYGDKNKWNKFLMGVQKGNQKWVEIEQDSTPTEVNEVAGSQQIQAEQNRYQRNESTRAQLDALANELKF | 475 | Gp41 DNA primase-helicase subunit [Enterobacteria phage T4] | NP_049654.1 | 0,0 (473/475) | DNA primase-helicase subunit | DnaB, replicative DNA helicase [DNA replication, recombination, and repair] | COG0305 | 6e-13 |
| 147 | 86004 | 86186 | 370 | MELVKVVFMGWFKNESMFTKEITMMKDDVQWATTQYAEVNKALVKAFIDDKKVCEVDCRG | 60 | Dmd discriminator of mRNA degradation [Enterobacteria phage T4] | NP_049653.1 | 7e-27 (60/60) | discriminator of mRNA degradation | No putative conserved domains have been detected | | |
| 148 | 86188 | 86430 | 371 | MHIVLFKPTPYNVRKNTQFKALIADTWELVLDIPAEESPPFGRVEFIKFAVRPTKRQIRQCKRYFRKIVKLEKQLLMLVK | 80 | Gp61.4 hypothetical protein [Enterobacteria phage RB14] | YP_002854372.1 | 4e-36 (74/76) | | No putative conserved domains have been detected | | |
| 149 | 86494 | 86748 | 372 | MMLVNREYQFKSEEDLEKFASGCELNRRTAKVIGLKPFTVLDCEV | 84 | No significant similarity found. | | | | No putative conserved domains have been detected | | |

Fig. 6CC

| | | | | | | | | |
|---|---|---|---|---|---|---|---|---|
| 150 | 86813 | | SKFRRGCSISGHALVDGNTFFFVFSVRELLLNELEEIK | | | | | |
| | 86995 | 373 | MSKVSGYQLLTQEQRSEMDSLQERCQIHRNNALDSFLLVEYENLCSRLEKEYVHQHEGGEE | 60 | No significant similarity found. | | | |
| 151 | 87099 | 374 | MKKFIFAAIFALSSCAAQPAMAGYDKDLCEWSMTADQTEVETQIEADIMNIVERDRPEMKAEVQKQLKSGGVMQYNYVLYCDKNFNNKNIIAEVVGE | 97 | Sp spackle periplasmic protein [Enterobacteria phage T4] | NP_049651.1 | 2e-49 (94/97) | spackle periplasmic protein, lysis regulation | No putative conserved domains have been detected |
| 152 | 87661 | 375 | MLSDEINDLLNDAEKVAIPSIDDQIFNAFMNRG | 33 | RB32ORF033c hypothetical protein [Enterobacteria phage RB51] | YP_0028539 90.1 | 1e-10 (33/33) | | No putative conserved domains have been detected |
| 153 | 87764 | 376 | MKTFKEFIKEDMVAGDSGGNPENISTGTTSGAVVNKGPEQIPKKKKEESKEKEE | 55 | Orf 61.1 [Enterobacteria phage T4] | AAB25712.1 | 2e-21 (54/54) | | Major capsid protein Gp23 | pfam07068 | 3e-04 |
| 154 | 87931 | 377 | MSSIPWIDNEFAYRALAHLPKFTQVNNSSTFKLRFRCPVCGDSKTDQNKARGWYYGDNNEGNIHCYNCNYHAPIGIYLKEFEPDLYREYIFEIRKEKGKSRPVEKPKELPKQPEKKIIKSLPSCIRLDKLAEDHPIIKYVKARCIPKDKWKYLWFTTEWPKLVNSIAPGTYKKEIPEPRLVIPIYNANGKAESFQGRALKKDAPQKYITIKAYPEATKIYGVERVKDGDVYVLEGPIDSLFIENGIATTGGQLDLEIVPFKDRRVWVLDNEPRHPDTIKRMTKLVDAGERVMFWDKSPWKSKDVNDMIRKEGATPEQIMEYMKNNIAQGLMAKMRLSKYAKI | 342 | Primase [Enterobacteria phage RB32] | YP_802973.1 | 0.0 (340/342) | primase | Toprim_N, DNA primase catalytic core, N-terminal domain | pfam08275 | 4e-05 |
| 155 | 89156 | 378 | MVQKLMALVNAIKGNKKRIAFTISAMIGILLWNFVLSPVAIAHGVSIPVITLDTFVDLAFALVGLI | 66 | RB32ORF030w hypothetical protein [Enterobacteria phage RB51] | YP_0028539 87.1 | 3e-27 (61/66) | | No putative conserved domains have been detected |
| 156 | 89228 | 379 | MAYFNECAHLIEGVDKANRAYAENIMHNIDPLQVMLDMQRHLQIRLANDKPETNRHPDSLETAGEVLAWLRNQDDYIADETRELYTSLGGMSNGEKEASAVWKPWKKRYSEMQSKKIQDLSPEDQLEIKFELIDQFHFFMNKFIALGMSAEEIFKLYYLKNAENFARQDRGY | 172 | dCTPase [Bacteriophage LZ5] | AF374621_1 | 6e-98 (171/172) | dCTP pyro-phosphatase | dUTPase_2 | pfam08761 | 2e-18 |

Fig. 6DD

| | | | | | | | |
|---|---|---|---|---|---|---|---|
| 157 | 89746 | 89946 | 380 | MARLNKRQLKKAHKKRIDQLFKN YDKELVCELLSNQLRAVDWVVE EGPDEIFVSEEALKLIIEHSK | 66 | Hypothetical protein RB14ORF29 [Enterobacteria phage RB14] | YP_0028543 65.1 | 1e-26 (61/66) | | No putative conserved domains have been detected |
| 158 | 89943 | 90116 | 381 | MKISKEEFIRRQKALINLHEWYAY QLKVDSSNINAVMALYKQIQDEH EFLAQVFIED | 57 | No significant similarity found. | | | | |
| 159 | 90156 | 90392 | 382 | MGGFVNIKTFTHPAGEGKEVKG MEVSVPFEIYSNEHRIADSHYQIF PSEKAAYSTVVSDAADWKTKNA AMFTPTQIGG | 78 | Small outer capsid [Enterobacteria phage RB14] | YP_0028543 64.1 | 6e-38(76/78) | small outer capsid protein | No putative conserved domains have been detected |
| 160 | 90491 | 90697 | 383 | MLNRWIKPNEDLDIIISRHVMKKY ELQPWSTEVVHSFMMYADGSV EFNAEIRYDYGEKQVEFKRGFL | 68 | Mrh.2 hypothetical protein [Enterobacteria phage RB14] | YP_0028543 63.1 | 4e-33 (68/68) | | No putative conserved domains have been detected |
| 161 | 90697 | 91038 | 384 | MFIFNWFKSFFTDFFSTTPGEGV VPISNDYLPLTVVEYVYMGDGTV EAVTMTYEEAQEYYKNPWRWS TPITSSNTQNTQSSSDSYDTNVP VHVWTGDSCGSSCDSSCSSTS CD | 113 | Hypothetical protein RB32ORF026c [Enterobacteria phage RB32] | YP_802968.1 | 1e-58 (112/113) | | No putative conserved domains have been detected |
| 162 | 91047 | 91532 | 385 | MEAILFEMYISSNSMSFAKDVPIT VAVMIDKGYCDPMYLVENFVSM PVPEDAEIKLKKIGIIETVPNIPFR AIEAFTKSEYINVSAEQYNDKPIS FYSYDSVYSWKIDKGNKFIIVSED ALSYFISSIWNSLHPNLLKIHEFD DAPTVVLGKTNESSEENV | 161 | Mrh [Enterobacteria phage RB32] | YP_802967.1 | 2e-86 (157/161) | affects phosphorylati on of host sigma32 | No putative conserved domains have been detected |
| 163 | 91507 | 91710 | 386 | MKVLKMFEWFSRPNSMYIDDG WVEQANKEMQNESEEWMKSMI SVEKEKKLERSALKLMRDIYGDK S | 67 | Postulated decoy of host sigma32 [Enterobacteria phage RB32] | YP_802965.1 | 2e-29 (65/67) | postulated decoy of host sigma32 | No putative conserved domains have been detected |
| 164 | 91707 | 91871 | 387 | VNRDMTLEEAKAKANEALDLLLK IGSKMMEENEKYIQENKIPDGPL VGKRKSHD | 54 | ModA.4 hypothetical protein [Enterobacteria phage T4] | NP_049639.1 | 1e-21 (51/54) | | No putative conserved domains have been detected |
| 165 | 91864 | 92346 | 388 | MIEVAKHYSIEFMSKEGKSVNTL DKKCSLIIPLAENPDILIKDIKERKY PENVILIIKHTEDILQNTDSPFSSS EALTIKGYKRAHEYGLFDLFEDD KVKLALNLAGQSSKSKTFIIEDIK DINAFVKMVWAHFDVGLRWRMS EEERKIIEANRYFGFYR | 160 | ModA.3 hypothetical protein [Enterobacteria phage RB51] | YP_0028539 79.1 | 7e-86 (156/160) | | No putative conserved domains have been detected |
| 166 | 92355 | 92537 | 389 | MDLFEMLEDNHSTNIQNDSSDY | 60 | ModA.2 | YP_0028539 | 2e-27 | | No putative conserved domains have been detected |

Fig. 6EE

| | | | | | | | | | | |
|---|---|---|---|---|---|---|---|---|---|---|
| 167 | 92605 | | KKEYRIVLQNYGIEAPDALLEELA SYHLDPPPWAPWAK | | | 78.1 | (60/60) | | | have been detected |
| | | 390 | MIINLADVEQLSIKAESVDFQVDM YKKVCEKFTDFEQSVLWQCMEA KKNKALHRQLNKIIKKHLTKSPYQ LYRGISKSTKELIKDLQVGEVFST NRVDSFTTSLHTACGFSYVEYFT EIIFRLKTDKAFNYSDHISDIILSSP NTEFKYTYEDTDGLDSERTDNL MMIVREQEWMIPIGKYKITSISKE KLHDSFGTFKVYDIEVVE | hypothetical protein [Enterobacteria phage RB51] | YP_0028543 56.1 | 207 | 2e-117 (205/207) | adenyl- ribosylating enzyme | No putative conserved domains have been detected |
| 168 | 93827 | | MKYSAMQLKDFKIKSMDASVRA SIREELLSEGFNLSEIELLIHCITN KPDDHSWLNEIIKSRLVPNDKPL WRGVPVETKQVLNQGIDIITFDK VVSASYDKNVELHFASGLEYNT QVIFEFKAPMVFNFQEYAIKALR CKEYSPSFKFPDSHRYRNMELV SDEQEVMIPAGSVFRIADRYEYK KHSTYTIYTLDFEGFNL | Adenylribosylating enzyme [Enterobacteria phage RB51] | YP_0028539 76.1 | 200 | 3e-112 (194/200) | adenyl- ribosylating enzyme | No putative conserved domains have been detected |
| | | 391 | | | | | | | | |
| 169 | 93225 | | MKLSKNQIRKITRRLEHTQASAK RRSKDFNLDFNYIKNILDQKVCA YSGEPFDNRIEGEKLSLERFDNN VGYIKGNVIAVKKKYNTFRSDYTL EELIEKRDLFALRIGRSSAKKVHK LNLDEKKWAKIKKTYNQIKAIQKK RENRIEHISQLSKSKQTSDVKLTII ALKARIDGSRIAEGAEVVKLNVLL KGSDWKTVKKLSEAEMQYDMC DKIIQGVERYQNLSFIDKLKLLKRG YPLNCSIFKLIRG | Postulated decoy of host sigma70 or sigmaS [Enterobacteria phage RB32] | YP_802959.1 | 248 | 9e-137 (243/248) | postulated decoy of host sigma70 or sigmaS | No putative conserved domains have been detected |
| | | 392 | | | | | | | | |
| 170 | 93943 | | MFYYAIVYRDKDGFAVPVPLDE HRPAVFFEREIADKVFTTLKEQY QLALGMGIPRLVETPRKFWFNKI EVKHVKPDVDTQRLYRRILDTGR IVSIPIAGNLR | Hypothetical protein RB32ORF016c [Enterobacteria phage RB32] | YP_802958.1 | 103 | 5e-49 (96/103) | | No putative conserved domains have been detected |
| | 94691 | | | | | | | | | |
| | | 393 | | | | | | | | |
| 171 | 94999 | | MTFDDLTEGQKNAFNIVMRAIKE KKHHVTINGPAGTGKTTLTKFIIE ALISTGETGIILAAPTHAAKKILSK LSGKEASTIHSILKINPVTYEENVL FEQKEVPDLAKCRVLICDEVSMY DRKLFKILLSTIPPWCTIIGIGDNK QIRPVDPGENTAYISPFFTHKDF YQCELTEVKRSNAPIIDVATDVR NGKWIYDKVVDGHGVRGFTGDT | DNA helicase [Enterobacteria phage RB14] | YP_0028543 52.1 | 439 | 0.0 (438/439) | DNA helicase | RecD_rel, recD/Tra A family | TIGR0144 8 | 3e-24 |
| | 96318 | | | | | | | | | |
| | | 394 | | | | | | | | |

Fig. 6FF

| | | | | | | | | |
|---|---|---|---|---|---|---|---|---|
| 172 | 96325 | 96585 | ALRDFMVNYFSIVKSLDDLFENR VMAFTNKSVDKLNSIIRKKIFETD KDFIVGEIIVMQEPLIKTYKIDGKP VSEIIFNNGQLVRIIEAEYTSTFVK ARGVPGEYLIRHWDLTVETYGD DEYYREKIKIISSDEEELYKFNLFLG KTAETYKNWNKGGKAPWSDFW DAKSQFSKVKALPASTFHKAQG MSVDRAFIYTPCIHYADAELAQQ LLYVGVTRGRYDVFYV | 395 | | | | |
| 173 | 96572 | 96817 | MININSKYLNRLIDGIRKHTNKQD NLDVMVTGAELLHKLYLISDTILAI KRIEKQSYHSNTDTVITLDESVCK LLIKFEEAIRGNN | 86 | Hypothetical protein RB51ORF017 [Enterobacteria phage RB51] | YP_0028539 72.1 | 7e-42 (86/86) | | No putative conserved domains have been detected |
| 174 | 96810 | 97052 | VEITKDQFYLLQDKVSEIYEIAYS KNRETVKIESSKLMLQLEEIERDL IALEFFCGEVKTVTISDYVLGEISY LYKAIIND | 81 | DexA.2 hypothetical protein [Enterobacteria phage RB14] | YP_0028543 50.1 | 2e-36 (77/81) | | No putative conserved domains have been detected |
| 175 | 97052 | 97735 | MIELSWCQFKSLMTNVKAVIEKN SGPENITIREKALKIIYSLEEMQKD IESMAKFIDEPINKVYIQDYTVGQI RDLARKI | 80 | Hypothetical protein RB32ORF013c [Enterobacteria phage RB32] | YP_802955.1 | 5e-39 (80/80) | | No putative conserved domains have been detected |
| 176 | 97799 | 98299 | MFDFIIDFETMGSSGEKAAVIDLAV IAFDPNPEVVETFDELVSRGIKIK FDLKSQKGHRLFTKSTIEWWKN QSPEARKNIAPSDEDVSTIDGIAK FNDYINAHNIDPWKSQGWCRGM SFDFPILVDLIRDIQRLNGVSENE LDTFKLEPCKFWNQRDIRTRIEA LLLVRDMTTCPLPKGTLDGFVAH DSIHDCAKDILMMKYALRYAMGL EDAPSEEDCDPLSLPTKR | 227 | DexA exonuclease A [Enterobacteria phage T4] | NP_049629.1 | 1e-130 (226/227) | DexA exonuclease A | DEDDh exonucle ases, part of the DnaQ-like (or DEDD) exonucle ase superfami ly | cd06127 | 0,001 |
| 177 | 98302 | 98847 | MKIYRVESSFSILDYEDAITIRRNL CVQITPYRSIIDDSWSEEWLLHVG YDRPNFMHHSDNNKRIPLPHED KLLVKNANIVINTKFKKDYVGVEY HIPGWFIALYHFAFASEYDMMR WFTREEREELASKGFYLAVYEV PDDQVIVGGHQVMFRKSHAELV DFIEMR | 166 | Hypothetical protein RB32ORF011c [Enterobacteria phage RB32] | YP_802953.1 | 4e-93 (163/166) | | No putative conserved domains have been detected |
| | 98302 | | MKFNYNPEYTPNPAAKLIDFDVV STYVCPVKPLEIKEPTMTTAIEIG KTYKLVEPKIKTNALISGHKTLTD VFGEGEFIVEEFAKSEWFDKSYV IHGRRLDNNKIKKNLVYEDEFILF | 181 | MotB.1 hypothetical protein [Enterobacteria phage JS10] | YP_0029223 58.1 | 8e-94 (168/182) | | No putative conserved domains have been detected |

Fig. 6GG

| | | | | | | | | |
|---|---|---|---|---|---|---|---|---|
| | | | QEVEEQDPTDLLCAAVSIRRPFD NPICGWVTDQWIEDGVELLNVV HAGDFSVVPRSAVVAILN | | | | | |
| 178 | 98924 | 99412 | 401 | MIINIGEIARVSDKSRSKAAGKLV EVVSIQLKHGVKDEDSEVKVRIIA KDGMSKPQFGYVRWKFLEPAFL KAVPAKGIETIDTSHVGVDFKWK LGQAIKFIAPCEFKFIKDDGKAVY TRAMCGYITDQWVEDGVKLYNV VFLGTYKVIPESWIKHYSNALYA | 162 | MotB modifier of transcription [Enterobacteria phage T4] | NP_049626. 1 | 2e-84 (154/162) | MotB modifier of transcription | No putative conserved domains have been detected |
| 179 | 99587 | 99802 | 402 | MKRKIVQNCTNDEFEDVLFDPDL VVVQKEHTIKFTHLTSVYYEKV GDKQPIYGVFREITEDGTTYWKE IY | 71 | Modifier of suppressor T4 tRNAs [Enterobacteria phage RB14] | YP_0028543 44.1 | 5e-34 (71/71) | modifier of suppressor T4 tRNAs | No putative conserved domains have been detected |
| 180 | 99802 | 100215 | 403 | MAIKFEVNKWYQFKNKQAQENFI KDHTDNGIYARRLGMHPFKILDV DALGRPIKIMSFAGNLVLSSGKDI LDEDFIWLSSNEAEFFNEVENPY QAAEEQEESAPITDQSKFPVMKV TIENDEQAWSLYQMLKAHFKE | 137 | RNA metabolism moderator [Enterobacteria phage RB32] | YP_802949.1 | 7e-61 (112/137) | RNA metabolism moderator | No putative conserved domains have been detected |
| 181 | 100218 | 100394 | 404 | MPLYDYKCQSKDCAKEYEKIKKI SERDTDVCPDCHRIAIRLVSAPK HVNGGFYDLLKG | 58 | Hypothetical protein RB32ORF006c [Enterobacteria phage RB32] | YP_802948.1 | 2e-26 (58/58) | | No putative conserved domains have been detected |
| 182 | 100397 | 100768 | 405 | MFKIGKKYRIREGEEKKYLFSAIY RNGSINAVISTSEFIVEDMKGNN VTMISTASGNDGKILHSFQSNVLI YDEEFDFFEEVPEGFAFECTITM KSGDPLSFTVKDEGSRLRIISLLQ AIKFK | 123 | Hypothetical protein RB32ORF005c [Enterobacteria phage RB32] | YP_802947.1 | 2e-58 (114/123) | | No putative conserved domains have been detected |
| 183 | 100774 | 101034 | 406 | MKYINRSIAALVLAVSLVGCTDAD NATKVLSSSGFTNIEITGYNWFG CSENDFQHTGFRAIGPTGQKVE GTVCSGLFFKDSTIRFK | 86 | Gp39.1 hypothetical protein [Enterobacteria phage RB14] | YP_0028543 40.1 | 2e-43 (85/86) | | No putative conserved domains have been detected |
| 184 | 101104 | 102921 | 407 | MIKNEIKILSDIEHIKKKRSGMYIGS SANEMHERFLFGKWESVQYYPG LVKLIDEIIDNSVDEGIRTKFKFAN KINVTIKNNQVTVEDNGRGIPQA MVKTPTGEEIPGPVAAWTIPKAG GNFGDDKERVTGGMNGVGSSL TNIFSVMFVGETGDGQNNIVRC SNGMENKSWETIPGKWKGTRVT FIPDFMSFETNELSQVYLDITLDR LQTLAVVYPDIQFTFNGKKVQGN | 605 | Gp60plus39 DNA topoisomerase subunit [Enterobacteria phage RB51] | YP_0028539 58.1 | 0,0 (603/605) | DNA topoisomeras e subunit | GyrB, type IIA topoisom erase (DNA gyrase/to po II, topoisom erase IV), B subunit | COG0187 | 8e-81 |

Fig. 6HH

| | | | | | | | | | |
|---|---|---|---|---|---|---|---|---|---|
| 185 | 102976 | 103179 | 408 | FKKYARQYDEHAIVQEQENCSIA VGRSPDGFRQLTYVNNIHTKNG GHHIDCVMDDICEDLIPQIKRKFK IDVTKARVKECLTIVMFVRDMKN MRFDSQTKERLTSPFGEIRSHIQ LDAKKISRAILNNEAILMPIIEAALA RKLAAEKAAETKAAKKASKAKVH KHIKANLCGKDADTTLFLTEGDS AIGYLIDVRNKELHGGYPLRGKV LNSWGMSYADMLKNKELFDICAI TGLVLGEKAENLNYHNIAIMTDA DHDGLGSIYPSLLGFFSNWPELF EQGRIRFVKTPVIIAQVGKKQEW FYTVAEYESAKDALPKHSIRYIKG LGSLEKSEYREMIQNPVYDVVKL PENWKELFEMLMGDNADLRKE WMSQ MKSYKVNLELFDKAVHREYRIIQ RFFDMGEAEEFKNRFKDIRDKIQ SDTATKDELLEVAEVIKRNMN | 67 | Hypothetical protein RB32ORF002c [Enterobacteria phage RB32] | YP_802944.1 | 1e-30 (67/67) | | TOPRIM_TopoIIA_li ke: topoisom erase-primase (TOPRIM ) nucleotidy l transferas e/hydrola se domain | cd01030 | 8e-24 |
| 186 | 103190 | 105367 | 409 | MIITTEKETILGNGSKSKAFSITAS PKVFKILSSDLYTNKIRAVVRELIT NMIDAHALNGNPEKFIQVPGRL DPRFVCRDFGPGMSDFDIQGDD NSPGLYNSYFSSSKAESNDFIGG FGLGSKSPFSYTDTFSITSYHKG EIRGYVAYMDGDGPQIKPTFVKE MGPDDKTGIEIVVPVEEKDFRNF AYEVSYIMRPFKDLAIINGLDREI DYFPDFDYYGINPERYWPDRG GLYAIYGGIVYPIDGVIKDRNWLS IRNEVNYIKFPMGSLDIAPSREAL | 725 | Membrane-associated affects host membrane ATPase [Enterobacteria phage RB32] | YP_802943.1 | 0,0 (717/725) | membrane-associated affects host membrane ATPase | HtpG, molecular chaperon e, HSP90 family [postrans lational modificali on, protein turnover, chaperon | COG0326 | 6e-05 |

Fig. 6II

| | | | | | | | |
|---|---|---|---|---|---|---|---|
| 187 | 105379 | | SLDDRTRKNIIERVKELSEKAFNE DVKRFKESTSPRHTYRELMKMG YSARDYMISNSVKFTTKNLSYKK MQSMFEPDNKLCNAGVVYEVNL DPRLKRIKQSHETSAVASSYRLF GINTTKINIVIDNIKNRVNIVRGLA RALDDSEFNNTLNIHHNERLLFIN PEVESQIDLLPDIMAMFESDEVNI HYLSEIEALVKSYIPKVVKSKAPR PKAATAFKFEIKDGRWEKEELFT LTSEADEITGYVAYMHRSDIFSM DGTTSLCHPSMNILIRMANLIGIN EFYVIRPLLQKKVKELGQCQCIFE TLRDLYVDAFDDVDYKYVGYS SSAKRYIDKIIKYPELDFMMKYFS VDEVSEEYTRLANMVSSLQGVY FNGGKDTIGHDIWTVTNLFDELS RNASKNSDKMVAEFTKKKFRIVSD FIGYRNSLSDDEVSQIAKTMKAL AA | | | | |
| | | | | | | | |
| | 106317 | 410 | MYNIKCLTKNEQAEIVKLYSSGN YTQQELADWQGVSVDTIRRVLK NAEEAERSKVTISGDITVKVNSD AVIAPVAKSDIIWNASKKFISITVD GVTYNATPNTHSNFQEILNLLVA DKLEEAAQKINVRRAVEKYISGD VRIEGGSLFYQNIELRSGLVDRIL DSMEKGENFEFYFPFLENLLENP SQKAVSRLFDFLVANDIEITEDGY FYAWKVVRSNYFDCHSNTFDNS PGKVVKMPRTRVNDDDTQTCSR GLHVCSKSYIRHFGSSTSRVVKV KVHPRDVVSIPIDYNDAKMRTCQ YEVVEDVTEQFK | 312 | Protector from prophage-induced early lysis rIIB [Enterobacteria phage T4] | NP_049889.1 | 0.0 (310/312) | rIIB protector from prophage-induced early lysis | |
| 188 | 106346 | 411 | MLGYQARVKEEYDQLMLKINALS NFLESTKFLTVSAVEQELLLSQFI SMKSYADCLEKRIAQFK | 64 | Hypothetical protein RB32ORF269c [Enterobacteria phage RB32] | YP_803211.1 | 3e-27 (62/64) | | No putative conserved domains have been detected |
| 189 | 106604 | 412 | MQKTNPGLQRLFQIPSFTLSNSD LTSEMKVKIADTARYSLKQNPNQ DKAEVIERCRIAVYAEFFVADWL RGYVNKGQEDVNDPYTYAWDV LAHPKYCGLRVEVKTHQTDSRW ISVTTGCSGEYPYGSGINLGPILN HQVADCIIFNTKEIHPGVIQYTPK FIGDREDLRKVVRKSNYNGWYL SI | 185 | Endonuclease IV [Enterobacteria phage RB14] | YP_0028546 07 | 4e-106 (183/185) | endonuclease IV | |
| | 107161 | | | | | | | No putative conserved domains have been detected |

Fig. 6J

| | | | | | | | |
|---|---|---|---|---|---|---|---|
| 190 | 107235 | 413 | MKFKFYYAKHHKITGEFIAFTTSTT DEGDIFTAVFLSKWESDQPYLSS REDLQRLVNGEYNDSWSYLVHD CVKKAIKQKHLEIEIEL | 87 | Hypothetical protein RB51ORF272 [Enterobacteria phage RB51] | YP_0028542 25.1 | 9e-22 (49/87) | | No putative conserved domains have been detected |
| 191 | 107578 | 414 | MKILNSVLIACAWWVAQVSAVVV GIHIYYEYF | 32 | Ndd.5 hypothetical predicted outer membrane protein [Enterobacteria phage T4] | NP_049885. 1 | 2e-09 (32/32) | | No putative conserved domains have been detected |
| 192 | 107742 | 415 | MKKIVKAIWNVVIILIVLSIFPIVLMI DVLNAYFGFM | 37 | Ndd.4 hypothetical protein [Enterobacteria phage RB14] | YP_0028546 03.1 | 1e-10 (37/37) | | No putative conserved domains have been detected |
| 193 | 107863 | 416 | MKRKRSAFTFIEWFFDNIFFPALFI FMLIFALGSVVVGIYLMTVVGIDIH QNGLKSVVETIWNGVK | 65 | Ndd.2a hypothetical protein [Enterobacteria phage RB51] | YP_0028542 22.1 | 3e-29 (65/65) | | No putative conserved domains have been detected |
| 194 | 108057 | 417 | MMNLLSGWFYILMFYIGANFPY WMGWSTTAFGFYTP | 36 | Hypothetical protein RB32ORF262c [Enterobacteria phage RB32] | YP_803204.1 | 6e-12 (36/36) | | No putative conserved domains have been detected |
| 195 | 108176 | 418 | MKIFKDVKVGEIFCLDNGDQLIRI SPLKSTSEKPTVNATLANNSNER FCIENDTETYTVEEFWELSVDCD D | 71 | Ndd.1 hypothetical protein [Enterobacteria phage RB14] | YP_0028546 00.1 | 4e-33 (70/71) | | No putative conserved domains have been detected |
| 196 | 108452 | 419 | MKYMTVTDLNNAGATVIGTIKNG EWFLGVPHKDILSKPGFYFLVSK LDGRPFSNPCVSARFYVGNQRS KQGFSAVLSHIRQRRSQLARTIA NNNVPYTVFYLPASKMKPLTTGF GKGQLALAFIRNHHSEYQTLEEM NRMLADNFKFVLQAY | 152 | Disrupts host nucleoid [Enterobacteria phage RB32] | YP_803202.1 | 3e-84 (149/152) | nucleoid disruption protein | No putative conserved domains have been detected |
| 197 | 108998 | 420 | MNIAKLLGVISFICWIVACVLTICID VSSVFSQALAQGMCAYLTFVLLS TND | 52 | Acridine resistance protein [Enterobacteria phage RB14] | YP_0028545 97.1 | 3e-20 (51/52) | acridine resistance protein | No putative conserved domains have been detected |
| 198 | 109294 | 421 | MQLNNRDLKSIIDNEALAYAMYT VENRAIPNMIDGFKPVQRFVIAR ALDLARGNKDKFHKLASIAGGVA DLGYHHGENSAQDAGALMANT WNNNFPLLDGQGNFGSRTVQK AAASRYIFARVSKNFYNVYKDTE YAPVHQDKEHIPPAFYLPIIPTVLL NGVSGIATGYATYILPHSVSSVK | 442 | Gp52 DNA topoisomerase subunit [Enterobacteria phage RB51] | YP_0028542 15.1 | 0,0 (442/442) | DNA topoisomeras e subunit | No putative conserved domains have been detected |

Fig. 6KK

| | | | | | | | | | |
|---|---|---|---|---|---|---|---|---|---|
| 199 | 110619 | | KAVLQALQGKKVTKPKVEFPEFR GEVVEIDGQYEIRGTYKFTSRTQ MHITEIPYKYDRETYVSKILDPLE DKGFITWDDACGEHGFGFKVKF RKEYSLSDNEEERHAKIMKDFGL IERRSQNITVINEKGKLQVYDNVV DLIKDFVEVRKTYVQKRIDNKIKE. TESAFRLAFAKAHFIKKVISGEIVV QGKTRKELTEELSKIDMYSSYYD KLVGMNIFHMTSDEAKHLAEEAK AKKEENEYWKTTDVVTEYTKDL EEIK | | | | | | |
| | 110768 | 422 | MSPFIGTSAALVSGGILLAGLGV VPAVAGGLLAFGIQRVIMTVITVM Q | 49 | MotA.1 hypothetical predicted periplasmic protein [Enterobacteria phage T4] | NP_049874. 1 | 4e-16 (48/49) | | No putative conserved domains have been detected |
| 200 | 110903 | 423 | MKFKIENEIVKAKNALTANKLVVD GIEYDICGVREEKPGVLTFFTMIF KFKGDTEFKQFDFAHEDEIEVRN LNIK | 75 | Hypothetical protein EpJS10_0253 [Enterobacteria phage JS10] | YP_0029226 02.1 | 5e-34 (74/75) | | No putative conserved domains have been detected |
| 201 | 111236 | 424 | MSKVTYIIKASNDVLNEKTAAILITI AKKDFIT.AAEVREVHPDLGNAVV NSNIGVLIKKGLVEKSGDGLIITG EAQDIISNAATLYAQENAPELLKK RATRKAREITSDMEEEDKDLMLKL LDENGFVLKKVETYRSNYLAILEK RTHGIRNFEINNNGNMRIFGYKM MEHHQKFTDIGMSCKIAKNGNV YLDIKRSAENIEAVITVASEL | 211 | Activator middle promoter | YP_803196.1 | 7e-117 (210/211) | activator middle promoter | Transcript ion factor MotA, activation domain | pfam0911 4 | 5e-34 |
| 202 | 111882 | 425 | MNKLEIVNELRRCVEPTQEGWDI WYHGAYLGTIVKIKTGKYMIIRES KDAPVGIRNNFMAAISSFTDAAY EIYLADYKEFQESQPVIRSIGVNK AQQKTLWQRIKGWFK | 109 | Arn.4 hypothetical protein [Enterobacteria phage RB14] | YP_0028545 92.1 | 8e-58 (107/109) | | No putative conserved domains have been detected |
| 203 | 112208 | 426 | MNPFINRLKMLNVPLSRETPESL VEKFKAHGYKCTEEDILKEVPEIC WQTAYWDENQKYQRRIVCAAN RFKLKDGRTLIIPGARHYSKDMA EVLDVVKPQLVTQQVCDDDQGF IDQYSNYWTREEAMIIATYAGQV RIERGGSEKELYSEDLY | 153 | Arn.3 conserved hypothetical protein [Enterobacteria phage T4] | NP_049871. 1 | 4e-84 (151/153) | | No putative conserved domains have been detected |
| 204 | 112669 | 427 | MNIKKFQIDGITNQIIKALEYANKM MSTNWGIYANEPAFKFCDMEFT KKLVGKDHVCPFSSPVNGMLKP ALRDLYIAMNEEMIKELKRQLKVI | 98 | Arn.2 hypothetical protein [Enterobacteria | YP_0028542 10.1 | 8e-50 (95/98) | | No putative conserved domains have been detected |

Fig. 6LL

| | | | QFGQGN | | phage RB51] | | | | |
|---|---|---|---|---|---|---|---|---|---|
| 205 | 112949 | 428 | LAREINSKSDYFNSLNDKDKNLIR HFIVEMGYTDTHDLREHIFECGV AKKFSFTCKCLREVIQHYEQFSR KT | 72 | Arn.1 conserved hypothetical protein [Enterobacteria phage RB69] | NP_861950. 1 | 1e-22 (52/72) | | No putative conserved domains have been detected |
| 206 | 113251 | 429 | MIIDSQSVVQYTIKIDILEKLYKFL PNLYHSIVNELVEELHLGNNDFLI GTYKDLSKAGYFYIIPAPGKSIDD VLKTIMIYVHDYEIEDYFE | 92 | Inhibitor of MrcBC restriction nuclease [Enterobacteria phage RB51] | YP_0028542 08.1 | 8e-44 (90/92) | inhibitor of MrcBC restriction nuclease | No putative conserved domains have been detected |
| 207 | 113526 | 430 | MSHNLEKVIEHNVAQERKSFKEF VEKIFEENTTDQFTNQASDDIITK STN | 50 | AsiA.1 hypothetical protein [Enterobacteria phage T4] | NP_049867. 1 | 9e-19 (48/50) | | No putative conserved domains have been detected |
| 208 | 113691 | 431 | MNKNIDTVREIITVASILKFSREDI VENRANFIAFLNEIGVTHEGRKL NQNSFRKIVSELTQEDKKTLIDEF NEGFEGVYRYLEMYTNK | 90 | AsiA anti-sigma 70 protein [Enterobacteria phage T4] | NP_049866. 1 | 5e-44 (90/90) | AsiA anti-sigma 70 protein | AsiA, anti-sigma factor A | pfam0901 0 | 3e-30 |
| 209 | 114620 | 432 | MAAPRISFSPSDILFGVLDRLFKD NATGKVLASRVAVVILLFMMAIV WYRGDSFFEYYKQSKYETYSEII EKERNARFESVALEQLQIWHISSE ADFSAVYSFRPKNLNYFVDIIAYE GKLPSTISEKSLGGYPVDKTMDE YTVHLNGRHYYSDSKFAFLPTKK PTPEINYMYSCPYFNLDNIYAGTI TMWYYRNDHISNDRLESICAQAA RILGRAK | 218 | Holin [Enterobacteria phage RB32] | YP_803187.1 | 7e-125 (216/218) | holin | No putative conserved domains have been detected |
| 210 | 115433 | 433 | MAVVGVPGWIGSSAANETGQR WMSQAAGQLRLGVPCWMSQFA GRSREIIHTVGANHNFNGQWFR DRCFEAGGAPIVFNIVGDIVSYSK DVPLFFMYGDTPNEVVQLNIHGV TMYGRGGNGGSNSPGSAGGHC IQNDIGGRLRINNGGAIAGGGGG GGGGYYSPFSQMRLTFGGGGG RPFGAPGGSIDMQSGATGGTIS APGSGSVNGIYNGNGGEVGSA GGRCNIRGQGSEYNGAAGYA VIGSAPTWQNVGAIYGPRV | 260 | Tail fiber protein [Enterobacteria phage KEP10] | BAF95751.1 | 2e-107 (254/260) | tail fiber protein | Phage tail fibre adhesin Gp38 | pfam0526 8 | 2e-76 |
| 211 | 118418 | 434 | MATLKQIQFKRSKTAGQRPAASV LAEGELAINLKDKTIFTKDDSGSV IELGLKYGGTINGSLEVTENITGT LIGNSSTATKLQTPRKINGISFDG SKDITLTPSDINVNSTTFIKNNGE LPTDANLDTYGPIEEYLGVWSKS | 982 | Tail fiber protein [Enterobacteria phage KEP10] | BAF95750.1 | 0.0 (921/982) | tail fiber protein | No putative conserved domains have been detected |

Fig. 6MM

| 212 | 119077 | 118427 | 435 | TSTNAQPANKFPEENAVGVLEVF VAGQFAGTQRYTVRSGNVYIRS LSAKWNGVDGPWGVWRNVQAS TRPLSQTIDLDSLGELEHCGLWR NSSSAIASFDRHYPEEGSAAQGF LEIFEGGLYTRTQRYTTRMGMVY TRCLAAAWDASAPKWEEWKQV GHGTPATFYDGDLNDFKTPGLY NILGTDAVINCPTGEGLPTVIVGL LEVKQRASGGAIFQRFTTAGTGA TTRDRIFERAYTGGAWGAWNEV YTSYSLPITLGMGGIKAQLAELD WQTFDFVPGSMFSVPLNKIKNM PANMDWGTIDGNLVMFSVGPSE HTGTGRTVQVWRGTVSQANYR YFVVRIAGNPGSRTNTCRRVVLE DGSHTWTAQQNFRGLLNITAAV NLGANQKISLAPGAYIQAPASGS GSNTYANQNTTIAPLYQAIDDSN KNQFAPIVKQKNTVTNITMASGM DIASSEYRIVAQGDLSATGTTATE LATWRFLPSGRFMSQSRVYAGA AFLNTDGNIAGSIWKKYNDATNL DAALNTRLGKGGDTMTGRLTINA PNDSIVLSTTASNSLHIRGDIDGT GNWYIGKGGADNSLAFEYSYASQ AAVHITNNGEIALNPQNTAMVNV NRDRVHINGSGWIARQPGDWG NQWRVEAPLFVDHGYVGQDSY YPILKARSVITNQGYSTAVDFGM RRIPSQWGQAIIRVGSTEASPDA GHPQAVFEFHHDGFFYTPGNGS FSDVYIRSDSRLKINKEELEYGAV EKVCRLKVYIYDKVKSIKDRSVIK REVGIIAQDLEKELPEAVSKVEVD GSDVLTISNSAVNALLIKAIQEMS EEIKELKTPLFTKIARKISKYFKF | | | | |
|---|---|---|---|---|---|---|---|---|
| | | 216 | MADLKVGSTVGGSVIWHQGNFP LNSAGDDVLYKSFKIYSEYNKPQ AADNDFVSKANGGTYAGPTINY GVNSYLQLSNNETPIRIRSGGGT GNTLVVGGSSGGISFRPAGSEIT TGQITITPEGLTTFTRAVTAPSVT VTSTPSAASDVTRKDYVDGAINT VTANANSRVLRSGDTMTGNLTA PNLFSQNPASQPSHVPRFDQIVI KDSVQDFGYY | YP_803184.1 | Hinge connector long tail fiber [Enterobacteria phage RB32] | 4e-120 (216/216) | hinge connector long tail fiber | Phage T4 tail fibre | pfam03903 | 4e-83 |

Fig. 6NN

| 213 | 120255 | 119140 | 436 | MEKFMAEFGQGYVQTPFLSESN SVRYKISIAGSCPLSTAGPYVKF QDNPVGNQTFSAGLHLRVFDPS TGALVDSKSYAFSASNNTTSAAF VSFMNSLSNNRLVAILTSGKVNF PPEVVSWLRGAGTSVFPSDSVL SRFDVSYAAFYTSSKRAIALEHV KLSNRKSTDDYQTILDVVFDSLE DVGATGFFPKRTYESVEQFMSAV GGTNNEIARLPTSAAISKLSDYNL IPGDVLYLKAQLYADADLLDLGTT NISIRFYDASNGYISSTQAEFTGQ AGSWELKEDYVVPENAVGFTIY AQRTAQAGQGGMRNLSFSEVS RNGGISKPAEFGVNGIRVNYVCE SASPPDIMVLPTQASSKTGKVFG QEFREV | 371 | Tail fiber hinge [Enterobacteria phage RB32] | YP_803183.1 | 0,0 (365/371) | tail fiber hinge | No putative conserved domains have been detected |
| 214 | 124133 | 120264 | 437 | MAEIKRKFRAEDGLDAGGDKIIN VALADRTVGTDGVNVDYLIQENT VQQYDPTRGYLKDFVIIYNNRFW AATDNIPKPAGNFNRIRWKALRT DAVYTTVSSGPYQLKSGEAISVD TSVGNDIEFTLPPSPLDGETVIIQ DIGGKPGINQVKINSSNQSIVNFR GEQVRSVLMTHPKSQMIFIFNNR LWQMYVADYSREAAIVTPSTAY QAQSNDFIVRRFTSAAPINVKLP RFANHGDIINFVDLDKLNPLYHTI VTTYDETTSVQEVGTHSIEGRTSI DGFLMFDDNEKLWRLFDGDSKA RLRIITNSNIRPNEEVMVFGANN GTTQTIELQLPTDISVGDTVKISM NYMRKGQTVKIKAAGEDKIASSV QLLQFPKRSEYPPEAEWVTVQE LVFNGETNYVPYLQLAYIEDSDG KYWVVQQNVPTVERVDSLNAST RARLGVIALATQAQANADLENSP QKELAITPETLANRTATETRRGIA RIATTAQVNQNTTFSFADDLIITP KKLNERTATETRRGVAEIATQQE TNTGTDDTTIITPKKLQARQGSE SLSGIVTFVSTAGATPASSRELN GTNVYNKNTNNLVVSPKALDQY KATPTQQGAVILAVESEVIAGQS QEGWANAVVTPETLHKKTSTDG RIGLIEIATQSEVNTGTDYTRAVT PKTLNDRRATESLSGIAEIATQVE FDAGVDDTRISTPLKIKTRFNSTD | 1289 | Gp34 proximal tail fiber subunit [Enterobacteria phage RB14] | YP_0028545 78.1 | 0,0 (1280/1289) | proximal tail fiber subunit | No putative conserved domains have been detected |

Fig. 600

| | | | | | | | | |
|---|---|---|---|---|---|---|---|---|
| | 124238 | | RTSVVALSGLVESGTLWDHYTL NILEANETQRGTLRVATQVEAAA GTLDNVLITPKKLLGTKSTESQE GVIKVATQSETVTGTSANTAVSP KNLKWIWQSEPTWAATTLIRGFV KTSSGSLTFVGNDTVGSTQPLES YEKNGYAVSPYELNRVLANYLPL KAKAVDSNLLDGLDSLQFIRRDIA QTVNGSLTLTQQTNLGAPLVSSS TATFGGSVSANSTLTISNTGTAT RLIFEKGPQTGTNPAQTMTVRV WGNQFSGESDTTRSTVFEVSDE TSSHFYSQRNKAGNTFNINGTV TPINVNASGTLNANGVATFGNSV TATGEIISRSANAFRAINGNYGFI VRNDGSVTNFMLTASGDQTGGF NGLRPLAINNASGQVTIGESLIIAK GATINSGGLTVNSRIRSQGTKTS DLYTRAPTSDTVGFWSIDINDSA TYNQFPGYFKMVEKTNEVTGLP YLERGEEVKSPGTLTQFGNTLDS LYQDWITYPTTPEARTTRWTRT WQKTKNSWSSFVQVFDGGNPP QPSDIGAIPSDNGIIGNLTIRDFLR IGNVRIIPDPVNKTVKFEWVE | | | | | | |
| 215 | 125155 | 438 | MDLEMMLDEDYKEGICFIDFSQI ALSTALVNFPDKEKINLSMVRHLI LNSIKFNVKKAKTLGYTKIVLCIDN AKSGYWRRDFAYYYKKNRGKA REESTWDWEGYFESSHKVIDEL KAYMPYIVMDIDKYEADDHIAVLV KKFSLEGHKILIISSDGDFTQLHK YPNVKQWSPMHKKWVKIKSGSA EIDCMTKILKGDKKDNVASVKVR SDFWFTRVEGERTPSMKTSIVEA IANDREQAKVLLTESEYNRYKEN LVLIDFDYIPDNIASNIVNYNSYK LPPRGKIYSYFVKAGLSKLTNSIN EF | 305 | RNaseH [Enterobacteria phage RB32] | YP_803181.1 | 4e-178 (305/305) | ribonuclease H | RNaseH_ C, T4 RNase H, C terminal | pfam0929 3 | 9e-40 |
| 216 | 125433 | 439 | MAKKEMVEFDEAIHGEDLAKFIK EASDHKLKISGYNELIKDIRIRAKD ELGVDGKMFNRLLALYHKDNRD VFEAETEEVVELYDTVFSK | 89 | DsbA dsDNA binding protein, late transcription [Enterobacteria phage T4] | NP_049858. 1 | 5e-43 (89/89) | dsDNA binding protein | No putative conserved domains have been detected | | |
| 217 | 125411 | 440 | MTQFSLNDIRPVDETGLSEKELSI KKEKDEIAKLLDRQENGFIIEKMV EEFGMSYLEATTAFLEENSIPET | 112 | Gp33 late promoter transcription accessory protein | NP_049857. 1 | 4e-57 (112/112) | late promoter transcription accessory | No putative conserved domains have been detected | | |

Fig. 6PP

| | | | | | | | | | |
|---|---|---|---|---|---|---|---|---|---|
| 218 | 125746 | 126399 | 441 | QFAKFIPSGIIEKIQSEAIDENLLR PSVVRCEKTNTLDFLL MIKLRMPAGGERYIDGKSVYKLY LMIKQHMNGKYDVIKYNWCMRV SDAAYQKRRDKYFFQKLSEKYK LKELALIFISNLVANQDAWIGDISD ADALVFYREYIGRLKQIKFKFEED IRNIYFSKKVEVSAFKEIFEYNP KVQSSYIFKLLQSNIISFETFILLD SFLNIDKHDEQTDNLVWNNYSIK LKAYRKILNIDSQKAKNVFIETVK SCKY | 217 | Gp59 loader of gp41 DNA helicase [Enterobacteria phage T4] | NP_049856.1 | 4e-121 (217/217) | loader of Orf146 DNA helicase | T4-helicase_C, T4 gene 59 helicase, C terminal | pfam08994 | 3e-35 |
| | | | | | | | | T4-helicase_N, T4 gene 59 helicase, N terminal | pfam08993 | 3e-34 |
| 219 | 126500 | 127408 | 442 | MFKRKSTAELAAQMAKLAGNKG GFSSEDKGEWKLKLDNAGNGQ AVIRFLPSKNDEQAPFALLVNHG FKKNGKWYIETCSSTYGDYDSC PVCQYISKNDLYNTDNKEYSLVK RKTSYWANILVVKDPAAPENEGK VFKYRFGKKIWDKINAMIAVDVE MGETPVDVTCPWEGANFVLKVK QVSGFSNYDESKFLNQSAIPNID DESFQKELFEQMVDLSEMTSKD KFKSFEELSTKFSQVMGTAAMG GAAATAAKKADKVADDLDAFNV DDFKTKTEDDFMSSSSGSSSSA DDTDLDDLLNDL | 302 | ssDNA binding, DNA repair, recombination and pre-synthesis [Enterobacteria phage RB32] | YP_803177.1 | 4e-172 (296/302) | ssDNA binding, DNA repair, recombination and pre-synthesis | Gp32 DNA binding protein like | pfam08804 | 6e-41 |
| 220 | 127553 | 127783 | 443 | MAKVDIDIVDFEYIEEIIRNRYPEL SITSIHDDPNYCNFSIVIEGPLEDL TRFMANEYCDGMDSEDAEFYM GLIEQ | 76 | Frd.3 hypothetical protein [Enterobacteria phage RB51] | YP_0028541 94.1 | 1e-36 (76/76) | | Bacteriophage FRD3 protein | pfam05798 | 3e-33 |
| 221 | 127829 | 128194 | 444 | MYIGKKYELVPRLIDTFINYRPRS NSSIVKIIQENGGWFEVKEAFFV DGFRVIKHIECANGKHFYFNVCE DEFHCFREYKEPTSEEDGAEDIV SGVTKIHCIVDENNVDEIIELLRKT FKK | 121 | Frd.2 hypothetical protein [Enterobacteria phage RB14] | YP_0028545 71.1 | 6e-62 (118/121) | | Bacteriophage FRD2 protein | pfam03197 | 2e-36 |
| 222 | 128333 | 128575 | 445 | MRLQRQSIKDSEVRGKWYFNIIG KDSELVEKAEHLLRDMGWEDEC DGCPLYEDGESAGFWIYHSDVD | 80 | Frd.1 conserved hypothetical protein [Enterobacteria | NP_049851.1 | 3e-39 (79/80) | | No putative conserved domains have been detected | | |

Fig. 6QQ

|   |   |   | QFKADWKIVKKSV | | | | |
|---|---|---|---|---|---|---|---|
| 223 | 128586 | 446 | MSGIHVTGIAQVNIRCQFKTVPG VTHITLSHDPYSRGRQLTGVIKFF GGIGGSEFTIGDDEIVGCKLKVQ KGVLELFSDEVFDEISRAVNKGM LTLIKMIKASGYVTDPF | 110 | Hypothetical protein RB51ORF237 [Enterobacteria phage RB51] | YP_0028541 90.1 | 2e-34 (78/116) | | No putative conserved domains have been detected |
| 224 | 128930 | 447 | MIFVFEFMNDEFDYAIFNALHNP DLSEFNEMFSDALSMSEEYCGE CQRVCVTVFENKEKTYEELFFDA NKATEWFVERGFA | 81 | Hypothetical protein RB32ORF231c [Enterobacteria phage RB32] | YP_803173.1 | 7e-39 (79/80) | | No putative conserved domains have been detected |
| 225 | 129175 | 448 | MIKLVFAYSPTKTVEGFNELAFG LGDGLPWGRIKKDLQNFKARTE GTILIMGAKTFQSLSTLLPGRSHI VVCDLARDYPVTKDGDLAHFYIT WEQYITYISGGEIQVSSPNAPFE TMLGQNSKVSVIGGPALLYAALP YADEVVVSRIVKRHRVNSTVQLD ASFLDDISKREMVETHWYKIDEV TTLTESVYK | 193 | Dihydrofolate reductase [Enterobacteria phage RB14] | YP_0028545 68.1 | 8e-109 (190/193) | dihydrofolate reductase | DHFR_1, dihydrofol ate reductase | 2e-30 pfam0018 6 |
| 226 | 129753 | 449 | MSNKLKVKDVPNAMALFICRQM HQGPMTPKQYLKGERSLGFTRK AKQMVKLGYKPNFAKYPSTYSW MN | 68 | No significant similarity found. | | | | |
| 227 | 129959 | 450 | MKQYQFLIKDILENGYETDDRTG TGTIALFGTKLRWDLTKGFPAVT TKKLAWNACISELLWFLSGSTNV NDLRLIQHNSLIQGKTVWDENYE NQAKDLGYHSGELGPIYGKQWR DFGGVDQIIEVIDRIKKLPNDRRQ IVSAWNPAELKQMALPPCHMFY QFNVRNGYLDLQWYQRSVDVFL G | 183 | Thymidylate synthase [Bacteriophage RB23] | AAP86753.1 | 2e-101 (177/183) | thymidylate synthase | Thymidyl ate synthase, thyA | 6e-67 PRK01827 |
| 228 | 130639 | 451 | MKSGIYQIKNTLNNKVYVGSAKD FEKRWKRHFKDLEKGCHSSIKL QRSFNKHGNVFECSILEEIPYEK DLIERENFWIKELNSKINGYNIAD ATFGDTCSTHPLKEEIIKKRSETV KAKMLKLGPDGRKALYSKPGSK NGRWNPETHKFCKCGVRIQTSA YTCSKCRNRSGENNSFFNHKHS DITKSKISEKMKGKKPSNIKKISC DGVIFDCAADAARHFKISSGLVT YRVKSDKWNWFYINA | 245 | I-TevI homing endonuclease [Enterobacteria phage T4] | NP_049849. 3 | 3e-141 (245/245) | I-TevI homing endonuclease | Group I intron endonucl ease, grpIintron _endo | 5e-39 TIGR0145 3 |
| 229 | 131521 | 452 | MLPNIASYATLVHIVAKMCNLIP GDLIFSGGNTHIYMNHVEQCKEI | 104 | Thymidylate synthase | AAP86755.1 | 7e-55 (103/103) | thymidylate synthase | Thymidyl ate | 8e-26 PRK01827 |

Fig. 6RR

| | | | | | | | |
|---|---|---|---|---|---|---|---|
| 230 | 131859 | | LRREPKELCELVIGGLPYKFRYL STKEQLEYILKLRPKDFVLKDYQ SHGVLKGKMAV | | [Bacteriophage RB3] | | synthase, thyA |
| 231 | 132076 | 453 | MILRFKDTSGAVLFTLPNPSELEV PGPNQPIIYGKKYYTHKMTREYF DNKISTVKTSSDCYYDITVLTEKQ YDELSPRGPSMPGSE | 87 | NrdA.2 [Enterobacteria phage T2] | AAP78917.1 | 2e-43 (86/87) | | No putative conserved domains have been detected |
| 232 | 132402 | 454 | MTNYHRAGRLCQVVNKYKSDFD VNIHRGTFWGNYVGKDAGSREA AIELFKDFIRRIKSGEITKAHLEP LRGMRLGCTCKPKPCHGDIIAHI VNRLFKDDFQVEDLCN | 108 | NrdA.1 [Enterobacteria phage T6] | ABI48941.1 | 5e-57 (106/108) | | No putative conserved domains have been detected |
| | 132393 | 455 | MQLINVIKSSGVSQSFDPQKIIKV LSWAAEGTSVDPYELYENIKSYL RDGMTTDDIQTIVIKAAANSISVE EPDYQYYAARCLMFALRKHVYG QYEPRSFIDHISYCVNEGKYDPE LLSKYSAEEITFLESKIKHERDME FTYSGAMQLKEKYLVKDKTTGQI YETPQFAFMTIGMALHQDEPVD RLKHVIRFYEAVSTRQISLPTPIM AGCRTPTRQFSSCVVIEAGDSLK SINKASASIVEYISKRAGIGINVGM IRAEGSKIGMCGEVRHTGVIPFWK HFQTAVKSCSQGGIRGGAATAY YPIWHLEVENLLVLKNNKGVEEN RIRHMDYGVQLNDLMMERFGKN DYITLFSPHEMGGELYYSYFKDQ DRFRELYEAAEKDPNIRKKRIKA RELFELLMTERSGTARIYVQFIDN TNNYTPFIREKAPIRQSNLCCEIAI PTNDVNSPDAEIGLCTLSAFVLD NFDWQDQDKINELAEVQVRALD NLLDYQGYPVPEAEKAKKRRNL GVGVTNYAAWLASNFASYEDAN DLTHELFERLQYGLIKASIKLAKE KGPCEYYSDTRWSRGELPIDWY NKKIDQIAAPKYVCDWSSLREDL KLFGIRNSTLSALMPCESSSSQVS NSTNGIEPPRGPVSVKESKEGSF NQVVPNIEHNIDLYDYTWKLAKK GNKPYLTQVAIMLKWVCQSASA NTYYDPQIFPKGKVPMSIMIDDLL YFWYFGGKNFYYHNTRDGSGT DDYEIETPKAEDCSSCKL | 754 | Ribonucleotide reductase A subunit [Enterobacteria phage RB51] | YP_0028541 83.1 | 0,0 (753/754) | ribonucleotide reductase A subunit | Ribonucle- otide- diphosph- ate reductase subunit alpha | PRK09103 | <1,0e-180 |
| 233 | 134709 | | | | | | | |
| | 135887 | 456 | MSTVFNTNPVDVLKEPMFFGSG LGIARYDIQRHKVFEDLTEKQLSF | 392 | Ribonucleotide reductase B subunit | YP_0028545 | 0,0 | ribonucleotide reductase B | Ribonucle- otide- | PRK09101 | 4e-141 |

Fig. 6SS

| | | | | | | | | | |
|---|---|---|---|---|---|---|---|---|---|
| 234 | 135915 | | FWRPEEVNLMMDAAQFNKLPQY QQNIFTNNLKYQSLLDSIQGRAP SAVLMSLISDPSLDTWVATWTFS ETIHSRSYTHIMRNLYTDPSKVF DEIVLDEAIMKRAESIGRYYDDVL IKTRYWENAKADIEYQKEINADE DVIEDAIEHETYWKRELMKSLYL CLHVINALEAIRFYVSFACTFNFH KNMEIMEGNAKIMKFIARDEQLH LKGTQYIIRQLQLGTDGDEWVKI AQECEQEAVDIFMEVNRQEKDW AVHLFKDGDVPGLNTNSMWSFI DYLTVSRMKQCGLPCPITDAPVK HPYPWIREYLNSDNVQSAPQEV ELSSYLVAQIDNDVDDKVMMSFK KYF | | [Enterobacteria phage RB14] | 62.1 | (387/392) | subunit | diphosphate reductase subunit beta | |
| | 136325 | 457 | MKEIATEYSFIKYTELELDYNGSI KQLSIPNKYNVIYAIANDELVYIG KTKNLRKRINYYRTAINRKDKTS DSTKSALIHAALKEGSKVEFYAR QCFNLSMTNELGTMTIATIDLEEP LFIKLFNPPWNIQHKKK | 136 | Endonuclease II [Enterobacteria phage RB51] | YP_0028541 81.1 | 7e-73 (135/136) | endonuclease II | GIY-YIG type nucleases (URI domain) | smart0046 5 | 1e-05 |
| 235 | 136378 | 458 | MQELFNNLMELCHKDSQRKFFYS DDVSASGRTYRIFSYNYASYSD WLLPDALECRGIMFEMDGEKPV RIASRPMEKFFNLNENPFTMNID LNDVDYILTKEDGSLVSTYLDGD EILFKSKGSIKSEQALMANGILMN INHHRLRDRLKELAEDGFTANFE FVAPTNRIVLAYQEMKIILLNVRE NETGEYISYDDIYKDAALRPYLVE RYEIDSPKWVEEAKNAENIEGYV AVMKDGSHFKIKSDWYVSLHST KSSLDNPEKLFKTIIDGASDDLKA MYADDEYSYRKIEAFETTYLKYL DRALFLVLDCHNKHCGKDRKTY AMEAQGVAKGAGMDHLFGIIMS LYQGGYDSQEKVMCEIEQNFLKN YKKFIPEGY | 374 | RNA ligase [Enterobacteria phage RB51] | YP_0028541 80.1 | 0,0 (373/374) | RNA ligase | RNA ligase, T4 RnlA family | TIGR0230 8 | <1,0e-180 |
| 236 | 137567 | | MDLQLITTEMVVEAYGDTTDGIS VFKGNRRVGYITDLKKDLAKQVK RKTTIKEYRNRRLEQARDMLPDA VEEMKVFLENQLAKYDCDVFINQ TQPNVHINSCKCYIIVNPLTGKHR LGISNPNRSASDMAEDVEACFKI SKSPAEHHILINGLSQDDIIEVIKT LCM | | | | | | | | |
| | 138070 | 459 | | 167 | Alc inhibitor of host transcription [Enterobacteria phage T4] | NP_049838. 1 | 3e-93 (164/167) | inhibitor of host transcription | | No putative conserved domains have been detected |

Fig. 6TT

| | | | | | | | | |
|---|---|---|---|---|---|---|---|---|
| 237 | 138061 | 138414 | 460 | MHVSNFTAGLLLLVIAFGGTSIILK NKVERLETSVTEITKTANENALAL NNLRIQYNYIDAMNNKNREAIAAI ERENEKLRKDAKKADVVAHKPG LVEKQINNSFNKFAEDIQDLSK | 117 | PseT.3 conserved hypothetical predicted membrane protein [Enterobacteria phage T4] | NP_049837.1 | 2e-59 (116/117) | | No putative conserved domains have been detected |
| 238 | 138411 | 138710 | 461 | MIKLSAVILSIGLLVGCSTKPLEVK KETVHPNWPVQIKSYDEAKLSW QVKVIDGKAWVGMPFEDSQEFR IWLNDVKRYVHDQKTMICYYRQ ELKEDKCK | 99 | Hypothetical protein RB32ORF219c [Enterobacteria phage RB32] | YP_803161.1 | 1e-51 (99/99) | Outer membrane assembly lipoprotein YfiO | TIGR0330 2  0,002 |
| 239 | 138707 | 138937 | 462 | MISWYQFEHLKGLIYESEMAAMI YGRQIQRLESLPPTNDVLLAQSR ANLKNEYQNKWGKASKDLHDYI QSLVEKNK | 76 | PseT.1 hypothetical protein [Enterobacteria phage RB51] | YP_0028541 76.1 | 2e-37 (76/76) | | No putative conserved domains have been detected |
| 240 | 138934 | 139236 | 463 | MKTLLERYIECSDRYIDVCHDNA SSISEDIEHAKALDDAGKALRKEA KARGFDMYQLKNHMIKFISSNVQ SKSVNQSTAELYKGRREHNIRIL EVFLGIK | 100 | RB32ORF217c hypothetical protein [Enterobacteria phage RB14] | YP_0028545 55.1 | 3e-49 (96/100) | | No putative conserved domains have been detected |
| 241 | 139233 | 140138 | 464 | MMKKIILTIGCPGSGKSTWAREFI AKNPGFYNINRDDYRQSIMAHEE RDEYKYTKNKEGIVTYMQHDVA NMILCQDATKGVIVSDTNLNPER RKVWEEFAKELGHQIEYKVFDVP WTELVKRNSKRGTKAVPIDVLRS MYKSMREYLGLPVYKGTPGKPK AVIFDVDGTLAKMNGRGPYDLEK CDIDIINPMVVELSKMYALMGYQI VVVSGRESGTEEDPTKYYRMTR KWVEDIAGVPLVMQCQREQGDT RKDDVVKEEIFWKHIAPHFDVKL AIDDRTQVVEMWRRIGVECWQV ASGDF | 301 | dN 3'phosphatase [Enterobacteria phage RB51] | YP_0028541 74.1 | 1e-170 (290/300) | dN 3'phosphatase | Predicted kinase  COG4639  8e-12 |
| 242 | 140158 | 140334 | 465 | LGFVIVNSGLVGTSNGQFCVFTS ENRAWEECLKLREKNPDVELVV KKTKLPLPWKTYE | 58 | Cd.5 hypothetical protein [Enterobacteria phage T4] | NP_049833.1 | 2e-24 (55/57) | | No putative conserved domains have been detected |
| 243 | 140327 | 140527 | 466 | MNNLEKIYRLCDKIEKEKKYLFCL WPIVDGRVGLDVLDYETEDKVD GATFDNALDVIDWLEENYVR | 66 | Hypothetical protein RB51ORF219 [Enterobacteria phage RB51] | YP_0028541 72.1 | 2e-29 (64/66) | | No putative conserved domains have been detected |
| 244 | 140530 | 140805 | 467 | MFPTYSKIVEVVFSQIIANNMFEK LDNAAELRIHAQVTHVLNALLPD | 91 | Hypothetical protein RB32ORF215c | YP_803157.1 | 2e-45 (91/91) | | No putative conserved domains have been detected |

Fig. 6UU

| | | | | | | | | | |
|---|---|---|---|---|---|---|---|---|---|
| 245 | 140868 | | QVDSIAITLYPGSAHIIVVFGLDAE LVIKGDIRFESQTSEFFKAI | | [Enterobacteria phage RB32] | | | | No putative conserved domains have been detected |
| | 141395 | 468 | MSEWFEEDKVYRFKAGYKDIFN ETCGANKRIAQFIGENSFKVKIDP AKNVISIKREIDDCWYKAVDVMG ESYKVSPLFSIAYMLEYSFFEEV QKDDSVSKFEIKTDKEIKWKVVGI TGCMFYIYAQTDTKEEAKKKALE YLEEHEEGPVMITQDAELVSVKL VKNVESKELGSTC | 175 | Hypothetical protein RB32ORF214c [Enterobacteria phage RB32] | YP_803156.1 | 5e-95 (173/175) | | No putative conserved domains have been detected |
| 246 | 141625 | 469 | MLSEKPITVKEFQEKVKLFAQEL VNKVSERFPETSVRVITETPRSV LVIVNPGDGDQISHLKLDFDGLV EAQRVYGVL | 78 | Hypothetical protein RB32ORF213c [Enterobacteria phage RB32] | YP_803155.1 | 5e-37 (78/78) | | No putative conserved domains have been detected |
| 247 | 141622 141960 | 470 | MMNLTDIIDNCLENDTGDHRALD SETAQFIRITLMNDTLVNSIHPSV YDAIIVTKYPVELHKKMTGAVFID KKNRFKDGQNITSSVIKSITKLRH EIYRVETAKSAYLVIMK | 112 | Cd.1 hypothetical protein [Enterobacteria phage T4] | NP_049829.1 | 2e-58 (111/112) | | No putative conserved domains have been detected |
| 248 | 141957 142538 | 471 | MKASTVLQIAYLVSQESKCCSW KVGAVIEKNGRIISTGYNGSPAG GVNCCDYAAEQGWLLNKPKHTII QGHKPECVSFGSTDRFVLAKEH RSAHSEWSSKNEIHAELNAILFA ARNGSSIEGATMYVTLSPCPDCA KAIAQSGIKKLVYCETYDKNKPG WDDILRNAGIEVFNVPKKNLNKL NWENINEFCGE | 193 | dCMP deaminase [Enterobacteria phage RB32] | YP_803153.1 | 3e-110 (193/193) | dCMP deaminase | Deoxycyti dylate_de aminase | cd01286 | 1e-37 |
| 249 | 142538 142774 | 472 | MKFRLVKLTAISSYSNENISFAVE YKKYFFSKWKQYYKTDWTSIDR PYSWKSDLEKCQKLLSTLKERG TTHIKTVIGK | 78 | Gp31.2 hypothetical protein [Enterobacteria phage RB51] | YP_0028541 67.1 | 1e-37 (78/78) | | No putative conserved domains have been detected |
| 250 | 142775 | 473 | MKLTTEQKVAIREILKTKLSMGIS NVFEKSDGTIRIMKCTRDADFM PTMQTGKLTESTRKESTDMIPVF DVELGAWRGFSIDKLISVNGMKV EHLLQFIGK | 102 | Gp31.1 conserved hypothetical protein [Enterobacteria phage T4] | NP_04826.1 | 2e-50 (99/102) | | No putative conserved domains have been detected |
| 251 | 143083 143140 | 474 | MSEVQQLPIRAVGEYYILVSEPA QAGDEEVTESGLIIGKRIQGEVP ELCVVHSVGPDVPEGFCEVGDL TSLPVGQIRNVPHPFVALGLKQP KEIKQKFVTCHYKAIPCLYK | 111 | Gp31 head assembly cochaperone with GroEL [Enterobacteria phage T4] | NP_049825.1 | 1e-56 (110/111) | head assembly cochaperone | Chaperon in 10 Kd subunit | pfam0016 6 | 8e-06 |
| 252 | 143475 143623 143871 | 475 | MIKQLQHALELQRNAWNNGHEN YGASIDVEAEALEILRYFKHLNPA | 82 | rIII lysis inhibition accessory protein, | NP_049824. | 6e-40 | rIII lysis inhibition | No putative conserved domains |

Fig. 6VV

| | | | | | QTALAAELQEKDELKYAKPLASA ARKAVRHFVVTLK | | | (82/82) | | have been detected | | |
|---|---|---|---|---|---|---|---|---|---|---|---|---|
| 253 | 144226 | 144444 | 476 | MPISPAFSFKREFIMAKQVKAKK AVEKKVGDSKRAGYKRGSNSRI NQTVEKIMRRARAVLRDDASRF GKQKA | 72 | rapid lysis phenotype [Enterobacteria phage T4] | CAA35653.1 | 2e-32 (71/72) | | No putative conserved domains have been detected | | |
| 254 | 144555 | 144920 | 477 | MNYINFERKYVSNGIAGSIDTICL WKHQNGSVCEIDQYMTPNYVY MRFENGITVSITKEGSNFKIALDD DFRERDLGTHPCWNGVHRKLLI KTWIRHILSNKAKPEHLEAIFDVV LNEFDI | 121 | Unnamed protein product [Enterobacteria phage T4] | CAC42995.1 | 2e-64 (116/121) | | Phage_T 4_Gp30_ 7, Phage Gp30.7 protein | pfam0691 9 | 3e-66 |
| 255 | 144949 | 145236 | 478 | MFMTTYFDTRKNFCEVVFSKAP KDLPAHLQPTSESIKNYVNVVCP LEFRTVNGRDTLAITKLNREIDID PSIAREINSSDINGGNVKSHGFQ MRF | 95 | Protein gp30.7 [Bacteriophage K3] | YP_0028545 39.1 | 1e-47 (91/95) | | No putative conserved domains have been detected | | |
| 256 | 145236 | 145433 | 479 | MKFLGQTVELKGVGIPGLISKVL PPFKWSGIQIKEAYIVSWVDGNE DLRMGDELSPIYGLKELV | 65 | Gp30.6 hypothetical protein [Enterobacteria phage RB14] | NP_049819. 1 | 5e-29 (65/65) | | No putative conserved domains have been detected | | |
| 257 | 145430 | 145636 | 480 | MNIINKIFGIQYIKVTYKVTDKNPY TDEHEEPQVKSIILEKGSDWPVE FRLPNYGHWADVEIISIENV | 68 | Gp30.5 hypothetical protein [Enterobacteria phage T4] | YP_0028541 58.1 | 5e-29 (64/68) | | No putative conserved domains have been detected | | |
| 258 | 145629 | 146087 | 481 | MSELEIRSNFKWPSCALSNFAQ WPFVMDGIQFGGLEGFLQGCKV KNVEQQRRIFGLSGLAAQQAGR SYARAQDRGTLFWLGVPFSRYS PAWKELYTNAYFEAAIONKGFRD ALHASKGKVLKHSMASGLTKDD TILTEAEFIDVLNLLRDSL | 152 | Gp30.4 hypothetical protein [Enterobacteria phage RB51] | CAD30242.1 | 5e-85 (152/152) | | Bacteriop hage protein GP30.3 | pfam0801 0 | 6e-71 |
| 259 | 146084 | 146923 | 482 | MKPTILTDIDGVCLSWQSGLPYF AQKYNLPLEHILKMIQDEKFISPG KLFNCDEELGVKLIEKYNRSDFIR YLSPYKDALCVINKLKEDYNFVA VTALGDSIDALLNRQFNLNALFP GAFSEVLMCGHDSSKEELFKKA KEKYNVICYIDDLAHHCDHASEIL NVPVYWMARGERDSIPKTAQRV YTWNDVENKLFSPKENKESFDS EKAIKDVIEKMIKNDSFPWNTTW RTPGFNPYNHLYHPYQTHPFQT | 279 | Gp30.3 protein [Bacteriophage Pol] | YP_803141.1 | 2e-163 (276/279) | | No putative conserved domains have been detected | | |

Fig. 6WW

| | | | WNYIKPGGIEYLYNRPTSGDNIF QGAF | | | | | |
|---|---|---|---|---|---|---|---|---|
| 260 | 146923 | 483 | MFVVHTIYENEGNTTRDYGHVN QFFRCNPEFRAQKDERIFKKCVE QGFIYVKHWMQGNKVRTTYHRS LTELNDELIYNRAVNQTLKDEQ | 89 | Hypothetical protein RB32ORF198c [Enterobacteria phage RB32] | YP_803140.1 | 1e-46 (89/89) | | No putative conserved domains have been detected |
| 261 | 147189 | 484 | MILKILNEIASIGSTKQKQAILEKN KDNELLKRVYRLTYSRGLQYYIK KWPKPGIATQSFGMLTLTDMLDF IEFTLATRKLTGNAAIEELTGYITD GKKDDVEVLRRVMMRDLECGAS VSIANKVWPGLIPEQPQMLASSY DEKGINKNIKFPAFAQLKADGAR CFAEVRGDELDDVRLLSRAGNE YLGLDLLKEELIKMTTEARQIHPE GVLIDGELVYHEQVEKEPEGLDF LFDAYPEISKAKEFAEVAESRTA SNGIANKSLKGTISEKEAQCMKF QWWDYVPLVEIYGLPAFRLKYDV RFSKLEQMTSGYDKVILIENQVV NNLDEAKVYKKYIDQGLEGIILKN TDGLWENARSKNLYKFKEVIDVD LKIVGIYPHRKDPTKAGGFILESE CGKIKVNAGSGLKDKASVKSHEL DRTRIMENQNYYIGKILECECNG WLKSDGRTDYVKLFLPIAIRLRED KTKANTFEDVFGDFHEVTGL | 487 | Gp30 DNA ligase [Enterobacteria phage RB51] | YP_0028541 54.1 | 0,0 (482/487) | DNA ligase | DNA_liga se_A_M, ATP dependen t DNA ligase domain | pfam0106 8 | 3e-26 |
| 262 | 148649 | 485 | MKAYLETIVVAQKEGGDVSTSVS QVILEFVDAYAYNKFTETFDAYE KGPKFEIYRTLLPLDY | 62 | Alt.1 conserved hypothetical protein [Enterobacteria phage T4] | NP_049812.1 | 1e-26 (57/62) | | No putative conserved domains have been detected |
| 263 | 148890 | 486 | MELITELFDEDTTLPITNLNPKKKI PQIFSVHVDDAIEQPGFRLCTYT SGGDTNRDLKMGDKMMHIVPFT LTAKGSIAKLKGLGPSPINYINSV FTVAMQTMRQYKIDACMLRILKS KTAGQARQIQVIADRLIRSRSGG RYVLLKELWDYDKKYAYILIHRKN VSLEDIPGVPEISTELFTKVESKV GDVYINKDTGAQVTKNEAIAASIA QENDKRSDQAVIVIKVKISRRAIA QSQSLESSRFESELFQKYESTAA NFNKPATAPLIPEAEEMKIGINSL ASKTKAAKIIAEGTADELHYDYKF FPMSQVGEVSEKIKEVIFNAIKNE PTTSIKCLEKYAAAANQLFEEYK DNWLDKHNKTRKGQPDEVWEE | 697 | Adenosylribosyl-transferase packaged protein [Enterobacteria phage RB14] | YP_0028545 31.1 | 0,0 (682/697) | adenosylribos yl-transferase packaged protein | VIP2; A family of actin-ADP-ribosylatin g toxin | cd00233 | 1e-36 |

Fig. 6XX

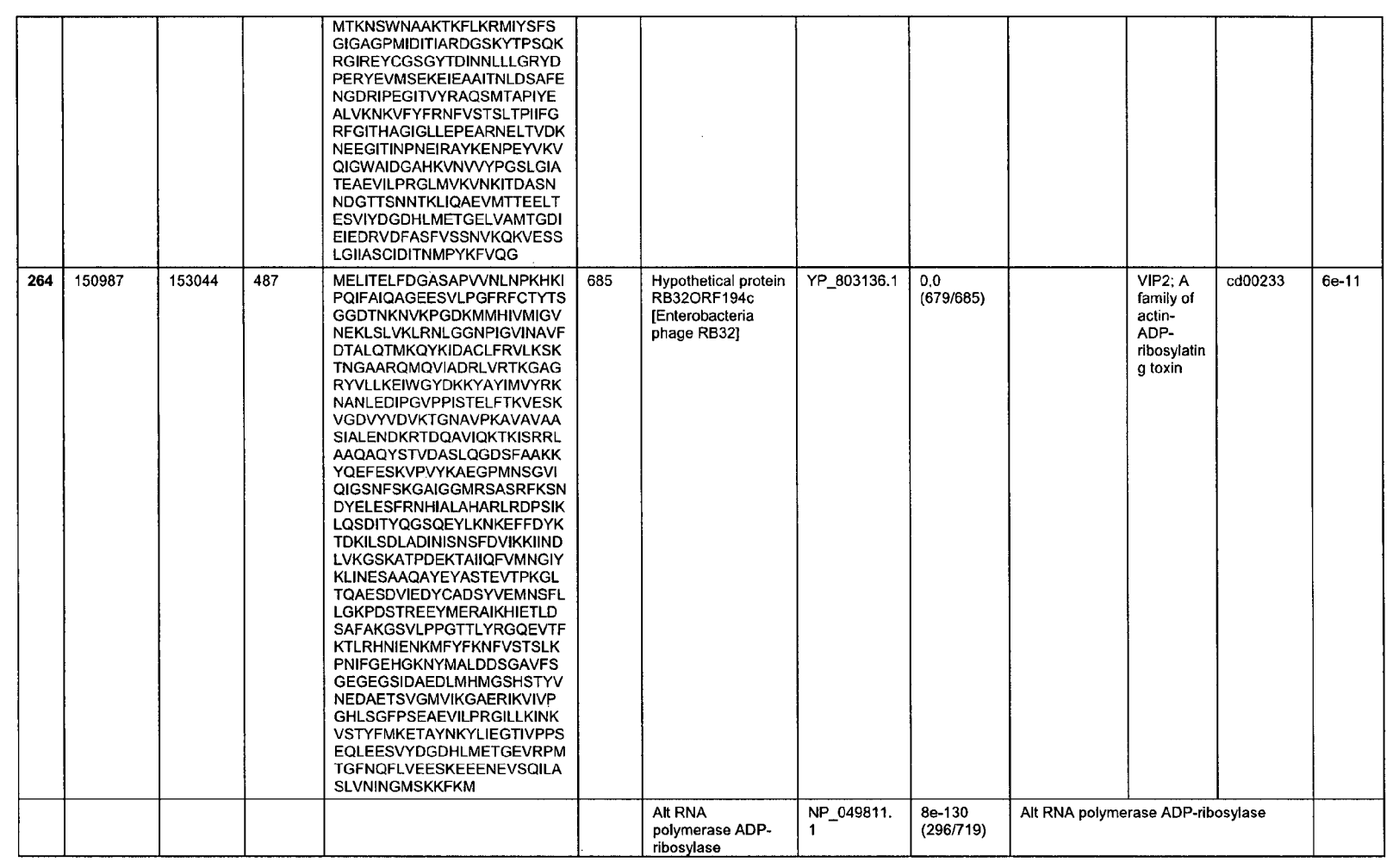

| | | | | | | | | | |
|---|---|---|---|---|---|---|---|---|---|
| | | | | | | | | | 6e-11 |
| | | | | | | | | cd00233 | |
| | | | | | | | VIP2; A family of actin-ADP-ribosylatin g toxin | | |
| | | | | |

| | | | | | | | | |
|---|---|---|---|---|---|---|---|---|
| 265 | 153105 | | MKSSLRFLGQELVVEGVIPADNA FNEAVYNEFIKFGTDKKFGIFPS ENFSKPEQTESIFQGVVTGKFES EAPVKIEVYIEDSLVASVAAFISFR K | 488 | | | | No putative conserved domains have been detected |
| 266 | 153395 | | MYSLEEFNNQAINADFQRNNMF SCVFATTPSTKSSSLISSISNFSY NNLGLNSDWLGLTQGDINQGIT LITAGTQKLIRKSGVSKYLIGAMS QRTVQSLLGSFTVGTYLIDFFNM AYNSSGLMIYSVKMPENRLSYET DWNYNSPNIRITGRELDPLVISFR MDSEACNYRAMQDWVNSVQDP VTGLRALPQDVEADIQVNLHSRN GLPHTAVMFTGCIPISVSAPELSY DGDNQITTFDVTFAYRVMQAGA VDRQAALEWLESAAINGIQSVLG NSGGVTGLSNSLSRLSRLCGTA GSISNINTMTGIVNSQSKILGAI | 489 | 96 | Alt.-3 conserved hypothetical protein [Enterobacteria phage T4] | NP_049808 | 3e-46 (95/96) | | No putative conserved domains have been detected |
| 267 | 153424 | | MAIVKEITADLIKKSGEKISAGQS TKSEVATKTYTAQFPTGRASGN DTTGDFQVTDLYKNGLLFTAYN MSSRDSGSLRTMRSNYSSSSSS ILRTARNTISNTVSKLSNGLISDN NSGTISKVPVANILLPRSKSDVDT SSHRFNDVQDSLITKGGGTATG VLSNMASTAVFGALESITQGIMA DNNEQIYTTARSMYGGAENRTK VFTWDLTPRSTEDLMAIINYQYF NYFSYGETGKSQYAAEIKGYLDE WYRSTFIEPLTPEDAVKNKTLFE KMTSSLTNVLVVSNPTWMWKNF GATSKFDGKTEIFGPCQIQSIRFD KTPNGNFNGLAIAPNLPSTFTLEI TMREIITLNRASLYAGTF | 490 | 321 | Base plate-tail tube initiator [Enterobacteria phage RB32] | YP_803134.1 | 0,0 (320/321) | base plate-tail tube initiator | |
| | | | | | 364 | Gp48 base plate [Enterobacteria phage RB51] | YP_0028541 48.1 | 0,0 (358/364) | base plate | No putative conserved domains have been detected |
| 268 | 155492 | 157264 | MKKPQEMQTMRRKVISDNKPTQ EAAKSASNTLSGLNDISTKLDDA QAASELIAQTVEEKSNEIIGAIDN VESAVSDTTAGSELIAETVEIGNN INKEIGESLGSKLDKLTSLLEQKI QTAGIQQTGTSLATVESAIPVKV VEDDTAESVGPLLPAPEAVNND PDADFFPTPQPVEPKQESPEEK QKKEAFNLKLSQALDKLTKTVDF GFKKSISISDKISSMLFKYTVSAAI | 491 | 590 | Gp29 baseplate hub subunit, tail length determinator [Enterobacteria phage T4] | NP_049805. 1 | 0,0 (567/590) | baseplate hub subunit, tail length determinator | No putative conserved domains have been detected |

Fig. 6ZZ

| | | | | | | | | |
|---|---|---|---|---|---|---|---|---|
| | | | EAAKMTAMILAVVGIDLLMVHF KYWSDKFSQAWDLFSTNFTKFS SETGTWGPLLQSIFGSIDKIKKLW EAGDWGGLTVAIVEGLGKVLFNL GELIQLGMAKLSAAILRVIPGMKD TADEVEGRALENFQNTTNASLSK EDQEKVANYQYKRMNDDLGPIA KGLDKIANWKTRASNWIRGVDN KEALTTDEERAEEEKLKQLSPE EAKIAJMKANEARAAMNRFDEYA NSADMSKDSTVKSVEAAYEDLK KRMDDPDLNNSPAVKKELAARF SKIDATYQELKKNQPNAKPQTSA KSPEAKQVQVIEKNKAQQAPIQQ ASPSINNTNNVIKKNTVVHNMTP VTSTTAPGVFDATGVN | | | | | |
| 269 | 157794 | 492 | MNLKLILPLKKVVLPISNKEVSIPK MGLKHYNILKDVKGPDENLKLLID SICPNLSPAEVDFVSIHLLEFNGK IKSRKEIDGYTYDINDVYVCQRLE FQYQGNTFYFRPPGKFEQFLTV SDMLSKCLLKVNDEVKEINFLEM PAFVLKWANDIFTTLAIPGPNGPI TGIGNIIGLFE | 177 | Base plate distal hub subunit [Enterobacteria phage RB32] | YP_803131.1 | 9e-97 (176/177) | base plate distal hub subunit | No putative conserved domains have been detected |
| 270 | 158914 | 493 | MSMLQRPGYPNLSVKLFESYDA WSNNRFVELAATITTLTMRDSLY GRNEGMLQFYDSKNIHTKMDGN EIICISVANANDINNVKTRIYGCKH FSVSVDSKGDNIIAIELGTIHSIEN LKFGRPFFPDAGESIKEMLGVIY QDRTLLTPAINAINAYVPDIPWTS TFENYLSYVREVALAVGSDKFVF VWQDIMGVNMMDYDMMINQEP YPMIVGEPTLIGQFVQELKYPLAY DFVWLTKSNPHKRDPMKNATIY AHSFLDSSLPMITTGKGENSIVVS RSGAYSEMTYRNGVEEAIRLQT MAQYDGYAKCSTVGNFNLTPGV KIIFNDSKNQFKTEFYVDEVIHEL SNNNSVTHLYMFTNATKLETIDP VKVKNEFKTDTTTEESSSDK | 390 | Gp27 base plate hub subunit [Enterobacteria phage RB51] | YP_0028541 45.1 | 0.0 (390/390) | base plate hub subunit | Phage-tail_1, Baseplate structural protein, domain 1 | pfam0909 7 | 2e-98 |
| | | | | | | | | Phage-tail_2, Baseplate structural protein, domain 2 | pfam0909 6 | 9e-86 |

Fig. 6AAA

| | | | | | | | | |
|---|---|---|---|---|---|---|---|---|
| 271 | 159663 | 158911 | 494 | MANIIRCKLPDGVHRFKPFTVED YRDFLLVRNDIEHRSPQEQKEIIT DLIDDYFGDYPKTWQPFIFLQVF VGSIGKTKVPVTFVCPKCKKEKT VPFEIYQKELKEPVFDVANVKIKL KFPSEFYENKAKMITENIHSVQV DEIWYDWKEISESSQIELVDAIEI ETLEKILDAMNPINLTLHMSCCDK YIKKYTDIVDVFKLLVNPDEIFTFY QINHTLVKSNYSLNSIMKMIPAER GFVLKLIEKDKHQ | 250 | Gp51 base plate hub assembly catalyst [Enterobacteria phage RB14] | YP_0028545 23.1 | 3e-141 (247/249) | base plate hub assembly catalyst | No putative conserved domains have been detected |
| 272 | 159714 | 160340 | 495 | MYEYKFDVRVGSKIINCRAFTLK EYLELITAKNNGSVEVIVKKLIKD CTNAKDLNRQESELLIHLWAHS LGEVNHENSWKCTCGTEIPTHIN LLHTQIDAPEDLWYTLGDIKIKFR YPKIFDDKNIAHMIVSCIETIHANG ESIPVEDLNEKELEDLYSIITESDI VAIKDMLLKPTVYLAVPIKCPECG KTHAHVIRGLKEFFELL | 208 | Gp26 baseplate hub subunit [Enterobacteria phage T4] | NP_049801. 1 | 7e-118 (208/208) | baseplate hub subunit | No putative conserved domains have been detected |
| 273 | 160340 | 160738 | 496 | MANINKLYSDIDPEMKMDWNKD VSRSLGLRSIKNSLLGIITTRKGS RPFDPEFGCDLSDQLFENMTPL TADTVERNIESAVRNYEPRIDKLA VNVIPVYDDYTLVEIRFSVIDNPD DIEQIKLQLASSNRV | 132 | Gp25 baseplate wedge subunit [Enterobacteria phage T4] | NP_049800. 1 | 2e-70 (132/132) | baseplate wedge subunit | Baseplate wedge subunit gp25 | PHA00415 | 3e-54 |
| 274 | 160805 | 161218 | 497 | MRLEDLQEELKKDVFIDSTKLQY EAANNVMLYSKWLNKHSSIKKE MLRIEAQKKVALKAKLDYYSGRG DGDEFSMDRYEKSEMKTVLSAD KDVLKVDTSLQYWGILLDFCSGA LDAIKSRGFAIKHIQDMRAFEAGK | 137 | UvsY [Enterobacteria phage RB51] | YP_0028541 41.1 | 3e-73 (137/137) | recombination, repair and ssDNA binding protein | No putative conserved domains have been detected |
| 275 | 161218 | 161442 | 498 | MRYNIDDAFNYEEEFETEIQFLM KKHNLKRQDIRILADHPCGEDVL YIKGKFAGYLDEYFYSKDMGIDM HMRVV | 74 | UvsY.-1 conserved hypothetical protein [Enterobacteria phage T4] | NP_049798. 1 | 1e-35 (73/74) | | No putative conserved domains have been detected |
| 276 | 161471 | 161638 | 499 | MSDKICVVCKTPIDSALVVETDK GPVHPGPCYNYIKELPVSESSEE QLNETQLLL | 55 | UvsY.-2 conserved hypothetical protein [Enterobacteria phage T4] | NP_049797. 1 | 1e-23 (55/55) | | No putative conserved domains have been detected |
| 277 | 161694 | 161924 | 500 | MLLEFKQFLYEASIDEFMGKIASC QTLEGLEELEAYYKKRVKETELK DTDDISVRDALAGKRAELEDSDD EVEESF | 76 | UvsW RNA-DNA and DNA-DNA helicase, ATPase [Enterobacteria phage T4] | NP_049796. 1 | 2e-35 (76/76) | RNA-DNA and DNA-DNA helicase, ATPase | No putative conserved domains have been detected |

Fig. 6BBB

| | | | | | | | | | |
|---|---|---|---|---|---|---|---|---|---|
| 278 | 163461 | 161950 | 501 | MTDIKVHFYDFSHVRIDCEESTF HELRDFFSFEADGYRFNPKYKY GHWDGRIRLLDYNRLLPFGLVG QIKKFCDNFGYKAWIDPQINEKE ELSRKDFDEWLSKLEIYSGNKRI EPHWYQKDAVFEGLVNRRRILN LPTSAGKSLIQALLARYYLENYE GKILIVPTTALTTQMADDFVDYR LFSHAMIKKIGGGASKDDKYKND APVVVGTWQTVVKGPKEWFSQ FGMMMNDECHLATGKSISSIISG LNNCMFKFGLSGSLRDGKANIM QYVGMFGEIFKPVTTSKLMEDG QVTELKINSIFLRYPDEFTTKLKG KTYQEEIKIITGLSKRNKWIAKLAI KLAQKDENAFVMFKHVSHGKAIF DLIKNEYDKVYYVSGEVDTETRN IMKTLAENGKGIIIVASYGVFSTGI SVKNLHHVVLAHGVKSKIIVLQTI GRVLRKHGSKTIATVWDLIDDCG VKPKSANTKKKYVHLNYLLKHGI DRIQRYADEKFNYVMKTVNL | 503 | RNA-DNA and DNA-DNA helicase [Enterobacteria phage RB51] | YP_0028541 37.1 | 0.0 (503/503) | RNA-DNA and DNA-DNA helicase | SSL2, DNA or RNA helicases of superfami ly II | COG1061 | 8e-27 |
| 279 | 163512 | 164192 | 502 | MIDKDYIAELKALDDNKEAKAKLA EYAEQFCIKVKKNKSFDNIVNDIE EALQKLASEPMPETDGLSIKDLID AADAAEGLKYDDEEVNPEAALLI DSPVKSDKIEVVETDKIPENTDV LIEDTPFVEEKFEQAVAEIIESEKP SVFTLPENFSPNLQLIGKNPGFC TVPWWIYQWIAETPDWKSHPTS FEHASAHQTLFSLIYYINRDGSVL IRETRNSSFVTLK | 226 | Minor capsid protein inhibitor of 21 protease [Enterobacteria phage RB14] | YP_0028545 14.1 | 4e-125 (224/226) | minor capsid protein | Ferrous iron transporte r, FeoB | TIGR0043 7 | 2e-04 |
| 280 | 164202 | 165620 | 503 | MTFTVDITPKTPTGVIDETKQFTA TPSGETGGGTITYAWTVDDAPQ EETSATFSYVLKGPAGQKTIKVV ATNQVAESEPETAEISTTITVQNK TQTTTLAVTPGSPDAGVIGTPIEF TAALASQPSGANATYQWYVDGS PVGEATSTTFNYTPDASGVKTIK CVAQVTATDYDTKEVTSNEVSLT VNKKTQTTLAVTPDSPPAGVIG TPVQFTAALASQPDGASATYQW YVDDSQVGGETNSTFSYTPTTS GVKRIKCVAQVTAENYNEKEVTS NEVSLTVNKKTMNPQVTLTPPSI NVQQDASATFTANVTGAPEEAQI TYSWKKDSSPVEGSTNVYTVDT | 472 | Outer capsid protein Hoc [Bacteriophage RB30] | AAM52483.1 | 0.0 (428/472) | outer capsid protein Hoc | PKD domain | pfam0080 1 | 0.001 |

Fig. 6CCC

| | | | | | | | | |
|---|---|---|---|---|---|---|---|---|
| | | | SSVGSQTIEVTAVVTATDYDSKTI TAEGQVQVTDKVAPEPEGELPY VHPLPHRTSAYIWCGWWVMDEI QKMTEEGKDWKTDDPDSKYYLH RYTLQKMMKDYPEVDVQESRN GYIIHKTALETGIIYTYP | | | | | | |
| 281 | 165722 | | | 67 | Hypothetical protein RB32ORF177c [Enterobacteria phage RB32] | YP_803119.1 | 4e-30 (67/67) | | | No putative conserved domains have been detected |
| | 165925 | 504 | MRTEVVVFTLHESGKSFIEIAREL NLQAKEVAVLWARAMTAKNKFE TREKVVYRKRHNKKVKNGTV | | | | | | |
| 282 | 165912 | | | 92 | Gp24.2 conserved hypothetical protein [Enterobacteria phage T4] | NP_049791.1 | 3e-46 (91/92) | | No putative conserved domains have been detected |
| | 166190 | 505 | MEQYDLYENESFANQLREKALK SKQFKLECFIKDFSELANKAAEQ GKTHFSYYCIARDKLITEEIGDWL RKEGFSFKVNSDQRDGDWLEIT F | | | | | | |
| 283 | 166200 | | | 334 | RnlB RNA ligase 2 [Enterobacteria phage T4] | NP_049790.1 | 0.0 (329/334) | RnlB RNA ligase 2 | RNA ligase | pfam09414 | 4e-132 |
| | 167204 | 506 | MFKKYSSLENHYNSKFIEKLYSL GLTGGEWVAREKIHGTNFSLIIER DKVTCAKRTGPILPAEDFFGYEII LKNYEDSIKAVQDIMETSAVVSY QVFGEFAGPGIQKNVDYGDKDF YVFDIIVTTESGDVTYVDDYMME SFCNTFKFKMAPLLGRGKFEELI KLPNDLDSVVQDYNFTVDHAGL VDANKCVWKAEAKGEVFTAEGY VLKPCYPSWLHNGNRVAIKCKN SKFSEKKKSDKPIKAKVELSEAD NKLVGILACYVTLNRVNNVISKIG EIGPKDFGKVMGLTVQDILEETS REGITLTQADNPSLVKKELVKMV QDVLRPAWIELVS | | | | | | |

Fig. 6DDD

Table 7 - Features of phage F510/08 gene products and assignment of putative functions.

| ORFs | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 1 | 1 | 124 | 507 | LLNEAVASKVLNSRLG WSAVGEYVELFNRTQ SRVAGLIPE | 40 | Hypothetical protein PPLUZ19_gp49 [Pseudomonas phage LUZ19] | YP_0016 71995.1 | 1e-14 (40/40) | | No putative conserved domains have been detected | | |
| 2 | 641 | 432 | 508 | MLSRQDRGERAWHQ QDAAWQRQIATWAAQ DHRHYAAPWRKRQAS QEYAVALTKHREALER SRHYGQPKG | 69 | No significant similarity found. | | | | No putative conserved domains have been detected | | |
| 3 | 1175 | 1528 | 509 | VGSRSVEFALSSRNNA STGSLETGLTHCQGIG RVRSQNDGRLQPSKR GTSHRRKGHGKLLGQ EPQCVRPAGITEGIDTV QDTRYSSHHLMATQQ KGLCQRTGRTNPRQRI DKTSASL | 117 | Hypothetical protein PT2_gp01 [Pseudomonas phage PT2] | YP_0021 17780.1 | 4e-31 (68/73) | | No putative conserved domains have been detected | | |
| 4 | 2012 | 2296 | 510 | MAHFKAKAPKSPFAAQ VAYWRDWEAKRTKLIA QDNVEGRKELRKMRD VRYATDPEPAPGRYHN PEQKAFVKGSEGKAR NILKGWNAKKSQGKGL | 94 | Hypothetical protein PPLUZ19_gp1 [Pseudomonas phage LUZ19] | YP_0016 71943.1 | 5e-48 (94/94) | | No putative conserved domains have been detected | | |
| 5 | 2296 | 2523 | 511 | MPRVNELTPRQRKAAK ARRDKARRIDLAHRMP KGADCPIFRKAEQAQA KQPRVDTLTTPRSAGY LAAAAYLNKSI | 75 | Hypothetical protein PPLUZ19_gp2 [Pseudomonas phage LUZ19] | YP_6016 71944.1 | 3e-35 (75/75) | | No putative conserved domains have been detected | | |
| 6 | 2534 | 3073 | 512 | MTNAISKTVIAFRGTEEI NRAIDAIRVRGKELDEA IQLTGLSIIHHIDQCGDV TVVKALYEAMPKGSRR NALVEWLVLHGKVQVN TDKKSNKDLPFLYNKF GKTDLVGATNSPWYSF KPEKALDQEFNLAAAL ATIKKQVLQAQTKGKVI VGMELLGDLEALAAKA APIAEQSKRAAAH | 179 | Hypothetical protein PT2_gp04 [Pseudomonas phage PT2] | YP_0021 17783.1 | 3e-100 (179/179) | | Hypothetical protein | PHA017 82 | 3e-72 |

Fig. 8A

| | | | | | | | |
|---|---|---|---|---|---|---|---|
| 7 | 3441 | 3809 | 513 | MQALNTLLIAIPKDPTA GMHAADKVLCAHGFR MGDLNTAHVLTPGGFV VVGAGVTVNRYDEAY RMSRNLDSEGFDVLLV QGSPLSGRVTCQAYG WINAEYHKGCANGRPI FDIAGTSYHVIA | 122 | Hypothetical protein PPLUZ19_gp4 [Pseudomonas phage LUZ19] | YP_0016 71946.1 | 2e-65 (120/122) | No putative conserved domains have been detected |
| 8 | 3796 | 4020 | 514 | MSSRDPYRIGHRVGLV NYSDRYLGADAAGTK GIIEAITRPSRCMTYH VRCERTLRLIEAEARNV RFIRQRAER | 74 | Hypothetical protein PPLUZ19_gp5 [Pseudomonas phage LUZ19] | YP_0016 71947 | 2e-34 (72/74) | No putative conserved domains have been detected |
| 9 | 4199 | 4459 | 515 | MTLVATVVDSAHNLEV DDLTAGNLYAASSPSG NMFIVVGNHNGRRLP VVLSSTDTRTIGDVISN TGFRYSEIAGFSVNLA QGDYD | 86 | Hypothetical protein PPLUZ19_gp6 [Pseudomonas phage LUZ19] | YP_0016 71948.1 | 9e-42 (86/86) | No putative conserved domains have been detected |
| 10 | 4459 | 4749 | 516 | MVTRTVYVTPEDPTPPI LSVGRLAPGELYKVVA PSSAEGIIVLATKQTPA LAQAAVVLHSMNPAQY PAGSAILNTAWKCRRL GVGEYVKLVQGEED | 96 | Hypothetical protein PPLUZ19_gp7 [Pseudomonas phage LUZ19] | YP_0016 71949.1 | 3e-48 (96/96) | No putative conserved domains have been detected |
| 11 | 4749 | 4988 | 517 | MAVAILILAVWLIGGALL FLPFDLVVSPRLPLSDE ALNRTALYTVLWPVTL PTLIAITVVVMLHSAYR GAIELYQEMKS | 79 | Hypothetical protein PPLUZ19_gp8 [Pseudomonas phage LUZ19] | YP_0016 71950.1 | 1e-27 (66/69) | No putative conserved domains have been detected |
| 12 | 4985 | 5278 | 518 | MIRTHTHNVERTPHRL YRHTELASGELYRVVQ PDSKRGTLVVGVAAW DSQGRPAVLPVVIHDD GDAKVTCARPTVLRND GWRMVLADKGTQVTL TAE | 97 | Hypothetical protein phiKMvp09 [Pseudomonas phage phiKMV] | NP_8774 48.1 | 9e-39 (80/97) | No putative conserved domains have been detected |
| 13 | 5357 | 5773 | 519 | MTNVNTTTETTTAAVL GAKLIKKPATVEDFRN NVVFHHSALTKLTEVY NEAVAALQTAERLSSL VAGDVITFDHGKGEKA EVLSGEVISVVAGVYQ VLVRFSDSAPAKLLDV KASAIRAVQSSAAQAA TLDEAIAQGE | 138 | Hypothetical protein PPphikF77_gp11 [Pseudomonas phage phikF77] | YP_0027 27830.1 | 1e-58 (114/123) | No putative conserved domains have been detected |

Fig. 8B

| | | | | | | | |
|---|---|---|---|---|---|---|---|
| 14 | 5842 | 6201 | 520 | MSKRNPEHINGTVRSV SVQKLAATQELEDRLE AALAVCQQRAEDIDLL SRRLQAAERARRWEID EIRNHQATIRLLQNDLN AAHDAHEAQERRARK ATIMAWVCLLTAGLAV TLKLAGV | 119 | Hypothetical protein PPLUZ19_gp11 [Pseudomonas phage LUZ19] | YP_0016 71953.1 | 2e-60 (119/119) | | No putative conserved domains have been detected |
| 15 | 6204 | 7013 | 521 | MQCKDLYTNLASGMF NVPCSQVTPEMRRVA KSRAFAHAYTPKKQAS GGTYTARVSGVTCDG GKVEVRLDNVERVSTF DYAELETRVAASLCQA DAKRAAEYEKILLLKAF PSVSPKDGPLSAKDFE LRLHDLCSTKLVVLRAL RDAGIEMDGPLRSRVR KLADRNNVMGAELFSL KQELAQLVAVGQKAGL NWDGAETQRLLTVAPT KALCRLISALTGVRYTH- HTVVAKAEAERERAK AEAKDSLQAATFAAAIA GGVVGSALMFLLG | 269 | Hypothetical protein PPLUZ19_gp12 [Pseudomonas phage LUZ19] | YP_0016 71954.1 | 3e-145 (260/268) | DNA polymera se | DNA_pol_A, DNA polymerase family A, 5'-3' polymerase domain | cd06444 | 5e-05 |
| 16 | 7284 | 7826 | 522 | MSKTSLYPLNLHPGLIQ IRTIHVFSIQAPSNAEN WWQWFLWQRKYHPL RESLSPAGELSASIAEC VLHLRRNGWQDSDIW RKKGGVLALGAFDLSG LMVGSCLVVGGELKAL CVDDRHSRQGIGAELV RAAELAGAEYLTCFEF LEPPYADLGWSTTHRE ANWTAGEPDVLHMRA PGHDV | 180 | Hypothetical protein PT5_gp14 [Pseudomonas phage PT5] | YP_0021 17736.1 | 6e-102 (180/180) | | No putative conserved domains have been detected |

Fig. 8C

| | | | | | | | | | |
|---|---|---|---|---|---|---|---|---|---|
| 17 | 8012 | 8836 | 523 | MALRRDSWLKQAQSL AVGQAGRFRHVLGCQ SMSRGGTNMTCKNLP DRWVAYCYSCQEGGV VEKTHVRRVQCADQE RFMPWPEDASDWTQA DCYQSLYGLLLSKGIDY NVMTPGLPLLYSERQH RLIFPTDAGWIGRATAD QNPKWVGYGYPAPDY HGWPQELSMGRPWVL TEDYLSALKVRWACPE VFAVGLNGTRLRDRLA AIMLQQTCKRAFIFLDG DRAGVRGSAGVMRRL RSLLIEGQVIPTPDGFD PKDLTREQIRSLVIGRI DASRTE | 274 | Primase [Pseudomonas phage LUZ19] | YP_0016 71958.1 | 2e-158 (271/274) | primase | Putative DnaG-like primase | PHA02031 | 6e-148 |
| 18 | 8805 | 10073 | 524 | LDVLTLHALSDRDRFR TLRSVVPEGMMGPET CFVIDWIEQYWKYYPA HQKVDPQALRELIKLR GGYQPEQLAVVLNLVN QLDKPVDPDSLQGVVS QLNELDFSGRVDALLA QYNQGEDIDLAYELRR LSDEALRRGGVSTPTD YYTDDVFDILAEEQGD HGIKLPGLVLPAYMKG LHAGASVLVAAPPDAG KTSFMAWIAVHIAPQLK RYFDPGRPILWLNNEG KGRRIKPRLYSAALGM TVGEILALDPEEVRRM YAEKIGGDSELIRIKDF HGGSLAQAEQVIDAMK PSVVFWDMMAHVKGG QRKDQNRTDEMEYKV AEVREMAVRHDFISFM TWQISNDGHDQLFPPQ SCLKDSKTAVQGAVDV QIHLGRLNGADQQVM RGLSLPKNKFQMDGK PSNVEAMINFDAARCR FFESVDHAS | 422 | DNA_B Helicase [Pseudomonas phage LUZ19] | YP_0016 71959.1 | 0,0 (395/397) | DNA_B helicase | DnaB helicase C terminal domain | cd00984 | 2e-06 |

Fig. 8D

| | | | | | | | | |
|---|---|---|---|---|---|---|---|---|
| 19 | 10063 | 10683 | 525 | MQAKHSRVLEGTKEIP LGSIEPLLGSVAGLLLC LYSDATHEEGVALAGG FPRDLMHGATPKDVDV ALYSMTWGRAEHLIQK ALPVLNPIFVRDGGWR SDYADGGDGGIFKGV MSLVGCRGLNGMDLD FNYYDADSLGRVMESF DFTINQVGIAYNWPDP EGGPRLGAYLHKDVT WGVNKEVGAGSRLPE RCEKMRAKAAYYGWE NV | 206 | Hypothetical protein PPLUZ19_gp16 [Pseudomonas phage LUZ19] | YP_0016 71960.1 | 7e-111 (196/206) | | Hypothetical protein | PHA01806 | 7e-92 |
| 20 | 10683 | 11630 | 526 | MSKRDVVLDIEKGIWR GVDQNDKAVEAIIKKN GYVIVEPKIDGCRAIVG AHGVVSRSGRRFPALD GLEDRIIERLARPGLDS GLVLDCEMYLAGMPFS EATGRMSSKTPLTEEE LECLHEAVFDATHIDVL RKARTSHLVYEERRAM ASSLLAACRLSDTPTFF QVGFTVCRRMSDVYR QYKFNREVGYEGSME KDPSLVYRNGKVAGCY KRKPGITVDGRIVGYV MGKTGKNVGRVVGYR VELEDGSGTVAATGLS EEHIQLLTYAHLNAHID EAMPNYGRIVEVSAME RSANTLRHPSFSRFRD LASNPGVKV | 315 | ATP-dependent DNA ligase [Pseudomonas phage phikF77] | YP_0027 27838.1 | 5e-159 (275/315) | ATP-depende nt DNA ligase | ATP-dependent DNA ligase | PHA00454 | 1e-99 |
| 21 | 11627 | 11911 | 527 | MKIRKSRNRNYPEDMV YHATNRDSLLYPKYVM GSVFISQDGTFRICVM AGTWDHVGSEVLHHA RDIQSLGAGRRKLHRV MRRLRRNLQQVGVKV | 94 | Hypothetical protein PPphikF77_gp20 [Pseudomonas phage phikF77] | YP_0027 27839.1 | 1e-46 (91/94) | | No putative conserved domains have been detected | | |
| 22 | 11908 | 12243 | 528 | MRMPTEEERTIRCLLA DIHEPLNLLFPGIRVKA ETMPLGWGDSICALVL RVSYEHLTLGRLEYMH EVPILHLSQWGRDGLL QHLMNEIPRRVLDGML RQAQKYSQSNWYSK | 111 | Hypothetical protein PT2_gp22 [Pseudomonas phage PT2] | YP_0021 17801.1 | 4e-58 (109/111) | | No putative conserved domains have been detected | | |

Fig. 8E

| 23 | 12240 | 14663 | 529 | MTTIRILDLETESYEHK GRKASPFDPRNYIVMA GWRDDVDGKVGQKVE HRFRSRAEAEDPNNR WFNLDGVDVIVAHNAM FESNWFFTRYRDEYLA FLRRGGRVWCTQQAE YLLSHQTWLYPALDEL APKYGGTHKVDGIKML WDQGVLTSEMDQDLL SEYLSGPCGDIENTAL VFYGQLMKLQARGMW AGYLERCEALIGFSAM ECAGLKVDLEVAKVNH AKQLEEVAGIEAELKKL MPDFPEYEFKYTSLY HMSAWLYGGEVRYKG RVPYEDGRMEKADFV RFGTAKRGTPIESTSV RVPIHEVTDQGEWHW PTITELATKHGPVITFSA GKNKGSVKVFREDTDI PATKWDDDQRFRFPG LINLTNLPEVVREKFLG KRPEFQCALTLADGSP VFSTSGDALKALEKQG FEAAKLLMRLAELHKD NSSFYITHTYNKDGTIK DTKGMLQYVDDDGIIH HSLNTTATATTRLSSS RPNLQQLPSKDEDDPE AGSRVKEMFVSRFGA DGMIGETDYTALEVVM LAALSKDRNLLAKLMA GTDMHLYRLAGKHNN WNGFDYDQLVAIKKDP NHPWHGRMMQARKNI KPKAFSAQYGASAAGI AFNTGCTVEEAQEFLD NEAALFPESIAFRQIVR DSAEATSLVMYKAEDQ MPAGAFSEMGPDGNW RQYRRGFWQAPGGTC YSFRQQERWDKEQRK TVMDFKDTQIANYWNQ GEAGFMMTVSVGRIFR WMLHRPGFMVTEFLIN NVHDAVYTDCHKDTAA EVNKGVRDIMADAARY MSERLGYDIADVPFPA | Putative DNA directed DNA polymerase [Pseudomonas phage phiKMV] | NP_8774 58.1 | 0,0 (806/807) | DNA polymera se | DNA polymerase family A, 5'-3' polymerase domain | cd06444 | 2e-20 |
|---|---|---|---|---|---|---|---|---|---|---|

Fig. 8F

| | | | VAEMGPNMFNMEVIQ | | | | | | |
|---|---|---|---|---|---|---|---|---|---|
| 24 | 14660 | 14971 | 530 | VKELHPLHTPEFVKTFL DQTGCLPGVRRTGRT TGIALQAIGMALSHPRE TLTFVDHPDGSAAALV ASIETILATLGYKNVLVR PTTRADGRSVSIVFKTL PNA | 103 | Hypothetical protein PPphikF77_gp23 [Pseudomonas phage phikF77] | YP_0027 27842.1 | 2e-52 (102/103) | | No putative conserved domains have been detected |
| 25 | 15026 | 16075 | 531 | MTQQLNALQAALALAN KAAETATIDMSETSTG GGGGRIFPAGTAMGR FCIYIELGDHAKEFQGK LKNPAPQIRLGFALWG DVNPQAGNPQSRPDD LFHTYEADGSIKPGLFR TFEMTLGNNEKSKTKL AFDKMNWSGQHTHFA QMLGQAFIIPIKRTKITK GNNAGKERNDIDWGGI MKPYNPVDGSPYNVP ELPMDLLQYFFFDAPT KETWDALYIEGTSDNG KSKNFLQETIRSATNFP GSALHIMLGGGDDLIIK PTSQAAGSNLPAVPNV AADAGVAAAPAVPAVP QAVAQTAPSVPQVANV AAPVVGTAEAQNVLPD VPQVAQTAAPAAVEVP AVPVVPAVPQV | 349 | Hypothetical protein PPLUZ19_gp21 [Pseudomonas phage LUZ19] | YP_0016 71965.1 | 0,0 (347/349) | | Hypothetical protein | PHA02030 | 4e-138 |
| 26 | 16075 | 17016 | 532 | MRLPSEEFLAGLSAQF DRSMAGGTLVCDADG PAYVAAATAKTLDTAL RRFWKLILEQQFLAHC TGTRVHLTAAGGAKAY RDTYPTMKPYQGQRK GKAKPALLEPLRRAVA DVHERGGAPEGIDVIL HTFFEADDGMMMDAY AMQDKAIIRSDDKDLR MTIYPYWEIDTACVSRI EGGFGYLKEAYTPSGQ FKLKGHGRKFFLAQWL GGDTADNIRGIDRFNG KLCGMKTAFDILHPITD EDEAIDMILEAYAKIKQ NPLAEAEVLWMRRTPT DNAAQYLLSRDLRPAF | 313 | 5'-3' exonuclease [Pseudomonas phage LUZ19] | YP_0016 71966.1 | 0,0 (313/313) | 5'-3' exonucle ase | 53EXOc, 5'-3' exonuclease | cd00008 | 0,006 |

Fig. 8G

| | | | | | | | | | |
|---|---|---|---|---|---|---|---|---|---|
| 27 | 17006 | 17446 | 533 | RQWIIELDAYHEALLQKRRESDYDE MTSEPKVYQIPRSQQRTFTLKLWAEQNKLCPLCGKPIDISVKGEAVMDHDHETGLVRGVLHRSCNTAEGKITNAAGSWGCKSMKYSDIIPYLRALLTYLEGPKHPLIYPLHKTDEEKHEAKLAKRRQAAAKRKAAMAVAKHNARNV | 146 | Putative DNA endonuclease VII [Pseudomonas phage phikF77] | YP_002727845.1 | 8e-81 (144/146) | DNA endonuclease VII | Endonuclease_7, Recombination endonuclease VII | pfam02945 | 8e-10 |
| 28 | 17443 | 18489 | 534 | MSKLRKQFTNEYLRNVYVELGLKKGAEHLTEHSRFGEVSRQCFRNWCIKLGFHDSRTRGMYAKKGAMHWLGRKAAEVVRKFPGAVGNVVGQGPKVLSLDIETSPIEGWVWSLWKQNVGLNQIKRDWTILSFCAKWMHSDEVIYMDCQGDPLDDMHLLVALHKLLDEADIIIVQNGKRFDVPKINARFFLNKMPPRPFKVIDTLIIAKQQFAFTSRKLEYMTHKACTIKKRLHGKFPGFDLWAACLQDNPEAWEEMRLYNIDDVRSMEELYILMRPWFVGHPNVAYFNDAEPTIRCPKCGDTDVKQEGWVHTQTGKYEHYHCGGCGGWSRGRYTRNTSEQRKALLSN | 348 | Hypothetical protein PPLUZ19_gp24 [Pseudomonas phage LUZ19] | YP_001671968.1 | 0,0 (346/348) | 3'-5' exonuclease activity | DEDDy exonucleases, part of the DnaQ-like (or DEDD) exonuclease superfamily | cd06126 | 3e-04 |
| 29 | 18499 | 18870 | 535 | MSLAFPDSYESTITTEPYRKGASLEERKVGKLPMHLVVEGFPLLKRELARMMQWAAEVKGYLPHDWKKMTVGEFKSAQHRHESKRLIDGPLDDESNLMHLVHEAFNAMAAAEVALMDREKGNE | 123 | Hypothetical protein PPLUZ19_gp25 [Pseudomonas phage LUZ19] | YP_001671969.1 | 2e-66 (123/123) | | No putative conserved domains have been detected | | |
| 30 | 18863 | 19213 | 536 | MSKICWCTRPHETDEGVRVIWAFNERGIIGVNYVTAYITPAMVSHRDWSDVILPDILREMAERLEREVKLVELRWFRAEILSCGEWRDYRAMTLEGAV | 116 | Hypothetical protein PPLUZ19_gp25.1 [Pseudomonas phage LUZ19] | YP_001671970.1 | 2e-60 (116/116) | | No putative conserved domains have been detected | | |

Fig. 8H

| 31 | 19222 | 21672 | 537 | SLAEAEWGPEDIGRVI ERR MDLIQQQIAHEEALVG AAQNDARIALEKAIAQG SIDRIPRARIMLMRMLPI VTEAIFAHQEAKAAGP AAKLRHLLRIIDAQDLA VMALRAGLSMLINYPTI TATKYYTHMGKILCREI EVRLAFKVNQPYYDRT LDYLKTSRTRSVRHIQK TMDALLDAVLPEEARID LPDGDYLRLGKFIGDPL IQCGLFEPNRFTGRGG TSVHLEPSPEAKEFLQ DPSAAMTWGGPGRSV MLAPPRPWNDWCDG GYYSAKAQKHHVLVRR TKHQTKRARQMQLRH LGRDKMPRVYEAVNAL QSVAYEINHDVYEIIER VFTSGGGVLGIPQRTY PDKPEFPLGDEWAKE NASEQELEAFNRWKR SVHRWYTGEREHTAK LREFAALYRVVREHHG KAVYFPMHVDSRGRM YYWGTPNPQGSDIAKA CLRFHEKRALGKRGLY WLKVHVANSLGCDKV YFDDRAAWVDERWDD FQRALDEGPENYPNLF PEDESPLCAIAGLLELR AAYASGNPEGYASGFI VHMDATCSGLQHYSAI LRDEIGGAYVNLLPPGL AKADIYSRVLGLVNESL ERDRAEGADGEARGY AILWDKAGLTRSLTKKP CMTLVYGTTFKGVVDH CLDYLDESGVEIPEGV PSYRLGSYMATLILDAI RETVPSAVFAMEWLQ RLARALPDASKDLHWT TPLGMQVFQSYPKTEE VRVRLRAEAVEYVTLY EAKDELDPVRNANGIA PNFVHGLDSSHLGLTA LACAAEGIPIQAIHDSM | 816 | Putative phage-specific RNA polymerase [Pseudomonas phage phiKF77] | YP_0027 27849.1 | 0,0 (799/816) | RNA polymera se | T3/T7-like RNA polymerase | PHA00452 | <1,0e-180 |
|---|---|---|---|---|---|---|---|---|---|---|---|

Fig. 8I

| | | | | | | | | |
|---|---|---|---|---|---|---|---|---|
| | 21845 | 22096 | | GTYAADVDRMHVHIRE QFIAMYSGPCVLVELA KQLGIEATPPRRGSLN LEAVRDSWAFFC | | | No putative conserved domains have been detected | |
| 32 | 22096 | 22569 | 538 | MATMKTHRPTVMSPT VEGSRTGKGTARPVTF TSQQIEWLEQTFPEHQ IGPGTTMEDIQFQAGR RDVVRAVRLRRRDAIA VELK | 83 | Hypothetical protein PPLUZ19_gp27 [Pseudomonas phage LUZ19] | YP_0016 71972.1 | 1e-40 (83/83) |
| 33 | 22569 | 22810 | 539 | MNKSIWRVHAKAGTPS ELQGLCWLAIQELEEF TLFRSKDDALNAMLDSI EGNDRTELLVFRDGQL AGGACIVFEDDPHVGP CVTAQWQYVLPRYRN TGVVREFIRELHRQAG WGQIPLVCWSHRESD SRYTIHYRRAKPYGQE SKEGAGQDHHRQTR | 157 | Hypothetical protein PPLUZ19_gp28 [Pseudomonas phage LUZ19] | YP_0016 71973.1 | 5e-88 (154/157) | Hypothetical protein | PHA01807 | 2e-70 |
| 34 | 22514 | 22810 | 540 | MGKKVKVKVLGKTIIGKL ADGLLGTDLSGAQSDA RKMEEQNRLMQQQAD QLARNQQVDLTAENVA QVDLGAMADATGTGT RRRRNQAGTGVSQTL GINY | 98 | Hypothetical protein PT2_gp34 [Pseudomonas phage PT2] | YP_0021 17813.1 | 2e-47 (98/98) | Putative structural protein | PHA01808 | 8e-14 |

Fig. 8J

| | | | | | | | | | |
|---|---|---|---|---|---|---|---|---|---|
| 35 | 22822 | 24354 | 541 | MKTTAAMLWEKLRDG SVESRAIEFAKTTLPYL MVDPMSGSRGVVEHD FQSAGALLVNNLAAKL ARSLFPTGIPFFRSELT DAIRREADSRDTDITEV TAALARVDRKATQRLF QNASLAVLTQVIKLLIVT GNALLYRDSAAATVVA WSLRSYAVRRDATGR WMDIVLKQRYKSKDLD EEYKQDLMRAGRNLS GSGSVDLYTHVQRKK GTAMEYAELYHEIDGV RVGKEGRWPIHLCPYI VPTWNLAPGEHYGRG HVEDYIGDFAKLSLLSE KLGLYELESLEVLNLVD EAKGAVVDDYQDAEM GDYVPGGAEAVRAYE RGDYNKMAAIQQSLQA VVVRLNQAFMYGANQ RDAERVTAEEVRITAE EAENTLGGTYSLLAEN LQSPLAYVCLSEVDDA LLQGLITKQHKPAIETG LPALSRSAAVQSMLNA SQVIAGLAPIAQLDPRI SLPKMMDTIWAAFSVD TSQFYKSADELEAEAE QQRQQAAQAQAAQET LLEGASDMTNALAGV | Head-tail connector protein [Pseudomonas phage LUZ19] | YP_0016 71975.1 | 0,0 (510/510) | head-tail connecto r protein | Head-tail_con, bacteriopha ge head to tail connecting protein | pfam12236 | 5e-103 |
| 36 | 24358 | 25326 | 542 | MTQPNDQQLPPGLAN LVANVPPAAAPTPSHV QVLPNPVIQPQAPVQP GQVGAPQQLAIPTQQP QPVPTSAMTPHYQPVA VPVAGQPVVPQAPAQ PAPVAPPAAGAVLPEN LEVPPPPAFTPNGEIVG TLAGNLEGDPQLAPSIS YLEAFSDKLDTVRAFG KAAENRDPRFIDEHYL KEVLGPAQAQHVINVA KGVLTYVDAQTKAVLN QTYAAVGGEAVLKQAA GVFNQHADPATKAAIG RLMDSGDAQAMQYAA KQIVAFAQGSGAVVQA TGQPLGAAAPALAALS | Hypothetical protein PT2_gp37 [Pseudomonas phage PT2] | YP_0021 17816.1 | 4e-174 (316/322) | scaffoldin g protein | Putative scaffolding protein | PHA01929 | 2e-92 |

Fig. 8K

| | | | AEQYRLEVSKLPLNAS EAEMAALRERRKAGM AQGI | | | | | |
|---|---|---|---|---|---|---|---|---|
| 37 | 25379 | 26386 | MSFLNDLTRPNYAGKN ADVDIHLEEHLGIVDKH FAYTSKFAPLMNIRDLR GSNVVRLDRLGNVEAK GRRAGEELERSRVVN DKWNLTVDTLLYLRHQ FDHODEWTQSFDMRK EVAELDGQELARKFDQ ACLIQVIKAAAMDAPVD LEDAFSPGVLEKLDLT GLTAKQAADKIVRMHR RVVETFIDRDLGDAVY SEGLTPMSPRVFSLLL EHDKLMNVEYQATGAT NDYKSRVAILNGVKV LETPRFATKAIAAHPLG RHFNVSAEESERQIAL FLPSKTLITAQVAPVQA KLWEDNEKFSWVLDTF QMYNIGARRPDTAGAI ELKGIGAFDITA | 335 | Major capsid protein [Pseudomonas phage LUZ19] | YP_0016 71977.1 | 0,0 (335/335) | major capsid protein | Capsid protein | PHA02004 | 3e-177 |
| 38 | 26483 | 27037 | MLLLDAVNVILRKIGEL PIPSMDETYPTMAIALP ELEDQRIQLLTQGWWF NTWWKHKLTPDPQGR INLPKDTLAFYPDSPDL QWDGLGVRDANTGDD RIGKSVEGRLVLSREW DRIPEIAQRVIAHQAAL AVYTHEIGPDETAQVIA QELQAYQNELSRMHT RSRPLNTQAKRSFSR WRRSLRT | 184 | Putative tail tubular protein A [Pseudomonas phage LKD16] | YP_0015 22825.1 | 2e-102 (183/184) | tail tubular protein A | Tail tubular protein A | PHA00428 | 7e-66 |
| 39 | 27040 | 29520 | MSYKQSAYPNLLMGV SQQVPFERLPGQLSEQ INMVSDPVSGLRRRSG IELMAHLLHTDQPWPR PFLYHTNLGGRSIAML VAQHRGELYLFDERDG RLLMGQPLAHDYLKAD DYRQLRAATVADDLFIA NLSVKPEADRTDVKGV DPNKAGWLYIKAGQYS KAFSMTIKVKDNATGT TYSHTATYVTPDNAST | 826 | Tail tubular protein B [Pseudomonas phage LUZ19] | YP_0016 71979.1 | 0,0 (821/826) | tail tubular protein B | | No putative conserved domains have been detected | |

Fig. 8L

| 40 | 29520 | 30065 | 546 | NPNLAEAPFQTSVGYI AWQLYGKFFGAPEYTL PNSTKKYPKVDPDANA ATIAGYLNQRGVQDGY IAFRGDADIVVEVSTDM GNNYGIASGGMSLNAT ADLPALLPGAGAPGVG VQFMGGAVMATGSTK APYYFEWDSANRRWA ERAAYGTDWVLKKMP LALRWDEATDTYSLNE LEYDRRGSGDEDTNPT FNFVTRGITGMTTFQG RLVLLSQEYVCMSASN NPHRWFKKSAAALND DDPIEIAAQGSLTEPYE HAVTFNKDLIVFAKKYQ AVVPGGIVTPRTAVIS ITTQYDLDTRAAPAVTG RSVYFAAERALGFMGL HEMAPSPSTDSHYVAE DVTSHIPSYMPGPAEYI QAAASSGYLVFGTSTA DEMICHQYLWQGNEK VQNAFHRWTLRHQIIG AYFTGDNLMVLIQKGQ EIALGRMHLNSLPARE GLQYPKYDYWRRIEAT VDGELELTKQHWDLIK DASAVYQLQPVAGAY MERTHLGVKRETNTKV FLDVPEAVVGAVYVVG CEFWSKVEFTPPVLRD HNGLPMTSTRAVLHRY NVNFGWTGEFLWRISD TARPNQPWYDTTPLRL FSRQLNAGEPLVDSAV VPLPARVDMATSKFEL SCHSPYDMNVRAVEY NFKSNQTYRRV MAFWLPLLAAGGMSAL QQGLANKEERNKIKAE NKARLKTDLDNLGAAA RDIANLGVMAASYRKQ AVASQVEAKRQGMLA GGSAEAQAGAFGVKG ASVDAVALDIEREVGE ALIQIDDNLDNQMWNL AEQAHSIQAQAKAGLL GQKSTTAGQRSPLVA | Internal virion protein [Pseudomonas phage LUZ19] | YP_0016 71980.1 | 2e-97 (181/181) | Internal virion protein | Putative internal virion protein A | PHA01547 | 2e-66 |
| --- | --- | --- | --- | --- | --- | --- | --- | --- | --- | --- |
| | | | 181 | | | | | | | |

Fig. 8M

| 41 | 30065 | 32761 | 547 | GLMSAGSLYASQYFKF GATPKGGN MAESQRASQELGINVG QTQLQPGQSARRGVR DSEVNYSGPSVGSQIL DGILGAGQQIAGKWFE HNVQQEVLRGERARM AGEAEEAVDSNVLAKP FVKGGWRKQDYRIAQ ADFSLKMQRFIANKGR EMTPEEFRKYLSQEAT HVLDSTEGMNPNDAL QALAQQQKAEEQLFG MQAKAYMDWSIDQAA RGFRTQGNSILAKAVQ AQATGDELSRQLSLEE AGLFYTNIMTSEDIPLE VRDKVGMQFLAASLD MNQRGIYEGLRDAGFL DSMSFDDRRALNGLYE KSKAQTRAKESMATLR ADADFQQRVANGAITD LAEVEAYSRGMVEEG RWSDAQAISFMTKAMT GLGNAQRMQGIMAAL EAGDINALHTLGTNVTE ALEQWDKMQAANGSS LTDRLVQGTQLGLRLG TFPKTYGESVGSAVRM IQAAKEGEANPELVNTL NSIFEQVASAQEINPSA GNVMLSGIPEAEQGAV AWALKQMKMGIAPAQ ALREFSANAEVVKQMD EFEKGQNTKAFKDNLG KQVNDKFVNNIFGRAW NMLTGESDLSNNEAVL SMYRRATIDEANWLAS DRKHAGLLTSDTGREA LLEIAAANVRNRTIQVG EGRNLKEGDLFSRRDS APLILPRGTTAEQLFGT NDTETIGTVLAEQHKP HVEGLLGYKSVVAFEY DRTRGSLLAVEYDENG VALDRTRVDPQAVGNE VLKRNADKLNAMRGAE YGANVKVSGTDIRMNG GNSAGMLKQDVFNWR | 898 | Internal virion protein [Pseudomonas phage LUZ19] | YP_0016 71981.1 | 0,0 (895/898) | internal virion protein, T4-like lysozyme | Bacteriopha ge_T4- like_lysozy me | cd00735 | 2e-10 |

Fig. 8N

| 42 | 32765 | 36778 | 548 | KELAQFEAYRGEAYKD ADGYSVGLGHYLGSSG NAGAGTTVTPEQAAQ WFAEDTDRALDQGVR LADELGVTNNASILGLA GMAFQMGEGRARQFR NTFQAIKDRNKEAFEA GVRNSKWYTQTPNRA EAFIKRMAPHFDTPSQI GVDWYSAATAE MAKQFKGRMTPKYPL DQVQLDEAQVQGGLD AVPTVGFDALTGGEIG ERNVAAGQRANAREL ERIVADQELPALDRAS ALWNQSTLVGRWVDA LQLDADLAANSTGEVD PNFDAGTYGVQALQAA GIQPTDNYLQIMARAG NAEDAAYLLSRIQRYE QDEQIVRDNPYWNFAV GMLDPAALAVDAVTFG AGRALRLGRAGMAAA GGAGQVGYVAGLDAA GADVDAGTYIVAGALG AGVGALLGSSAGRIAA EAPTQPHVPEVSAPTV GLPEVAMTAEEAAARG FKAGDVVDLLDEGTVL SRVSARVEQAEIPAIPR RDTAFGDELHSLSGRK LSEVLDHIKTHAEVPKP LQGIAAKVADTIRTLEG LGQRTAFRVVQGGDT ASSAFLKPGTAGIHST QGLDTLVQVRGSTAPG RVGTNPVTVLHEAVHA ATVGVMNAALRNPGA MSPKVAQAMQTLENV RGNVLNALKQDRAAG RQLSEFEETLLAGNSN TLANVKELVAWGLTDT RFQRTLNRLRYSDGGP GLWSRFVEGIRTLLGL RSDADTALSRVLAASE TIMEAMPGYTKAQAKW ANKGAPVTEEASLETIV RSTRERAREGAGFVN RFFSEADILAQPGEGA RRLLSRLIDDPVRRDG | 1337 | Internal virion protein [Pseudomonas phage LUZ19] | YP_0016 71982.1 | 0,0 (1327/1337) | internal virion protein | Virion protein | PHA02006 | <1.0e-180 |
|---|---|---|---|---|---|---|---|---|---|---|---|

Fig. 8O

| 43 | 36780 | 37535 | 549 | | 251 | Tail fiber protein [Pseudomonas phage phiKMV] | NP_877477.1 | 9e-144 (248/251) | tail fiber protein | Phage T7 tail fibre protein | pfam03906 | 4e-05 |
|---|---|---|---|---|---|---|---|---|---|---|---|---|
| | | | | FSTNDNAASYLRRYRN EFEGVVKSYDEMMAK AMAEQGVGLTARALNS RRAMAVRDQLNEQVT RELLRDREWTAYGS VRVDPNLPPTIKALADR SDEIHGLMGQRAREAG VRGFENFAPRPGYFHR SWNWSKMAQMDEAA PGLARRAISEAVFRGIP GLERADADTIAQAIVQR ARDRATGIRSEFMGAM GVADTAFIRQALEEAN VSQAKFDSIMAKIEQK QSDQGTVKYGKGRLS LDMTAEINHNGTVYRV QDLIDRDLDRLMENYA GSMSGRSALARAGMP GDSEIEAFIREYQREAA HLGTDKVQELTGQLRG VFGDFTGNVPREHQL GPVAQRASGLTSATML GFSGVYQLAELATMAH RQGVFNVMKAMLNSR LGDFVGAMRRDPDLA DEMQTVLGLNLANDIR MKPWKRQFDTFLVSQ DTFMDRFLHAGKQAVP VLNGMKFIHNWQSRM NANLTLNKYARAAQGD EAALRVLQQYGKDVD WTPVLARVRGYVTYR GRNARSMNWGAWSQ ADVNTVMNTALRIMDD SLLYGRVGQNSGFARS PVGQILGQFRSFVAFA HNKLLRGTYENSGVLG VASLLAFQYPLTALMM GAKAAINGKFDTSDEGI RKMAIDGIGYTAGLGFT ADMWGVITGHSRMSA PVFGLAEHSNEVFRGV KDLVTGDDPAAATGDI VNGAAGALPFVNVFPA TKLLLESIKGE VARFKNPETIHVADGV EAVFSLDFPFLRREDV FVQVDKILVTDYTWVD DTNIQLAVVPKKDQEV RIFRDTPAQVPDTQFS | | | | | | | |

Fig. 8P

| | | | | | | | |
|---|---|---|---|---|---|---|---|
| 44 | 37535 | | QGIPFLPRYIDANNKQL LYAVQEGINTANLALD GVLDAIRIAEEARRLAQ EALDAANEALRRALGF AEIRTVTEDSDIDPSWR GYWNRCITSEQSLTLT MQMEDPDEPWIEFSE VHFEQAGIRDLNIVAGP GVTINRLQNTTMQLYG ENGVCTLKRLGPNHWI IFGAMEDD | | | | |
| | 37975 | 550 | MRGIIAGVVASQIRRPK PVLTTITYPQSSSDRG GMTFHAIAGIIQDTVKF ADSKDLGSYEMLVRDA TLKSMVITLTEVKDSSV WSMGVLSAAIKSVVQF LTPVEEKSSLDMSIIHG EHKQSVIPYSRWAEAG SLSMGITEGKVYVP | 146 | Hypothetical protein phiKMVp39 [Pseudomonas phage phiKMV] | NP_8774 78.1 | 3e-76 (142/146) | | No putative conserved domains have been detected |
| 45 | 37965 | 551 | MYHSSTIRGEFDLEIVR PDGTVRQHLHFKNLIT DLALEAMSSKGVPSGG WTNMFAGTGNRTPVP ADVSLVAPVANASASL NYGNRAVWDSTTGEK VHTGTGTFRAGSFQG QSLAEVGIGRVVSELY SRSLIKDANGDPTTITV LVDEELRVTVTLRIAPP ASSEVKITMKGIEYTLS MRDRRTFRDLSPEPAA EFGTRGSLSWSAISAP DSNGQTKTANLSGDA GTGIIQVPAQSAQIMRI QPADANWTEGIQYLR WETPAGRELEIKLDPP LVKNSLERVDITVTHIF NRV | 292 | Putative tail fiber protein [Pseudomonas phage PT2] | YP_0021 17825.1 | 4e-164 (284/292) | tail fiber protein | No putative conserved domains have been detected |
| 46 | 38840 | 552 | MIQFKFGDYRTRVPFQ GARDRRDINDRSDYVD GGVAIQDPSQGLLYQE WHAELLEDGIIYLTPEK ERVTTRIGPGINEGVAS MAVTFDQNMNYVLVYT KQGEGFIDFFDSATEE. RNVMNLGPVDYIKTDL DDRRPEGSAWAQVLV CYTRQGNFYVRASSTR | 196 | Hypothetical protein phiKMVp41 [Pseudomonas phage phiKMV] | NP_8774 80.1 | 1e-70 (129/130) | | No putative conserved domains have been detected |
| | 39430 | | | | | | | |

Fig. 8Q

| | | | | FTEEELIVGTGKVTRPI VKCGMAANWRFQVLF RGRM | | | | | | |
|---|---|---|---|---|---|---|---|---|---|---|
| 47 | 39430 | 39735 | 553 | MSKKQTASAERLGLLH ELVCTAIERNFKWYMD NDIPIPASDIAAATKFLK DNEITCDPSDTINIDRL REEMRQAQAENRRIAL EGFIAGETDDEMERLY TH | Terminase small subunit [Pseudomonas phage LUZ19] | 101 | YP_0016 71987.1 | 2e-53 (101/101) | terminas e small subunit | Hypothetica l protein | PHA02046 | 9e-36 |
| 48 | 39745 | 41550 | 554 | MTPQERFQIAHEVRDM YPRFRDFCLDAMLFLG FKMTWMQLDIADFMQ DSPNKAMVAAQRGEA KSTIACIYVVWCITQNP ATRAMLVSGSGDKAEE NGGLITKLIMHWDLLAY LRPEARMGDRTSATSF DVNWALKGVEKSASIN CIGITAALQGYRADILIP DDIETTKNGLTATERAK LTRQSQEFTSICTHGKI LYLGTPQSRESIYNGLP ARGFLMRIWPGRFPTL DEQERYGDWLAPSILA RIARLEEKGHNPRTGK GLDGTRGWAADPQRY NEEDLLDKELDQGPEG FQLQYMLDTSLADEQR MQLKLRDLLFIDATHES VPEQVAWAADERFKLK FDAHRFPVIKPELYLPA LMAGGWAPLQQMTMF VDPAGDGGDELSYAV GGTLGPYIHVVSIGGW KGGFAEENLEKCIALAA RYGVKVIYVEKNLGAG AVGQLFRNHMRSIDPD TNKPRYEGIGVEDRQK SGQKERRIIDTLRPIMQ RHRLIFHVSAMDSDHV ACQQYPADKRNERSV FHQIHNITTDRGSLPKD DRIDALEGLVRELAPTL VKDDEAATRAREEAAK KEWLNNPMGYTKSVL RSLGMGRERRKGRPK GRRL | Putative DNA maturase B [Pseudomonas phage PT5] | 601 | YP_0021 17769.1 | 0.0 (597/601) | DNA maturase B | No putative conserved domains have been detected | | |
| 49 | 41547 | 41747 | 555 | MMILDTATEAGKGTLAV | Holin [Pseudomonas phage | 66 | YP_0016 | 2e-29 | holin | No putative conserved domains have | | |

Fig. 8R

| | | | | LUZ19] | 71989.1 | (66/66) | | been detected | | |
|---|---|---|---|---|---|---|---|---|---|---|
| 50 | 41744 | | TGVGIAVYSPYEIASLC AAVLTALYVGAQLITLL PKMLDSIAELRRRFKK | | | | | | | |
| | 42226 | 556 | VNKPLRGAALAAALAG LVALEGSETTAYRDIAG VPTICSGTTAGVKMGD KATPEQCYQMTLKDY QRFERIVLDAIKVPLNV NEQTALTFFCYNVGPV CTTSTAFKRFNQGRAT EGCQALAMWNKVTIN GQKVVSKGLVNRRNA EIKQCLEPSSQYSSLL W | 160 | Endolysin [Pseudomonas phage LUZ19] | YP_0016 71990.1 | 2e-89 (159/160) | endolysin | Endolysin_ autolysin | cd00737 | 5e-34 |
| 51 | 42184 | | | | | | | | | |
| | 42513 | 557 | MPRTIVAILVLAVVALG ASYGFVQSYRALGIAQ EEIKRQTARAEALEVR YATLQRHVKEVAARTN TQRQEVDRALDQNRP WADRPVPAAVVDSLC NRPGARCAVRTPTD | 109 | Rz protein [Pseudomonas phage LUZ19] | YP_0016 71991.1 | 2e-55 (108/109) | lambda Rz1-like protein | Phage lambda Rz1-like protein | PHA020 47 | 3e-32 |
| 52 | 42603 | | | | | | | | | |
| | 42917 | 558 | MANTREQYLAGRNTG LTFYQVCQPGTDNRIA LHDMDEADVKAKATAV IAAATALGGEGGATPP DPLTAYKVKNGDTLPV DGGGSVKVTVANGAIT KVVYTAPAG | 104 | Hypothetical protein PT2_gp53 [Pseudomonas phage PT2] | YP_0021 17832.1 | 2e-52 (104/104) | | No putative conserved domains have been detected | | |
| 53 | 42967 | | | | | | | | | |
| | 43212 | 559 | MATFAAATQKDLRAFA GAIENLIRPLEEAALGS GFTEVITITKGTDGNET RTSERKVRPELVANLD ALMAAVETAKAAVYK | 81 | Phage particle protein [Pseudomonas phage LUZ19] | YP_0016 71994.1 | 1e-36 (79/81) | phage particle protein | No putative conserved domains have been detected | | |

Fig. 8S

Table 9 - Features of phage F44/10 gene products and assignment of putative functions.

| orf | Start position | Stop position | SEQ ID NO.: | Aminoacidic sequence | Size (aa) | Name[organism] | Acc No | E value and identity | Predicted function | Name | Acc No | E value |
|---|---|---|---|---|---|---|---|---|---|---|---|---|
| 1a | 467 | 1 | 561 | MKKIYILEEEIEEMDYDLWEEDT VYTTSYEVLGYTDSLEDAEYIK NNYGTSNPIFINEYPYLTKDKLI EEQRYRYNSAIELKRVDGYFE VYEINDLNVTECFSINKDDISFD CPFSIDMFSSDRNSIFIEFMMY SEYDNKKDTIEKENSFLMK | 155 | hypothetical protein KgORF8 [Staphylococcus phage K] | YP_024439.1 | 2e-62 (131/155) | | PHA02241, hypothetical protein | PHA02241 | 8.06e-17 |
| 2 | 689 | 471 | 562 | MKKIINFLVDYNINFSYSEDSLN VMGNSYLVDKHGTQDYEIIGNY GHITGVFSYQTEEEVIAKLKNLI GVWE | 72 | ORF201 [Staphylococcus phage G1] | YP_241058.1 | 3e-31 (68/72) | | No putative conserved domains have been detected | | |
| 3 | 884 | 690 | 563 | MRDKRIHSELLYNIIGKHIQEEE NITPYIEAIYVDIMNIIVVEYTFYN ENGTRMLGQYPIGEVM | 64 | ORF218 [Staphylococcus phage G1] | YP_241059.1 | 7e-28 (62/64) | | No putative conserved domains have been detected | | |
| 4 | 1611 | 874 | 564 | MNLEKSFLLSTIEFGSTYQGTS DEYSDKDYMSLVVQPLSDTIFR NSEKASKHTEVSRYYAVERFIS LVLKSGFDNVLNLCAQLEQAKN TRFNKTVLDLFYDDFIFLTYVRA NFKPIAYSVIGNINNILKKEELAG KDLVKFYTFYNHLEYYNDLLDD LDNLNVSYKDFAKVKYMPKEVL DNKRSNVSIENKKDLVTKVEPLI QEVKDKLKSNESNIKHYKDAM ELVEKSLKDKTVSFLTEVYNER | 245 | hypothetical protein KgORF9 [Staphylococcus phage K] | YP_024440.1 | 1e-124 (238/245) | | No putative conserved domains have been detected | | |
| 5 | 1778 | 1674 | 565 | MKYILGLITLGVILFKIYEYFKYIQ DEVDTTEDI | 34 | ORF437 [Staphylococcus phage G1] | YP_241061.1 | 9e-08 (29/34) | | No putative conserved domains have been detected | | |
| 6 | 2027 | 1800 | 566 | MDFYQFLNHENVRVNSITPSQ KNFIRENIDYTNLDTVDIDFMNS KQAKKEIEKIIRTKNEEEYDMA MDALSGWEG | 75 | gp ORF020 [Staphylococcus phage A5W] | ACB89011.1 | 4e-29 (61/73) | | No putative conserved domains have been detected | | |
| 7 | 2415 | 2029 | 567 | MFGKAPEHIMEIIDKEDNILGED LTLNIDYKGINLTVKRHPHSGHL NGYINVPTNITKEQFNSIEDCSH GGITYDEHEGDYRVLGFDCAH YSDMTPYAVISFSDSYYRDLKY VLNTLKDMADCLKEGE | 128 | gp ORF021 [Staphylococcus phage A5W] | ACB89012.1 | 4e-39 (79/130) | | No putative conserved domains have been detected | | |
| 8 | 2685 | 2512 | 568 | MEKVNHEFLAELAKSNSPVLNS | 57 | ORF245 | YP_241064.1 | 3e-26 | | No putative conserved domains have been detected | | |

Fig. 10A

| | | | | | | | | | have been detected | |
|---|---|---|---|---|---|---|---|---|---|---|
| 9 | 3208 | 2726 | 569 | KPLQDGDYNIEFDYDGFHFEFS QKNGYWQWKYNAK MANEKELIRMVNYLIDNMSMW HINYARAVLIPSEVEKIIKEHEKF DDLLKKRGEWLVKGSDTDNID DLETYNQIMNNQKDEMMIQEID IYTQGKTIKVDNKHYSSNELNE VINKIEQSEDIKIKSNYKLLCIDY TKVIGYEVTYASSYEEKFKNDL EKDL | 160 | hypothetical protein KgORF11 [Staphylococcus phage K] | YP_024442.1 | 5e-78 (144/160) | | PHA0224, hypothetical protein | PHA022 43 | 5.15e-24 |
| 10 | 3800 | 3258 | 570 | MDRRIGKHNLTQDLRLGDKVEV YDAHKFKENEDGTIELGDKVTE GIVVDYKGDFTGNTSGLVTLDS SEEELIIGEHNFKLIEEGNLQAV YDSVSKNKVESLSEDYDMYRK LLGVKSGELEDISYELERLIMEY NKKVDNYNGLLTLSKEKARELS LLTGDRKMIPHMKNKRLELGTE ADF | 180 | hypothetical protein KgORF12 [Staphylococcus phage K] | YP_024443.1 | 1e-188 (166/180) | | No putative conserved domains have been detected | | |
| 11 | 4333 | 3800 | 571 | MVYDSIISRTMAVSILNKWIAELI TDVDLDKCKFTEEEYGKVVTN SINKIQDVLIEKNYEVTDGELYDI VCTELINPIKNNTEEEKHNEKN DLLEHLEDLAFRHDIDLGYVSD GSYNLTVTHWLMQDEFTDVNI KVNKDEDFYTITIPESKYFWLPI TKENLEMFLTQDPINKGEIE | 177 | hypothetical protein KgORF13 [Staphylococcus phage K] | YP_024444.1 | 1e-95 (173/177) | | No putative conserved domains have been detected | | |
| 12 | 4500 | 4336 | 572 | MKNLIKFLSMVVVTILTFSLTYVI LKKETNNKRNGVAPFDFSLED HIHLNKEIK | 54 | hypothetical membrane protein MbpP [Staphylococcus phage A5W] | ACB89017.1 | 5e-20 (50/54) | Membrane protein MbpP | No putative conserved domains have been detected | | |
| 13 | 4781 | 4503 | 573 | MVNNIWAVVLSIIILLIILLWFLF RKKVNGGSSKNVEIQKAEEGN DNKEQEVEEAQYRELNEEEKE KNENSSKDYKYDKEKVKNKLK ELE | 92 | hypothetical membrane protein MbpR [Staphylococcus phage A5W] | ACB89018.1 | 5e-24 (89/92) | Membrane protein MbpR | No putative conserved domains have been detected | | |
| 14 | 5626 | 4781 | 574 | MGRRLIDNSELNVIKYDGLPDF FSALKKNRVSGRENSSDTGSY DFTGTHSFQEAYNLMVKGDRE SYDMVVKLKKMTDALFRMDKS VKRKPVVAPEGYQPHVPNAIK GLPNSMMSQQRVKAEKKVIDV FYNSSISWMEDPENLAYRGAIM LSAIQTLETKGYSINLYLGKLSN SEYENKLTGFVVNIKHSYQRLN VFKSSFYLVNPSFLRRISFRVLE | 281 | hypothetical protein KgORF14 [Staphylococcus phage K] | YP_024445.1 | 5e-160 (277/281) | | No putative conserved domains have been detected | | |

Fig. 10B

| | | | | | | | | | |
|---|---|---|---|---|---|---|---|---|---|
| 15 | 6756 | 5638 | 575 | VEPDMVDLTNHGYGSVVSKSS YGNKLTEHILDNAVIFDSSIGIDI NNDSSENLRAVKKLFGGRL MAKQDTIERLERLVEQOMETT ADLAKKLGEKNSNPYEQAIVDA IVEKAGTESREIIITDVKKQIEEY VEEQLSNLPVKIELQQEGKTIK DISGIFHYRYQDILKLVNQNIPV FLKGGAGSGKNHVLEQVAEAL DLDFYFSNAITQEFKLTGFIDAN GKFHETQFYKAFTKGGLFFLDE MDASIPEVLLILNSAIANKYFDF PIGRVTAHEDFRVVSAGNTMG TGADHIYVGRQQLDGATLDRF AQVEFDYDTKVEHQLSSNEDL VNFVQQLRHENDEKGLPYVFS MRAIINGSKLDGVMEDEFVVES IIFKSVPKDEINQFISSLPEGNRY TEATRKLLGMQQEPKQEPRKS NSTSKDSMDFDTIMDKLGLE | 372 | ORF15 [Staphylococcus phage K] | YP_024446.1 | 2e-109 (193/194) | ATPase | ATPase-like protein | PHA022 44 | 2.63e-175 |
| 16 | 7233 | 6907 | 576 | VSKRTDNFIYFCKYYFSEYLPS LGVEVLNHNETSHGTMEGVRK YYIANILYEGQELTVTIDLEEFN NATSMHNMLEIMNSHTYNCMF MYDMDTHGTKDIDDFFKLMYF | 108 | ORF134 [Staphylococcus phage G1] | YP_241072.1 | 3e-55 (105/108) | | No putative conserved domains have been detected | | |
| 17 | 7642 | 7226 | 577 | MNAKEFMKTQAQVEDYLDKLK VTIIEDALSVSKEWSNDSNDLG YALSSLGESIGILLEDYNIQVDA HLPEHYKGSKDVISFLEEHFSY DGFVDSMIFNIVKYTTRLGRKD AVDKEVQKIKTYYVRLERNIKY GDSTRV | 138 | hypothetical protein KgORF16 [Staphylococcus phage K] | YP_024447.1 | 2e-74 (138/138) | | No putative conserved domains have been detected | | |
| 18 | 8077 | 7775 | 578 | MEKVELIKQWAKDRNLQTGKP EGQMLKLLEEAGELASGIAKSN DHVTRDSVGDIFVVLTVLCLQL DIDIEECIDMAYDEIKERKGKLIN GVFVKEEDLKK | 100 | hypothetical protein KgORF17 [Staphylococcus phage K] | YP_024448.1 | 2e-49 (99/100) | Pyrophosph o-hydrolase | MazG | pfam03 819 | 4.19e-03 |
| 19 | 8265 | 8077 | 579 | MEKFQEDYVNIDIRVKAYVRVG YRYEEDITNNLHELVEDNLNVT SDSDNLIIKDTEIKGDIE | 62 | ORF228 [Staphylococcus phage G1] | YP_241075.1 | 2e-26 (62/62) | | No putative conserved domains have been detected | | |
| 20 | 8470 | 8309 | 580 | MVKPVITLEPEDVKVLLDYLSFL EDDMRNYEGMRELYEELHKKY QLAKGNYSD | 53 | ORF259 [Staphylococcus phage G1] | YP_241076.1 | 3e-22 (53/53) | | No putative conserved domains have been detected | | |
| 21 | 10518 | 8470 | 581 | MAITYKQKGLTEQEIINLPKVNK GCIYIGEEDVFLKKKKNNIINLG | 682 | hypothetical protein KgORF18 | YP_024449.1 | 0.0 (639/682) | | No putative conserved domains have been detected | | |

Fig. 10C

| | | | | | | | | | |
|---|---|---|---|---|---|---|---|---|---|
| 22 | 10596 | 10859 | 582 | SKELFRDIHNIFSFDTATEIHLFL ALCGNKEVTNFEGDPYETVEK LVEGVIGNNKGRNYKEYIEADR GERKDFPLYGSRRRKQIQSKG YVEEKIKELENENRLWGYEAR QLDEYKEAVDSLNNDIMDVLD QGKYVLINSSIVMNEDIEKGSS EYYKEMSDSLYSRWVMHPST ENNSSFGLKVRHIRDKIHNMGN KWVLENKSSFDVKTGAVKVFL TDSLVNKEIALNLYKDDISKSEY KNELTLSVLLNVILKNYSQPNLN RGIIIKIIEQTLEHHNFDFSSWCP DNIDVYGHINYRGDKYRIFIGEN STSNYLITLTDIVKNIDKINNLEE FGLFERNALLFHIPKNPKWKVH EAFNLTKQTYKKLLTLNKFEQG NYLRFANTLYKNYNHLHNEVNL HQLFDDTFLMVRDSRDVTNAL KVKPIVNEILSISFANYKKMTHY LDVDAQDRQRITGYALDNYYLD YLHDLSILIREGYRTLESVNLTP FSLKLEHDIVTDEKQSIQQQLD DAELKAKYDNKLEKIIDKTYKLK DGRKVKFLPADTVSKLKDEGK MLSHCVGGYANRILKNSCLILL ARLEEDLDNSWFTVEIRITDNG YVLGQQQSIDAYKLPNELKEAL EKDIKKINKEEFKEVA | [Staphylococcus phage K] | | | |
| | | | | MSIEKKEEIIAHNEVVFRSLTQG LYVKEVDIYSDVVSYTKDVDEA LAMPNTINFKNSRKYEKLIRNLD LEPLNKIQKVIYETHLEEL | 87 | gp ORF038 [Staphylococcus phage A5W] | ACB89029.1 | 8e-41 (85/87) | |
| 23 | 11049 | 10876 | 583 | LNDLIKEGNKYYHKVRAGETLW TISKNYDVEIKKLQELNNIKSVS LTNLEYVLVCVE | 57 | gp ORF039 [Staphylococcus phage A5W] | ACB89030.1 | 9e-24 (56/57) | Peptidoglyc an binding protein |
| 24 | 11634 | 11056 | 584 | MDNLSHYLSILYAILVTVGYIPG LIALVKSDSVKGVSSYFWYLIVA TVGISFYNLLLTDATMFQVVSV GLNLTLGIVCLLVASYRKKDYF SIPFIIVFSLLLFLLSDFTALTQTV ATITILAYVTQITTFYKTKSAEG TNRFLFLIIGLGLASLIVSMVLTH TYVHIIATEFVNFVLILICYLQAN YYSRR | 192 | gp ORF040 [Staphylococcus phage A5W] | ACB89031.1 | 13-93 (183/192) | |
| 25 | 12250 | 11627 | 585 | MVNKIKDKVIYMGGHILNEAMV DYRDKQHKEVDGIVGVTPYSP | 207 | hypothetical protein KqORF20 | YP_024451.1 | 6e-92 | |

Additional conserved domain info (rightmost columns):

| Row | Domain | E-value |
|---|---|---|
| 22 | No putative conserved domains have been detected | |
| 23 | LysM | pfam01476 / 5.26e-06 |
| 24 | PHA02246, hypothetical protein | PHA02246 / 6.35e-42 |
| 25 | No putative conserved domains | |

Fig. 10D

| | | | | | | | | | have been detected | | |
|---|---|---|---|---|---|---|---|---|---|---|---|
| 26 | 13139 | 12243 | 586 | HKDKSINDKANAEQTKLAERILT NDFKAMQESDIFVDVLNEGLG TIAELGILLGMKHQAQETIKQLK EQSELFKFNEIDELSETYDILQG QIGEQEYILKKPVLIYCSDIRQG HGKPYNDPDRAEFSTNQFVYG MVLELTNGEGFISWEEVTNRLE KLGEQDG MKSYTKVKNKGIVLDKFKERGL VVQEKLDGSNASFTVENGELV CFSRRKKLNENETLNGFYDWV HENINVRNTYVSALEKYIIFGEW LVKHKIQYKEEFYNNFYVFDVY DKENEVYLSIEDMNVIAHHLGL KTVKTLLVAKPSHYLNDLKPEEI QELVGKSDMTVKPDKGEGIVIK YLDGKSEYDDYFKLVSNEFKEF SRQKMKTEVKKNESVADYAITR ARMEKMIFRAIEEDRLSEDDLE LENFGLIMKQVGQNFVDDIMEE EKENILKIVDKQIKKKMPHILREI LEEKGDTIDG | [Staphylococcus phage K] putative DNA ligase [Staphylococcus phage K] | (172/209) 5e-169 (296/298) | DNA ligase | ATP-dependent DNA ligase | COG14 23 | 9.05e-03 |
| 27 | 13363 | 13139 | 587 | MNYLAKVFINNNWLVKLITIVLL TLFLSGLVYVISAISLFLSTVLNL PGLVVLAFLASVSLILFSIVHNS KEDN | No significant similarity found. | | | No putative conserved domains have been detected | | |
| 28 | 14172 | 13432 | 588 | MAIQLKELDFKLKDYPNVRYNM GEHLIFNEFLEKATTEQLDFCE DFFNDNVEILWNESQAGTGKT MCSVACAYADYLNKNRKLVFII SPVSEDLGSRPGNQTEKEMAY FMGLHDALIELNMNPEQQITEM LMMEDNVKEDKLGDCWVSQIS HLFLRGGNLRDATIIINEAQNFK RSELKKVLTRVHTKNSTVIVEG NFKQIDLKNESKSGFGDYMEY FKNYEGAVFHNFTVNFRSKLA QYADNFKW | putative PhoH-related protein [Staphylococcus phage K] | 8e-144 (245/246) | ATPase | PhoH-like protein | pfam02 562 | 1.46e-21 |
| 29 | 14838 | 14224 | 589 | MKKINSVIKGEGKKVQTADVRK ISYYVKDYNPCMTVDDANDYN ATSQYLVSDNGKFIAKYNKDM NAVGFYEESGDTVKHLTHTTP ERLEGTVFTIEEETEIDLINDTLP QGDILIKFSDGSIYLPDNESVLD SVNYLADNDWDSVDDIIYTGLS KGNSENCIVDFNYNNYDIGYDD VEDEDVCDNYPECECSNYCSS | hypothetical protein KgORF23 [Staphylococcus phage K] | 3e-113 (204/204) | | PHA02248, hypothetical protein | PHA022 48 | 9.28e-98 |

Fig. 10E

| | | | TGEYIGN | | | | | | |
|---|---|---|---|---|---|---|---|---|---|
| 30 | 15279 | 14854 | 590 | MQDSVNIYTDGSSSYNKGKVG SGAVLVSKEGNIISEISKSVDKP GLIKYNNVAGEILACCYGIEEAI KLGYNQAIVYIDYIGLIHWYEGT WSARNILSKTYINMIREYQKVID INFVKVKSHSNDKWNDYADNL AKKSIDI | 141 | putative ribonuclease [Staphylococcus phage K] | YP_024455.1 | 5e-74 (141/141) | Ribonuclease | RnaseH | cd06222 | 4.11e-18 |
| 31 | 15460 | 15269 | 591 | MKKGVFTVIADGFKFNVIAKDK KEVQEHCFKCFDFNYISVSFCR EVYSDCEFPQFMEDYKYAG | 63 | ORF222 [Staphylococcus phage G1] | YP_241086.1 | 1e-28 (63/63) | | No putative conserved domains have been detected | | |
| 32 | 16124 | 15483 | 592 | MENNNLVNFLMTTDDIDDTIEM VDSFELQDINKVLGEDTFLTIME ITDSLPDNQYKIVLLSSLDKLLN TDRKELVEYDEEFPTIRKHNVS ELKRDTVNSVIDSYMNTNIEILY TEYPTISNYSVVVDSVKVLNTL YLIESKNGKIEATLSEDGEDLHE YISEEGYSVTDILNKFDDVEDLF DEDDSLINFFSDIDEGKNKTIKS FIELVINLK | 213 | hypothetical protein KgORF25 [Staphylococcus phage K] | YP_024456.1 | 7e-113 (212/213) | | No putative conserved domains have been detected | | |
| 33 | 16344 | 16114 | 593 | MDEKKESKPLNLQKIRVEKGHT LRSLASEIGVHYSLISYWEYGK KKPRSANLMRLEKALNTPGKEL FKELEEDDGE | 76 | ORF187 [Staphylococcus phage G1] | YP_241088.1 | 5e-36 (76/76) | DNA binding protein | HTH_XRE helix-turn-helix XRE-family like proteins | smart00530 | 4.91e-08 |
| 34 | 16574 | 16347 | 594 | MNKFKRWFRINVLKKETLLFKV YWRYESPSLKKPHVFHIELYAK SKAEARNKSQEYILKNAKESED FKFLKVEEK | 75 | ORF190 [Staphylococcus phage G1] | YP_241089.1 | 6e-34 (74/75) | | No putative conserved domains have been detected | | |
| 35 | 17375 | 16683 | 595 | MKKTIFATLALGTAITFGGIATN EASADEIDYNKLAEQAKSNSAE VNTKPIQEGNYDFSFSDGEFTY HFYNYNGNFGYEYHSGSTQVD NTVSRLAGEEQTPEQKVDQQQ AQFDTQNKQDTKKEVQTTSAP VQKETKQPTQSTSSTGGSVAE QIRQAGGDEAMIEIAMRESTMN PNAVNASSGAQGLFQGLGKS WSGGSIAEQTKGAKQYMIDRY GSTSGALAYHNAHSY | 230 | hypothetical protein KgORF26 [Staphylococcus phage K] | YP_024457.1 | 1e-130 (229/230) | | LT_GEWL - lytic transglycosylase and goose egg white lysozyme domain | cd00254 | 4.34e-03 |

Fig. 10F

| | | | | | | | | |
|---|---|---|---|---|---|---|---|---|
| 36 | 18367 | 17573 | 596 | MRKSVVISGVLGFLAIIGFIILLM CITKIPQGHGVGVVYSVNGVKED TKSPGWHLTAPFDKVNKYPTK TQTHKYKDLNVATSDGKNLQM DIDVSYKVDATKAVDLFNRFGS ADIEELEKGYLRSRVQDNVRQ AVSKYSVIDAFGVKTGEIKKDTL DSLNDNLEKQGFVIEDIALSSPK ADKNTQKAIDSRVKANQELERT KVDKQIAEQNAKKKEVEANGD KKANEIRESSLSDKILRQQLIEK WDGKQPIQIGGDGTIVDVTGK | 264 | hypothetical protein KgORF28 [Staphylococcus phage K] | YP_024459.1 | 2e-133 (229/261) | | Band_7 domain of flotillin (reggie)-like proteins | pfam01 145 | 5.79e-24 |
| | | | | | | | | HflC, membrane protease subunits | COG03 30 | 1.86e-13 |
| 37 | 18675 | 18367 | 597 | MALLLTYFAIFIVFLVLVGFGISY LFDFLSMKEKKSNIRKQYRELV RQGTLDEYGLEQYVKYKKQFL NDRRQSIVTRADKQEIDQEEKA LNSLIKEIEKGEM | 102 | hypothetical protein KgORF29 [Staphylococcus phage K] | YP_024460.1 | 1e-50 (102/102) | | No putative conserved domains have been detected | | |
| 38 | 20276 | 18789 | 598 | MAKTQAEINKRLDAYAKGTVDS PYRVKKATSYDPSFGVMEAGAI DADGYYHAQCQDLITDYVLWL TDNKVRTWGNAKDQIKQSYGT GFKIHENKPSTVPKKGWIAVFT SGSYEQWGHIGIVYDGGNTST FTILEQNWNGYANKKPTKRVD NYYGLTHFEIPVKAGTTVKKET AKKSASKTPAPKKKATLKVSKN HINYTMDKRGKKPEGMVIHND AGRSSGQQYENSLANAGYARY ANGIAHYYGSEGYYWEAIDAK NQIAWHTGDGTGANSGNFRFA GIEVCQSMSASDAQFLKNEQA VFQFTAEKFKEWGLTPNRKTV RLHMEFVPTACPHRSMVLHTG FNPVTQGRPSQAIMNKLKDYFI KQIKNYMSNGTSSSTVVKDGK TSSASTPATRPVTGSWKKNQF GTWYKPESATFVNGNQPIVTRI GSPFLNAPVGGNLPAGATIVYD EVCIQAGHIWIGYNAYNGNRVY CPVRTCQGVPPNQIPGVAWGV FK | 495 | putative lysin [Staphylococcus phage K] | YP_024461.1 | 0.0 (491/495) | Endolysin | CHAP | pfam05 257 | 1.22e-15 |
| | | | | | | | | SH3_5, bacterial SH3 domain | pfam08 460 | 2.54e-14 |
| | | | | | | | | N-acetylmura moyl-L-alanine amidase | COG56 32 | 7.60e-05 |
| 39 | 20779 | 20276 | 599 | MANETKQPKVVGGINLSTRTKS KTFWVAIISAVALFANQITGAFG LDYSAQIEQGVNIVGSILTLLAG LGIIVDNNTKGLRDSDIVQTDYV KPRDSKDPNEFVQWQTNANN ASTFEIDSYENNAEPDTDDSDE | 167 | putative holin [Staphylococcus phage K] | YP_024463.1 | 6e-89 (162/167) | Holin | Phage_holin_1 | pfam04 531 | 3.49e-25 |

Fig. 10G

| | | | VPAIEDEIDGGSAPSQDEEDTE EHGKVFAEEEVK | | | | | |
|---|---|---|---|---|---|---|---|---|
| 40 | 21049 | 20864 | MASAKQLYYTESLVGKAIINNK VSNKEEVWDKLELLPETKLEDL DNKQMSEVIKKLNQINE | 600 | ORF233 [Staphylococcus phage G1] | YP_241098.1 | 9e-26 (61/61) | | No putative conserved domains have been detected |
| 41 | 21282 | 21211 | ACACCCUUAGUAUAAUUAGU AGUACAAGGGUCUCCAAAAC CCUUAGUCUUUGUGCAAAUC AAAGAGGUGUG | 601 | | | | tRNA4-Trp | |
| 42 | 21361 | 21289 | GGUUUCUUAGGCUCAGAUGGU AGAGCACUAGAUUGAAGCUC UAGGUGUCAUUGGUUCAAAU CCAAUAGAAACCA | 602 | | | | tRNA3-Phe | |
| 43 | 21441 | 21368 | GGCUCAUUGGUGUAACUGGU UAACACUGCCCUGUCACG GCAGAGAGUACGAGUUCGAG UCUCGUAUGGGUCG | 603 | | | | tRNA2-ASP | |
| 44 | 22812 | 22594 | MKRQKMFYSSLICKECGNVFK VPRKRANKREEGHIKDYCIKC CKTTKHIEDNRSEAERRWDAIQ EELTKDN | 604 | ORF200 [Staphylococcus phage G1] | YP_241099.1 | 8e-35 (72/72) | | No putative conserved domains have been detected |
| 45 | 23499 | 23290 | MSKHIEITMSSGAKYFLVSTDE KSYNRQDIDYMLRGMDETSIKV YTESAITSPQVYINPNRIESFKIV F | 605 | ORF207 [Staphylococcus phage G1] | YP_241100.1 | 1e-32 (69/69) | | No putative conserved domains have been detected |
| 46 | 23844 | 23512 | LDKEINNLVSQVETIKSKIQEGN YIDRGTFKDLEVEVAELRKMIV SIDKDVAVNSEKQSAIYVQLER LDEKISELAGSTKTKDTKKKDT TEKVLLLVLGAILSFVFNKFA | 606 | ORF209 [Staphylococcus phage G1] | YP_241101.1 | 3e-52 (107/110) | | PHA02414, hypothetical protein | PHA024 14 | 1.54e-30 |
| 47 | 23857 | 24183 | LTKYKDILKLEFKDALAHFKRDR RYFHVYRIDRVLINGSIIYFDYY YLPSDDPNIVIKELDLQSFGKLR FEIDTKTSYGKVVTDNYMEIIND FLENYDIHSESETVRP | 607 | hypothetical membrane protein MbpC [Staphylococcus phage A5W] | ACB89047.1 | 4e-53 (105/108) | Membrane protein MbpC | No putative conserved domains have been detected |
| 48 | 24623 | 25009 | LNNNIAIFIFKTLVIIFLLLILSVIN SLSLIYSIRPSVVMTYFIFGGIVS NVALTVTDKFLLKKEDPLPEYV LKKVEINDKEIRIIKKIIESNYGIT AEEIKVRAKAQRRIEEDSKKED YDENKERN | 608 | hypothetical membrane protein MbpD [Staphylococcus phage A5W] | ACB89048.1 | 4e-48 (125/128) | Membrane protein MbpD | No putative conserved domains have been detected |
| 49 | 24987 | 25265 | MKTKKEIKEQRKELKDGATSVS LVKKGDKRIASPSRICSLCGQQ LSGMNYTKGKALSKVNHFHLQ | 609 | ORF161 [Staphylococcus] | YP_241104.1 | 5e-47(92/92) | | No putative conserved domains have been detected |

Fig. 10H

| | | | | | | | | |
|---|---|---|---|---|---|---|---|---|
| 50 | 25262 | 25672 | 609 | YSKYIYFDICADINNCYKNLRKR GEMD | | | | No putative conserved domains have been detected |
| | | | | LSAENIRDIINKKKLEEEDTRKYI ADGFMNGIGKLMYEFNKKVDN KEIEVKDPNDLYKLFVIFSQMQ NMVNETSEGGAIPQLSRPQOE LFDEITTEDSNGESTVDLQKISE MSAEDITAMISEKEKVMNEENS ETF | 136 | ORF133 [Staphylococcus phage G1] | YP_241105.1 | 2e-71 (135/136) | | | |
| 51 | 25687 | 27504 | 611 | MDGKELIKIAQETFQTEKITREQ IDHIINMLNPSTYMLKYHTLRGH PITFSIPNRDRSKAQAHRPWQT RIVNDTHPNKAVIKSRQLGLSE MGVWEMVHFADMHSYANAKC LYTFPTNEQMKKFVQSRLNPVL EKEYFRDIVDWDKDSLGFKKIR NSSLFFRTSSKASTVEGVDIDY LSLDEYDRVNLLAESSALESMS SSPFKIVRRWSTPSVPGMGIHK LYQQSDQWYYGHRCQHCDYL NEMSYNDYNPDNLEESGNMLC VNPEGVDEQAKTVQNGSYQFV CQKCGKPLDRWYNGEWHCKY PERTKGNKGVRGYLITQMNAV WISADELKEKEMNTESKQAFY NYILGYPFEDVKLRVNEEDVYG NKSPIAETQLMKRDRYSHIAIGI DWGNTHWITVHGMLPNGKVDL IRLFSVKKMTRPDLVEADLEKII WEISKYDPDIIIADNGDSGNNVL KLINHFGKDKVFGCTYKSSPKS TGQLRPEFNENNNRVTVDKLM QNKRYVQALKTKDISVYSTVDD DLKTFLKHWQNVIMDEEDEK TGEMYQVIKRKGDDHYAQASV YAYIGLTRIKELLKEGNGTSFGS TFVSTDYNQEGNKQFYFDE | 605 | gp74 [Listeria phage A511] | YP_001468454.1 | 0.0 (308/503) | Terminase large subunit | Terminase_ GpA | pfam05 876 | 4.8e-22 |
| 52 | 27497 | 28318 | 612 | MNRGEIDLTDKLFYGTISNEEIN KSVLNLLGEELSLDYVSKNSD TLDVKYEHVYKSLGFDNFFDCF. LYANREPEIVHKGGDKNLGGL NKVKRTVIRNGKEMEMTVYED GNKENDSKEKQEGKEEVSRSA VGARAISNGEEGKVNPKKVAN SLSNLSKKGVDVSHINTNSSLY KEFVDDNGDTLGITSFKRTEND IILESYASSHDSDGVGARAIMEL | 273 | hypothetical protein KgORF36 [Staphylococcus phage K] | YP_024466.1 | 3e-153 (273/273) | | | No putative conserved domains have been detected |

Fig. 101

| | | | | | | | | |
|---|---|---|---|---|---|---|---|---|
| 53 | 28296 | 28478 | 613 | LRLSIKENKNAVVYDIELPEAVE YLKTLGFKPNKDGYILRKKDVK QFLGDYSDFI VIIVILFSTIVIYSIVFILYIVLKTIYI KSNMSRIDNTTELLKILQEDIEG KIKKEGRNK | 60 | ORF235 [Staphylococcus phage G1] | YP_240894.1 | 3e-23 (59/60) | No putative conserved domains have been detected |
| 54 | 28475 | 28954 | 614 | MTLEENKLTLEESITPLSKEEKE DSIKEFSSLLCEMVNRLYKSYN VFRQDPMDETQRLDGSLMVFQ SRLNDPLTGDLHDKMYKLAFS KRIDIFEANKQFRKDVEAGKAIE LGDVAIIDTALSNILSGNEFQGSI SFMLRKDFEEKERIRKEEEEKL NNL | 159 | hypothetical protein KgORF37 [Staphylococcus phage K] | YP_024467.1 | 5e-86 (159/159) | No putative conserved domains have been detected |
| 55 | 28996 | 29322 | 615 | LKKKPQGNEVIITITVMIAVFVVI MTIFFNKYQDAKEDKDRYQRL VEIYKKADDNDGETKKKYVKRL NKAEEELKKVKKQIIKIIIRSQV KKDKKIKKLERKYMM | 108 | hypothetical protein KgORF38 [Staphylococcus phage K] | YP_024468.1 | 4e-26 (68/69) | No putative conserved domains have been detected |
| 56 | 30117 | 30221 | 616 | VDEEDKNEDTTDDKQPTEQPD DNNIDNEDKTEEE | 34 | hypothetical protein KgORF38 [Staphylococcus phage K] | YP_024468.1 | 2e-08 (34/34) | No putative conserved domains have been detected |
| 57 | 30306 | 30647 | 617 | MNIITSLSVVFTCLSLLTLMIFVH SKFSSKNVFVLYVIYAIIGIGTYI VLTMFQTTSVLIKNDVIDSIENT EHYIGFNDPIIFTISFIGAILGGI WYKMMKIIKKSNFKDKK | 113 | hypothetical membrane protein MbpE [Staphylococcus phage A5W] | ACB89055.1 | 5e-56 (113/113) | Membrane protein MbpE | PHA02256, hypothetical protein | 6.49e-28 |
| 58 | 30665 | 31036 | 618 | LIFSKDKKWDEAKDFIKGQGM QDNWIEVDYYRQIGGKHVAVF IALNKVKYMILEATKDNKVILVD KDNNILLEDYDIVMESKKMFYYI EEPFEVKINIPQHIRDVTYNNTV VLTTVRGSRGD | 123 | hypothetical protein KgORF40 [Staphylococcus phage K] | YP_024470.1 | 2e-64 (122/123) | | No putative conserved domains have been detected |
| 59 | 31040 | 32731 | 619 | LADLFKQFRLGKDYGNNSTIAQ VPIDEGLQANIKKIEQDNKEYQ DLTKSLYGQQQAYAEPFIEMM DTNPEFRDKRSYMKNEHNLHD VLKKFGNNPILNAIILTRSNQVA MYCQPARYSEKGLGFEVRLRD LDAEPGRKEKEEMKRIEDFIVN TGKDKDVDRDSFQTFCKKIVR DTYIYDQVNFEKVFNKNNKTKL EKFIAVDPSTIFYATDKKGKIIKG GKRFVQVVDKRVVASFTSREL | 563 | putative portal protein [Staphylococcus phage K] | YP_024471.1 | 0.0 (562/563) | Portal protein | Phage_port al | pfam04 860 | 1.13e-13 |

Fig. 10J

| | | | | | | | | | |
|---|---|---|---|---|---|---|---|---|---|
| 60 | 32925 | 33698 | 620 | AMGIRNPRTELSSSGYGLSEVE IAMKEFIAYNNTESFNDRFFSH GGTTRGILQIRSDQQQSQHALE NFKREWKSSLSGINGSWQIPV VMADDIKFVNMTPTANDMQFE KWLNYLINIISALYGIDPAEIGFP NRGGATGSKGGSTLNEADPGK KQQQSQNKGLQPLLRFIEDLVN RHIISEYGDKYTFQFVGGDTKS ATDKLNILKLETQIFKTVNEARE EQGKKPIEGGDIILLDASFLQGTA QLQQDKQYNDGKQKERLQMM MSLLEGDNDDSEEGQSTDSSN DDKEIGTDAQIKGDDNVYRTQT SNKGQGRKGEKSSDFKH | | | | |
| | 33717 | 34667 | 620 | LEEIKFNAFVPMDLKKSVSTAS DTNEYSIVSGWASTPSMDLQN DIVNPKGIDIEYFKSQGYINYEH QSDKVVGIPTENCYVDIEKGLFI EAKLWKNDENVVKMLDLAEKL EKSGSGRRLGFSIEGAVKKRNI NDNRVIDEVMITGVALVKNPAN PEATWESFMKSFLTGHGTSPD TQVDAGALRKEEIASSITNLAYV TKIKDLKEFNDVWNGVVEDLSK SNSMGYEESVLTLQLAKGLSR KDAELAVMDINKQKLE | YP_024472.1 | 9e-147 (256/257) | Prohead protease | Peptidase_ U35 | pfam04 586 | 8.72e- 05 |
| 61 | 34783 | 36174 | 621 | MSKEMQNILEEYDKLNAQEAV SKSVEDDEKNTVESTEEQVAE TTEEPAKEPEKVSEEDAKEAQ EQGEKVESEEVAEGNEDEEVE KSAKESKDPVDQKDTKTENKD NEKRKNKKDKKEDSDDEDKDT DDDKDKKEDKKEKTSKSISDED ITTVFKSILTSFENLNKEKENFA TKEDLSEVSKSINELSAKISEIQ AEDVSKSVDTDEEAVEKSVTST NGEQEKVEGYVSKSVDTEEQA ETGEAKSEEAEEVQEDNTFKG LSQEERTKFMDSYKAQAKDPR ASKHDLQSAYQSYLNINTDPTN ASEKDIKTVKDFAQI | hypothetical protein KgORF42 [Staphylococcus phage K] | | | | | |
| | | | 621 | | YP_024473.1 | 4e-170 (316/316) | | No putative conserved domains have been detected | | |
| 62 | | 36174 | 622 | MTIEKNLSDVQQKYADQFQED VVKSFQTGYGITPDTQIDAGAL RREILDDQITMLTWTNEDLIFYR DISRRPAQSTVVKYDQYLRHG NVGHSRFVKEIGVAPVSDPNIR | hypothetical protein KgORF43 [Staphylococcus phage K] | | | | | |
| | | | 622 | | putative capsid protein [Staphylococcus phage K] | YP_024474.1 | 0.0 (463/463) | Capsid protein | No putative conserved domains have been detected | | |

Fig. 10K

| | | | | | | |
|---|---|---|---|---|---|---|
| 63 | 36266 | 36562 | 623 | QKTVSMKYVSDTKNMSIASGL VNNIADPSQILTEDAIAVVAKTIE WASFYGDASLTSEVEGEGLEF DGLAKLIDKNNVINAKGNQLTE KHLNEAAVRIGKGFGTATDAY MPIGVHADFVNSILGRQMQLM QDNSGNVNTGYSVNGFYSSR GFIKLHGSTVMENELILDESLQP LPNAPQPAKVTATVETKQKGA FENEEDRAGLSYKVVVNSDDA QSAPSEEVTATVSNVDDGVKL SINVNAMYQQQPQFVSIYRQG KETGMYFLIKRVPVKDAQEDGT IVFVDKNETLPETADVFVGEMS PQVVHLFELLPMMKLPLAQINA SITFAVLWYGALALRAPKKWAR IKNVRYIAV MLYYKKLLDKKMATVYGTVEID KDGVVKGLTKEQEKEFANVPG FEFEEEKKTTRKQSASTSKEEE PKEEEKKASTRKTTSTTRKSTA RKTTAKKDENK | 98 | ORF151 [Staphylococcus phage G1] | YP_240904.1 | 7e-46 (97/98) | No putative conserved domains have been detected |
| 64 | 36575 | 37483 | 624 | MVNSMFGGDLDPYEKSLNYEY PYHPSGNPKHIDVSEIDNLTLA DYGWSPDAVKAYMFGIVVQNP DTGQPMGDEFYNHILERAVGK AERALDISILPDTQHEMRDYHE TEFNSYMFVHAYRKPILQVENL QLQFNGRPIYKYPANWWKVEH LAGHVQLFPTALMQTGQSMSY DAVFNGYPQLAGVYPPSGATF APQMIRLEYVSGMLPRKFKAGR NKPWEMPPELEQLVIKYALKEI YQVWGNLIIGAGIANKTLEVDGI TETIGTTQSAMYGGASAQILQI NEDIKELLDGLRAYFGYNMIGL | 302 | hypothetical protein KgORF45 [Staphylococcus phage K] | YP_024475.1 | 2e-177 (302/302) | No putative conserved domains have been detected |
| 65 | 37497 | 38375 | 625 | MEKPYMIGANSNPNVINKSTTY TTTQADEQDKPKYTTRLEFDT IDMIRFINDRGIKVLWEEAYFCP CLNPDTGHPRVDCPRCHGKGI AYLPPKETIMAIQSQEKGTNQL DIGILDTGTAIGTTQLEKRISYR DRFTVPEVLMPQQMIYFVNKD RIRKGIPLYYDVKEVTYIATQDG TVYEEDYEIKNNRLYLNEKYEN HTVTLKILMTLRVVSDILKESR YQYTKFNQPKSKFENLPQKLLL | 292 | hypothetical protein KgORF46 [Staphylococcus phage K] | YP_024476.1 | 2e-170 (290/292) | No putative conserved domains have been detected |

Fig. 10L

| | | | | | | | | |
|---|---|---|---|---|---|---|---|---|
| 66 | 38375 | 38995 | 626 | KREDIVLQDPYKVNDGIEEDL EIQVDDPKASASNPSNLGGFF GGAFK MPVHGKRPNLFKNKNYKQVGK RTIDGMRSEVLDKLQATAQQV ENTSIKRMPTYLQITEKKLEKEG VVDLKKAFAHSSKKKTSKDGG WYLTVPIRKTSRMNNSTYQDM RTLKVDKGTGSVSKITDYLEGR RKNVSHPSMKPEPMTHNMTKV KRGKQSSYFIFRTVSSKSPASS WILNRDKVNEDNFSKTTLKTVK QLMNWKMKNLN | hypothetical protein KgORF47 [Staphylococcus phage K] | YP_024477.1 | 1e-116 (206/206) | | No putative conserved domains have been detected | |
| 67 | 39014 | 39850 | 627 | MAITSVDSYLLSEIKPRLNTVLE NCYIIDEVLKDFDYQTRESFKE AFCGKNAQHEVTVGFNFPKFK NNYEAHYLIQLGQGQETKNSL GSIQSSYFEATGDTLVESSTAIR EDDKLVFTVSKPIGELIKVEDIE FAKYDNLQVEGNKVSFKYQTN EDYENYNANIIFTEKKNDSKGL VKGFTVEEQVTVVGLSFNVDV ARCLDAVLKMILISMRDSIEEQQ TFQLQNLSFGDIAPIIEDGDSMI FGRPTIIKYTSSLDLDYTITQDIN KLTFKERKDWK | hypothetical protein KgORF48 [Staphylococcus phage K] | YP_024478.1 | 3e-160 (278/278) | | No putative conserved domains have been detected | |
| 68 | 39852 | 40067 | 628 | MARKKTPENNTPKFNGYVHIDT FLDTAKTLFNMKDSQVAGFKA YMEGSHYLFSEQEFLPSLEKYL GRKLDI | ORF202 [Staphylococcus phage G1] | YP_240909.1 | 2e-34 (70/71) | | No putative conserved domains have been detected | |
| 69 | 40094 | 41857 | 629 | MAVEPFPRRPITRPHASIEVDT SGIGGSAGSSEKVFCLIGQAEG GEPNTVYELRNYAQAKRLFRS GELLDAIELAWGSNPNYTAGKI LAMRIEDAKPASAEIGGLKVTS KIYGNVANNIQVGLEKNTLSDS LRLRVIFQDDRFNEVYDNIGNIF TIKYKGEEANATFSVEHDEETQ KASRLVLKVGDQEVKSYDLTG GAYDYTNAIITDINQLPDFEAKL SPFGDKNLESSKLDKIENANIK DKAYYVKAVFGDLEKQTAYNGI VSFEQLNAEGEVPSNVEVEAG EESATVTATSPIKTIEPFELTKLT GGTNGEPPATWADKLDKFAHE GGYYIVPLSSKQSVHAEVASFV KERSDAGEPMRAIVGGGFNES | major tail sheath protein [Staphylococcus phage 812] | ABL87117.1 | 0,0 (583/587) | Major tail sheath protein | Phage_sheath_1 | pfam04984 | 6.04e-09 |

Fig. 10M

| | | | | | | | | |
|---|---|---|---|---|---|---|---|---|
| | | | KEQLFGRQASLSNPRVSLVAN SGTFVMDDGRKNHVPAYMVA VALGGLASGLEIGESITFKPLRV SSLDQIYESIDLDELNENGIISIE FVRNRTNTFFRIVDDVTTFNDK SDPVKAEMAVGEANDFLVSEL KVQLEDQFIGTRTINTSASIIKDF IQSYLGRKKRDNEIQDFPAEDV QVIVEGNEARISMTVYPIRSFKK ISVSLVYKQQTLEA | | | | | | |
| 70 | 41930 | 42334 | 630 | MASEAKQTVHTGNTVLLMIKGK PVGRAQSASGQREYGTTGVYE IGSIMPQEHVYLRYEGTITVERL RMKKENFADLGYASLGEEILKK DIIDILVVDNLTKQVIISYHGCSA NNYNETWQTNEIVTEEIEFSYL | 134 | capsid protein [Staphylococcus phage 812] | ABL87118.1 | 3e-73 (134/134) | Capsid protein | No putative conserved domains have been detected |
| 71 | 42754 | 43683 | 631 | MGKNQYTFNIKENKNKWYEW CKLQNVKPLVEYENAQQIFYFE FLEGKFKGLIGKTYWASINRGS NMRMSCLTSESKDKYLKNLGK RKGIEVVEDYKGGRKLKHKFIV LEGKYQGCEGYITLNDLENLGR VDNRSLSEKGRKQYFDKQARL RDCIILEYPKDYRIKTKDKIVVKD KEGHVHNIIVQDFFEKSSLLELS CASEGEKIVKEILTKNSIKFEKE KSFRNKEGKVQRFDFYINENN KEYAIEYNGAQHYIDSTGYLKD TLETTQKRDKLKKEYSKDKGIN LLIIPYTITDKKEMEKIILNFLNK | 309 | ORF018 [Staphylococcus phage Twort] | YP_238556.1 | 2e-19 (79/239) | | No putative conserved domains have been detected |
| 72 | 43741 | 43899 | 632 | MNNRQAKLKGYNQFHYYDFPT TKGKFKDIMKRKSRTELKKDLQ KERKYYLDK | 52 | ORF245 [Staphylococcus phage Twort] | YP_238558.1 | 3e-11 (37/52) | | No putative conserved domains have been detected |
| 73 | 43889 | 44029 | 633 | LTNKRKTIGKMSNTRATWNINP VTKVKKDKTKYSRKNKHKGLD NYN | 46 | ORF293 [Staphylococcus phage G1] | YP_240912.1 | 1e-10 (44/46) | | No putative conserved domains have been detected |
| 74 | 44074 | 44364 | 634 | MRIYISNDYNKELLDKCLSDINK DKGNINYSINYGEGNIKEADVEI IKLDKNLLETESRAFAYSKFVED CIFLFPYKIALLRGGKIELRFDW NEIL | 96 | No significant similarity found. | | | | |
| 75 | 44385 | 44843 | 635 | MSTFWSERRTTNKDRQVKKHY TQMSMYERKKCVELLQETITEN RINFTRHSAKKVKGKPTTNIPK LIGFIFKNKFAYENIIEYNNTDYN GNIERRIVVKHPKVITVEGKLSY | 152 | hypothetical protein KgORF51 [Staphylococcus phage K] | YP_024481.1 | 2e-83 (151/152) | | PHA02264, hypothetical protein | PHA022 64 | 2.05e-29 |

Fig. 10N

| | | | | | | | |
|---|---|---|---|---|---|---|---|
| | | | QFLTISLEDARVITVWYNSVDD THRTLDLNYYSKDLTIQ | | | | |
| 76 | 44856 | 45050 | 636 | MGLTIVNGYFFLSSIIFIVVSILN GKGTVTRESLAMSQALVIITSIQ FLAFLIINGIYYSLKYM | ORF215 [Staphylococcus phage G1] | YP_240914.1 | 4e-19 (49/64) | No putative conserved domains have been detected |
| 77 | 45066 | 45218 | 637 | MEIYIVIDLRGSTEEETSMDFKA FRKLQDAITYVDGNGNRDLHIIP LELE | No significant similarity found. | | | No putative conserved domains have been detected |
| 78 | 45286 | 45597 | 638 | MSQDKLRAIYTEMKVELHKFPK EVDVTSKSTAIAINQILDKFKTLT EQAGKITRKYLEGQEILTIDYEY YDSLQEYYIYLLRNSEKIEQSLQ EITKRTGEYVK | hypothetical protein KgORF52 [Staphylococcus phage K] | YP_024482.1 | 3e-51 (102/103) | PHA02265, hypothetical protein / PHA022 65 / 2.51e-17 |
| 79 | 45730 | 46188 | 639 | MAEEIKKEQDVQETTKEEKKDV SKMTPEEIDKLKYQDKQEKEQ VINKVIKGVNDTWEKEYNFEEL DLRFKVKIKLPNAREQGNIFALR SAYLGGMDMYQTDQVIRAYQM LATLQEVGIEVPKEFQDPDDIY NLYPLTVMYEDWLGFLNSFRY | hypothetical protein KgORF53 [Staphylococcus phage K] | YP_024483.1 | 2e-82 (152/152) | No putative conserved domains have been detected |
| 80 | 46232 | 46768 | 640 | MESIVKQPLSRNLWAIMKEFNV LPTEQRFKDLDDYQIEFIIGNMN RDVYEHNKQLKQAQKGGKFDS QFEDDDSSWWNESHEDFDPV PDFLDADDLAQQMEAKLSDRD KEEFAKRNDAELNDETEGLTT QHLAMMEYIRQKQQELDDEVG NGKTSEDDATISQDSVNKALED LDDDWYM | hypothetical protein KgORF54 [Staphylococcus phage K] | YP_024484.1 | 8e-99 (178/178) | No putative conserved domains have been detected |
| 81 | 46821 | 50879 | 641 | MMAMNDDYRLVLSGDSSDLEN SLKAIELYMDSLESKNIDAPLDN FLKKLKVIAKEVKNVQNAMDKQ DGKSVISSKDMDESIKSTQSAT KNINELKKALDDLQKENISKGIA PDPEVEKAYAKMGKVVDETQE KLEKMSSQKIGSDASIQNRIKE MKTLNQVTEEYNKISKDSSATK DYTKRLRANRNMTRGYMERSE GTGRLTYDQGARVRSELGKVS SYESQRKQNQRNLGQAREQY SNYRNQQQDLTKRRASGQINK AQYEQELASIKQEMKAREELIS NYEKLGAELDKTVQYYKGSVQ KDFQSRDVDQQRGTFGRMVQ ERLPSIGSHAMMGTTAMATGL YMKGASLSETNRPMVTSLGQN | hypothetical protein KgORF55 [Staphylococcus phage K] | YP_024485.1 | 0.0 (1343/1351) | Smc, chromosome segregation ATPases / COG11 96 / 8.71e-06 |

Fig. 100

| 82a | 50957 | 52159 | 642 | SDNMDIDSVRNAYGDLSIDNKL GYNSTDMLKMATSYEASVGHK SDEDTMAGTKQLAIGGRSLGIK DQEAYQESMGQIMHTGGVNS DNMKEMQDAFLGGIKQSGMV GRQDEQLKALGSIAEQSGEGR TLTKDQMSNLTAMQSTFAESG SKGLQGEQGANAINSIDQGLKN GMNSSYARIAMGWGTQYQGL EGGYDLQKRMDEGISNPENLT DMADMATQMGGSEKEQKYLF NRSMKEIGANLTMEQSDEIFKD SKEGKLSKEELAKKAKKMEKE GKKEGEDNATDYKESKSGKND QNKSKTDDKAEDTYDMAQPLR DAHSALAGLPAPIYLAIGAIGAF TASLIASASQFGAGHLIGKGAK GLRNKFGRNKGGSSGGNPMA GGMPSGGGSPKGGGSPKGG GTRSTGGKILDSAKGLGGFLVG GAGWKGMFGGESKGKGFKQT SKEAWSGTRKVFNRDNGRKA MDKSKDIAKGTGSGLKDIYNDS IFGKERRQNLGEKAKGFGGKA KGLYGKFADKFGDGGKNGILS QSPKAGGSGIGKLGKLAGGLG KGAGVLGVATSALSLIPALASG DSKAIGCGIGSMGGGMAGASA GASIGALFGGVGAIPGALIGGAI GSFGGGAVGEKVGDMAKKAN TKEGWNLGWTNGDKDGKNKF QDSLLGKPISKAWSGITGLFDN DAEASEENSKDKKGVKGVKG DTKKKEKMTAEQLREKNNQSE TKNLKIYSDLLDRAQKIIESAKGI NIDGGTSDSGSDSGGSASDVG GEGAEKMYKFLKGKGLSDNQV GAVMGNLQQESNLDPNAKNPS SGAFGIAQWLGARKTGLDNFA KSKGKKSSDLDVQLDYLWKEM. QSDYESKNLKNAGWSKGGSLE QNTKAFATGFERMGANEAMM GTRVNNAKEFKKKYGGSGGG GGGGAMSSTYQEAMSNPVLTT GSNYRGSNDASNASTTNRITV NVNVQGGNNPEETGDIIGGRIR EVLDSNMDIFANEHKRSY | MKRLRRPKVRIEIVTDDNTFTL | hypothetical protein | YP_024486.1 | 0,0 | Tail lysin | No putative conserved domains |

Fig. 10P

| | | | | | | | |
|---|---|---|---|---|---|---|---|
| | 52258 | | RFEDTRDYNGDEFGAKLLGFQ TKNSMEDDSSVFQINMAGDTY WDKLVMANDIIRIFITPNDDPND KEGRQERLIQVGMVSQVSKVG SYGNDQTQFRITGQSFVKPFM KFGLGVIQEVQAVLPEVGWLID GDGDNEVKFTGSSAHEVMTGII RRFVPYMKYNYTEKTYNTIDSY LDYDDLSSWDEFENLTEVSAFT NFDGSLKQLMDMVTARPFNEL FFKNSEKTPGKAQLVLRKTPFN PTEWRALDMIKVPTEDFIEEDV GKSDVETYSIFTATPAGMLKEL NGDVFSKPQFHPELTDRYGYT KFEVENIYLSTKSGSATEDSDS SGDDNGTERGTYSKIMKDLSN YGRDNISKGIDKYTSKLSSKYK NLKKPKLKKL | | KgORF56 [Staphylococcus phage K] | | (390/400) | have been detected |
| 82b | 52368 | 643 | LTKDKLKSILKEKFKTQDDFNN SKKRKKLKQMHLKN | 36 | | | 7e-04 (23/23) | No putative conserved domains have been detected |
| 82c | 52365 | 644 | LTTKYRFGNKTHATTLLDEYIKY KGEPPNDEAFDKYLKAIEGVSN IATDTGSDASDSPLVMFSRMLF NWYHGNPNFYAGDIIVLGDPKY DLGKRLFIEDKQRGDTWEFYIE SVEHKFDYKQGYYTVGVTRG LKDAILEDGKGSPHRFAGLWN QSSDFMGGLMGEDTSKELKEK GVSEKQSSGDKDGGSDSSGA QDGGSLDSLKKYNGKLPKHDP SFVQPGNRHYKYQCTWYAYN RRGQLGIPVPLWGDAADWIGG AKGAGYGVGRTPKQGACVIW QRGVQGGSAQYGHVAFVEKV LDGGKKIFISEHNWATPNGYGT RTIDMSSSAIGKNAQFIYDKK | 338 | | | 0.0 (334/338) | CHAP | pfam05 257 | 2.48e-13 |
| 83 | 53395 | 645 | MATDKEAKDVIDKFIDNVFND VLTMERVKEKDEEIKKITTDDM YEKVVYIRPYVGVIQSLNPQHV QYESFSNNGYDIEAELSFRKVS YLVDKGSIPTDSLSTLTVHLVER NQELLIDYFDEDVPLSTILADLNDNL KSLSNIKYMFKGAPKENPFGTD KDVYIDTYNLLYWLYLGEDEEL AYPMNINYFFTEGRFFTIFGKG HKYKVDVSKFIVGDILFFGRSD | 295 | hypothetical protein KgORF57 [Staphylococcus phage K] | YP_024487.1 | 9e-166 (292/295) | No putative conserved domains have been detected |

Fig. 10Q

| | | | | | | | |
|---|---|---|---|---|---|---|---|
| | | | TNIGIYVGDGEFISMIGKFPKDE TPIGKYKLDDYWNEFNGRVMR FDEEVYI | | | | |
| 84 | 54282 | 56828 | 646 | MVVRFQSSMGRSLKRVDSDDL NVKGLVLATVSKINYKYQSVEV KVNNLTLGSRIGDDGSLAVPYP KSFIGRTPEGSVFGTKPLITEGS VVLIGFLNDDINSPIILSVYGDNE QNKMINTNPLDGGKFDTDSVY KYSSALYEILPSLNYKYDDGEG TSIKTYNGKSFFSMTSGEEEKP QATDFYTGTEYQDLFTSYYGN KTLIEPRIQKAPNMLFKHQGVF YDDGTPDNHITTLFISERGDIRA SVLNTETQKRTTQEMSSDGSY RVIKQDDDLMLDEAQVWIEYGI SEDNKFYIKNDKHKFEFTDEGI YIDDKPMLENLDESIAEAMKNL NEIQKELDDINYLLEGVGKDNL EELIESTKESIEASKKATSDVNR LTTQIAEVSGRTEGIITQFQKFR DETFKDFYEDASTVINEVNQNF PTMKTDVNTLKTKVDNLEKTEI PNIKTRLTELENNNNNADKIISD RGEHIGAMIQLEENVTVPTRNY MPIPWSKVTYNNAEFWDSNNP TRLVVPKGITKVRVAGNVLWDS NATGQRMLRILKNGTYSLGLPY TRDVAISTAPQNGTSGVIPVKE GDYFEFAFQDSEGDRQFRAD PYTWFSIEAIELETETMEKDFM LIGHRGATGYTDEHTIKGYQMA LDKGADYIELDLQLTKDNKLLC MHDSTIDRTTTGTGKVGDMTL SYIQTNFTSLNGEPIPSLDDVLN HFGTKVKYYIETKRPFDANMDK ELLTQLKAKGLIGIGSERFQVIIQ SFARESLINIHNQFSNIPLAYLT STFSESEMDDCLSYGSYAIAPK YTTITKELVDLAHSKGLKVHAW TVNTKEEMQSLIQMGVDGFFT NYLDEYKKI | putative glycerophosphoryl diester phosphodiesterase [Staphylococcus phage K] | YP_024488.1 | 0,0 (838/848) | Glycero-phosphoryl diester phospho-diesterase | GDPD_SaG IpQ like, glycerophos -phodiester phospho-diesterase domain | cd08601 | 1.70e-60 |
| 85 | 56935 | 57726 | 647 | MPQSDGISNLHRIALRFPKEGG GYDMYRFKVNPENYTIDSPQR TTAIKTKSDIVIEDYGKDIEVINF TGTTGFRPVREADGLKTGKQK MEELQSRVSEYAMQGGSGNV | hypothetical protein KgORF59 [Staphylococcus phage K] | YP_024489.1 | 1e-150 (262/263) | | No putative conserved domains have been detected | | |

Fig. 10R

| | | | | | | | | |
|---|---|---|---|---|---|---|---|---|
| 86 | 57726 | | SGSYLQFFNFTDDSYYKVHLAPQGLKITRSKDEPLLFRYEITLVVIGSLTEADRSAVTTEEFGNVKPNASQRVDEGIKELDKNARKTRDRNNQEISKRENTIPKSTGDNTNEGNRLKQSFPSSSIYNPRQSTNGLKGNIDNMALIIGYGDGGVSS | | | | | No putative conserved domains have been detected | |
| 87 | 58250 | 648 | MNNFIPQPQGLLRFLNALDADLTSSHMNLLDEEVSFVSKFYTPQLQLSELAKKVLTNIKTDDIPVLEREFNDNTIIHKANDTLLKVQAPRMYMILQSIVLEAYAIVNCFVENPSSLKYLTEEDVSITRENLNYVADYLGNYDDYNSVVLDLRDLDLCFSAIELQLPLIKKEANV | 174 | ORF078 [Staphylococcus phage G1] | YP_240925.1 | 8e-95 (173/174) | | No putative conserved domains have been detected |
| | 58250 | 649 | MRFKKHVVQHEETMQAIAQRYYGDVSYWIDLVEHNNLKYPYLVETDEEKMKDPERLASTGDTLIPIESDLTDVSAKEINSRDKDVLVELALGRDLNITADEKYFNEHGTSDNILAFSTNGNGDLDTVKGIDNMKQQLQARLLTPRGSLMLHPNYGSDLHNLFGLNIPEQATLIEMEVLRTLTSDNRVKSANLIDWKIQGNVYSGQFSVEIKSVEESINFVLGQDEEGIFALFE | 234 | putative bacteriophage baseplate protein [Staphylococcus phage K] | YP_024491.1 | 2e-134 (234/234) | Baseplate protein | DUF1371, Protein of unknown function | pfam07 115 | 7.96e-04 |
| 88 | 58969 | 650 | MKTRKLTNILSKLIDKTMAGTSKITDFTPGSASRSLLEAVSLEIEQFYILTKENIDWGIQEGIIEAFDFQKRQSKRAYGDVTIQFYQPLDMRMYIPAGTTFTSTRQEYPQQFETLVDYYAEPDSTEIVVEVYCKETGVAGNVPEGTINTIASGSSLIRSVNNEYSFNTGTKEESQEDFKRRFHSFVESRGRATNKSVRYGALQIPDVEGVYVYYEETGHITVFAHDRNGNLSDTLKEDIIDALQDYRPSGIMLDVTGVEKEEVNVSATVTISNKSRIGDTLQKHIEGVIRSYLNNLKTSDDLIITDLIQAIMNIDDVLIYDVSFDNLDENIIVPPQGIIRAGEIKVELK | 348 | hypothetical protein KgORF62 [Staphylococcus phage K] | YP_024492.1 | 0,0 (347/348) | | XkdT, Un-characterized homolog of phage Mu protein gp47 | COG32 99 | 3,44e-05 |
| 89 | 60036 | 651 | VANFLKNLHPLLRRDRNKKDNQDPNFALIDALNEEMNQVEKDAIESKLQSSLKTSTSEYLDKFGDWFGVYRKTDENDDVYRARIIK | 854 | hypothetical protein KgORF63 [Staphylococcus | YP_024493.1 | 0,0 (498/545) | | No putative conserved domains have been detected | |

Fig. 10S

| | | | | | | | | |
|---|---|---|---|---|---|---|---|---|
| 90 | 62711 | YLLLKRGTNNAIIDAIKDYLGRD DIDVSVYEPFTNIFYTNKSHLNG EDHLMGYYYRFAVINVSIGDYF PVEIIDVINEFKPAGVTLYVTYD GASTIRGGAIIKWLDGLPKIETY QEFDRFTGYDDTFYGHINIMNQ SKDTDNSTSDIFKTNHSLINSLD VLTGSSSVGRQYVNYGYITSYV YNPGMTSSVNQISASTEGRGQ EVPTDYYMYTSTKNNNTVELS MQTTSGVSYLYNNFNFRDYMS KYRPQVNLQSDEARRIVSDYIK ELSIDYYLSAVIPPDESIEIKLQV YDFSINRWLTVSINNLSFYEKNI GSNIGYIKDYLNSELNMFTRLEI NAGKRDSVDIKVNYLDDLMFYY ERGIYTIKPYKALVENYLDISRE TYVEAFKISSLSNGDIITKTGYL PIGYLRVSGDIDNLSNHIEIITID NNTNSITSTLLEDDSNSLILSYG NVKTNIH-SFELNSDASISNIKFE YSYYGDAWEELTVLTEISEGET IVPNILIDLYGLQTVDYSNINPM SKVSLRSIWNVKLGELNNKEGS LSNMPNDYFNAVWQDIDKLSDI DLGSMRMIKDTEGGVFDGATG EIIKATLFNVGVYTDLDMLAYTL TNYTEPITLGSSRLISELKEELLT SESFNVDNRIKVIDSISEQLPNN NILSNSYQTQTITQNGFAKYNL KEPIEQRKQYNLRIHGDFKEGL ERLAIGNSNGSFNEVFVYPENI KDGIVDITYTSRDDNYAEGKQR LNNDYRVYAQPYDSEVVTIYSL ELIKV | phage K] | | | | | | |
| | 63232 | 652 | MAIATYNSHVELAKYLVSKADS VYLTIGKSTPWSNETNPPQPDE NATVLQEVIGYKKATKVTLVRP SKSPEDDNKNLISYGNKSWVE VTPENAKDEGAKWVYLESSIV GDELPLGTYRQVGFVMDLVAK SGISKFNLVPSEVESTGTLLFFD NKQFQNRSEQTTAKERFIVEV | 173 | hypothetical protein KgORF64 [Staphylococcus phage K] | YP_024494.1 | 3e-95 (172/173) | Baseplate structural protein | Phage-Gp8, bacteriopha ge T4 baseplate structural proteins | pfam09 215 | 6.79e-04 |
| 91 | 66711 | | | | | | | | | |
| | 63253 | 653 | MAINFKGSPYLDRFDPSKDRTK VLFNPDRPLQQAELNEMQSID QYYLKNLGDAIFKDGDKQSGL GFTLSEDNVLTVNPGYVYINGK | 1152 | hypothetical protein KgORF65 [Staphylococcus phage K] | YP_024495.1 | 0,0 (1147/1152) | | No putative conserved domains have been detected | | |

Fig. 10T

```
IRYYDNDDSVKITGVGKETIGIK
LTERIVTPDEDASLLDQTSGVP
SYFSKGADRLEEKMSLTVNDP
TSATIYTFMDGDLYIQSTNAEM
DKINKVLAERTYDESGSYKVNG
FELFSEGNAEDDDHVSVVVDA
GKAYVKGFKVDKPVSTRISVPK
SYDLGTAENESTIFNKSNNSISL
ANSPVKEIRRVTGQVLIEKERV
TRGAQGDGQDFLSNNTAFEIV
KVWTETSPGVTTKEYKQGEDF
RLTDGQTIDWSPQGQEPSGGT
SYVVSYKYNKRMEVGKDYEVT
TQGEGLSKKWYINFTPENGAK
PIDQTVVLVDYTYYLARKDSVFI
NKYGDIAILPGEPNIMRLVTPPL
NTDPENLQLGTVTVLPDSDEAV
CISFAITRLSMEDLQKVKTRVD
NLEYNQAVNALDDGAMEGQN
PLTLRSVFSEGFISLDKADITHP
DFGIVFSFEDAEATLAYTEAVN
QPKIIPGDTTAHIWGRLISAPFT
EERTIYQGQASETLNVNPYNIP
NKQGVLKLTPSEDNWIDTENVT
ITEQKTKKVTMKRFWRHNESY
YGETEHYLYSNLQLDAGQKWK
GETYAYDREHGRTGTLLESGG
QRTLEEMIEFIRIRDVSFEVKGL
NPNDNNLYLLFDGVRCPITPAT
GYRKGSEDGTIMTDAKGTAKG
KFTIPAGIRCGNREVTLKNANS
TSATTYTAQGRKKIVQDIIIRTR
VTVNLVDPLAQSFQYDENRTIS
SLGLYFASKGDKQSNVVIQIRG
MGDQGYPNKTIYAETVMNADD
IKVSNNASAETRVYFDDPMMA
EGGKEYAIVIITENSDYTMWVG
TRTKPKIDKPNEVISGNPYLQG
VLFSSSNASTWTPHQNSDLKF
GIYTSKFNETATIEFEPIKDVSA
DRIVLMSTYLTPERTGCTWEM
KLILDDMASSTTFDQLKWEPIG
NYQDLDVLGLARQVKLRATFE
SNRYISPLMSSSDLTFTTFLTEL
TGSYVGRAIDMTEAPYNTVRFS
YEAFLPKGTKVVPKYSADDGK
TWKTFTKSPTTTRANNEFTRYV
IDEKVKSSGTNTKLQVRLDLST
```

Fig. 10U

| | | | ENSFLRPRVRRLMVTTRDE | | | | | |
|---|---|---|---|---|---|---|---|---|
| 92 | 66760 | 654 | MPREVRDPYSQAKLFIPTVEEK SIKELEKTYKEKIDEATKLINELK KERGEK | 52 | ORF262 [Staphylococcus phage G1] | YP_240931.1 | 3e-20 (52/52) | | No putative conserved domains have been detected |
| 93 | 66918 | 655 | MAFNYTPLTETQKLKDMYPKV NDIGNFLKTEVNLSDVKQISQP DFNNILASIPDSGNYYVTNSKG APSGEATAGFVRLDKRNVNYY KIYYSPYSSNKMYIKTYANGTV YDWISFKLDEGNLYNEGNTLNV KELTESTTQYVTLVNPPKENLN TGWVNYKESKNGVSSLVEFNP VNSTSTFKMIRKLPVQEQKPNL LKDSLFVYPETSSSNIKTDNWN TPPFWGTANSGRSGVRFRG ENTIQIDDGSSTYPTAMTNRFK MGNELSVGDTITVSVYAKINDP ALLKDNLVYFELAGYDMVDRT DNPYTGGRREITASEITTEWKK YSFTFTIPENTIGASGVKVNYVS LLLRMNCSSSKGNGAVVYYAL PKLEKSSKVTPFITHATDVRKY DEIWSNWQEVISKDELKGHSP VDIEYNDYFKYQWWKSEVNEK SLKDLAMTVPQGYHTFYCQGSI AGTPRGRSIRGTIQVDYDKGDP YRANKFVKLLFTDTEGIPYTLYY GGYNQGWKLLKQSETSTLLWE GTLDFGSTEAVNLNDSLDNYDL IEVTYWTRSAGHFSTKRLDIKN TSNLLYIRDFNISNDSTGSSVDF FEGYCTFPTRTSVQPGMVKSIT LDGSTNTTKVASWNEKERIKVY NIMGINRG | 639 | hypothetical protein KgORF66 [Staphylococcus phage K] | YP_024496.1 | 0.0 (617/640) | | PHA01818, hypothetical protein | PHA018 18 | 6.90e-04 |
| 94 | 68862 | 656 | MAVKYDIGNNEIVLHLREGKYIT GFTTVGGYDKELGQVKVNREIL PAYFFDNFAYERYLYYSKPEEV IENKNYVPPQINNGDEESQQNT VPKEQYDSLKEEELELMRKQQE AMMEMLQKLLGQKG | 124 | hypothetical protein KgORF67 [Staphylococcus phage K] | YP_024497.1 | 3e-63 (121/124) | | DUF2977, Protein of unknown function | pfam11 192 | 2.94e-12 |
| 95 | 69243 | 657 | MALNFTTITENNVIKDLTTQVNN IGEELTKERNIFDITDDLVYNFN KSQKIKLTDDKGLTKSYGNITAL RDIKEPGYYYIGARTLATLLDRP DMESLDVVLHVVPLDTSSKVV QHLYTLSTNNNQIKMLYRFVSG NSSSEWQFIQGLPSNKNAVISG | 458 | hypothetical protein KgORF68 [Staphylococcus phage K] | YP_024498.1 | 0.0 (445/458) | | PHA01818, hypothetical protein | PHA018 18 | 0.0 |

Fig. 10V

| | | | | | | | | |
|---|---|---|---|---|---|---|---|---|
| 96 | 70709 | 72457 | 658 | TNILDIASPGVYFVMGMTGGMP SGVDSGFLDLSVDANDNRLAR LTDAETGKEYTSIKKPTEVYTA WKKEFEPKDMEKYLLSSIRDD GSASFPLLVVTSDNKTFQQAIID HIDRTGQTTFTFYYQGGVSGS PMSNSCRGLFMSDTPNTSSLH GVYNAIGTDGRNVTGSVVGGN WTSPKTSPSHKELWTGAQSFL SVGTTKNLADDISNYSYVEVYT KHKTVEKTKGNDDSGTICHKFY LDGSGTYVCSGTFVSGDRTDT KPPVTEFYRVGVSFKGSTWTL VDSAVQNSKTQVYTRIIGINMP MRLRIKNLYTYVEFEEDDKYLK DIFLKRVHTTIGARQEGFGYSP AYKRGSWDGYVDFYVYEEDKF PTGLLFKIELLLGELQSRYNFQF ETIDERDESFLSEEDIDDEITLL DNNVGGITLRDYQYEAVYNSLT FYNGIAHLATNGGKTEVASGIID QLLPQLEKGERVAFFTGSTEIF HQSADRLQERLNIPIGKVGAGK FDVKQVTVVMIPTLNANLKDPT QGVKVTPKQNISKKIAQEILPKF EGGTNQKKLLKVLLDNTTPKTK VEQNVLSALEIIYQNSKTDAEVL LNLRNHNAHFQKIVREKNEKKY DKYQDMRDFLDSVTVMIVDEA HHSKSDSWYNNLMTCEKALYR IALTGSIDKKDELLWMRLQALF GNVIARTTNKFLIDEGHSARPTI NIIPVANPNDIDRIDDYREAYDK GITNNDFRNKLIAKLTEKWYNQ DKGTLIIVNFIEHGDTISEMLNDL DVEHYFLHGEIDSETRREKLND MRSGKLKVMIATSLIDEGVDIS GINALILGAGGKSLRQTLQRIGR ALRKKDDNTTQIFDFNDMTNR FLYTHANERRKIYEEEDFEIKDL GK | 582 | putative helicase [Staphylococcus phage K] | YP_024499.1 | 0,0 (582/582) | Helicase | HELICc, helicase superfamily c-terminal domain | cd00079 | 1.80e-12 |
| 97 | 72469 | 74082 | 659 | MATKTQRKLYQYLEENATENK FHISTKKELADSLGVSISALSNN LKKLEEENKVVTVSKRGKNGG VIITLVREYDTEELKEFNNSTDN IITSDLQYAKALREKHFPSYRYE RKEQRRRTKIEMAQYNAIKDEK | 537 | putative Rep protein [Staphylococcus phage K] | YP_024500.1 | 0,0 (531/537) | Transcription regulator protein | HTH_ARSR subfamily of helix-turn-helix bacterial transcription | cd00090 | 4.28e-03 |

Fig. 10W

| | | | | | | | | |
|---|---|---|---|---|---|---|---|---|
| 98 | 74075 | | RRIIADMNFYSEGLPYPSKDIFN MSYDPEGFYKAYILCKLYDQYA ISHMDAKHTSHLKAMSKATTKD EYDYHQHMSEYYRNKMIQNLP RNSVSDNFFGSKMFNTFYNFY LKIKDKNINVFKYMKNVFKNVTF YYENGMQPNPIPSPNFFSSDK YFKNYNNYIKGIKKGINSTNRHL GDTDSIINSSDYVKNPAVLHLH QLYTGLNSTLHDIDTMFEQAL DLENASYGLFGDMKHIILLQYN SMIEEEIKNLPIEEKDIINKYVKQ CIINNYSPTSISPSARLSMFTMQ KEHIVYNKQLNKGIKREDLLPLS LGGIVNKDSLSSMDIQNLEQNG NEYLYMRQHTSTYYILRMFGD YLGYEVNLREVKYIVEKYNLIDK IPLTKEGMLDYNKLIHLVEEEVN NYE | | | | | |
| | 75517 | 660 | MSKKIKELILHKSMKDIHFAREV LDNLPKNLFSAESEDMGYLFTA IKRTAHISDKMSNEALAIKVEQL MGNNKEDEEKVTKTLTYLEDLY KVDVNEKDESVNYEIEKYIKTE MSKEVLVKFIAENKQEDSDNLH ELVDKLKQIEVSDISGGNGEFID FFEDTEKKQELLSNLATNKFST GFTSIDNHIEGGIARGEVGLIIAP TGRGKSLMASNLAKNYVKSGL SVLYIALEEKMDRMVLRAEQQ MAGAEKSQIVNQDMSLNNKVY DAIQNHYQKNRKLLGDFYISKH MPGEVTPNQLEQIIVNTTIKKDK NIDVVIIDYPHLMRNPYAKYHSE SDAGGKLFEDIRRLSQQYGFV CWTLAQTNRGAYGSDVITSEH VEGSRKIVNAVEVSLAVNQKDE EFKSGFLRLRYLDKIRNSSNTGE RFVNLKVEPTKMIVRDETPEEK QEHIQLLSDNGKEDTSKFQNK DNKIEAINNTFGGLPGV | 480 | putative helicase [Staphylococcus phage K] | YP_024501.1 | 0,0 (480/480) | Helicase | 41 helicase | PHA025 42 | 1.06e-05 |
| 99 | 75596 | 661 | MKFVFFTDSHFHLFTNYAKPDN EFVNDRFKEQIEALQKVFDIAK KEEATVIFGDLFHKRNSVDTR VYNKVFSTFAKNNEVPVLLLRG NHDATTNSLYTDSSIDTFEYLP NVNVIKSLNTILKDNVNIVFTAY | 341 | putative exonuclease [Staphylococcus phage K] | YP_024502.1 | 1e-172 (294/345) | Exonucleas e | MPP_Mre11 _N nuclease, N-terminal metallo- phosphatas | cd00840 | 3.56e-21 |

Fig. 10X

| | | | | | | | | | e domain | | |
|---|---|---|---|---|---|---|---|---|---|---|---|
| 100 | 76621 | 76998 | 662 | GDETKEIKTYINSNYDKDMVNIL VGHLGVEGSLTGKGSHRLEGA FGYQDLLPDKYDFILLGHYHRR QYFQNPNHFYGGSLMQSFS DEQEANGVHLIDTDKMTTEFIPI HTRRFITIQGEDIPDNFEQLIEE DNFIRVIGTANHAKVLEMDDSM KDKNVEVQIKKEYTVEKRIDSD VSDDPLTIASTYAKQYSPESEQ EILECLKEVL MKKYREYLNKTDAENLAEDWE KVTEDLWKVFKDMKPKINTLDI SNVGSKDLDKSKPILQFQDSD GVIENICNVEGLEDGLSKMKKIF DDSNFEKHYYNRVVDHDGYY WIDYGSHHCFFRVTKGDK | 125 | hypothetical protein KgORF73 [Staphylococcus phage K] | YP_024503.1 | 3e-65 (123/125) | | PHA02275, hypothetical protein | PHA022 75 | 2.14e-21 |
| 101 | 76998 | 78917 | 663 | MVVFKQVEVNNFLAIKEATLEL DNRGLILIEGENKSNESFHSNG SGKSTLISAITYALYGKTEKGLK ADDVVNNIEKKNTSVKLKFDIG EDSYLIERYRKDKENKNKVKLF VNEKEITGSTNDVTDKQIQDLF GIEFNTYVNAIMYGQGDIPMFS QATDKGKKEILESITKTDVYKQ AQDVAKEKVKEVEEQQNNIRQ EIYKLGYQLSTKDEYFQREIEQ YNQYKEQLVQIENSNKEKDRL REQEEKQIEAQIEQLASQIPTIP EDEFKHSEEYNKASQSLDLLSN KLTELNQVYSEYNTKEQVLKSE IATLSNSLNQLDINDHCPVCGS PIDNSHKLKEQENISNQIENKK QEITSVLEMKDTYKEAIDKVKD KSQEIKDKMSQEDQQEREHNN KINSIIQEASRIKSDISSLENNKT YLKVKYQHQSVQGLEREEPSK EKHEEDKKELQESIDKHEENIV QLETKKGKYQQAVDAFSNKGI RSVVLDFITPFLNEKANEYLQTL SGSDIEIEFQTQVKNAKGELKD KFDVIVKNNKGGGSYKSNSAG EQKRIDLAISFAIQDLIMSKDEIS TNIALYDECFDGLDTIGCENVIK LLKDRLNTVGTIFVITHNTELKP LFEQTIKIVKENGVSKLEEK | 639 | putative exonuclease [Staphylococcus phage K] | YP_024504.1 | 0.0 (636/639) | Exonuclease | 46 endonuclea se subunit | PHA025 62 | 1.68e-26 |
| 102 | 78917 | 79513 | 664 | MKLKILDKDNATLNVFHRNKEH KTIDNVPTANLVDWYPLSNAYE | 198 | hypothetical protein KgORF75 | YP_024505.1 | 2e-111 (197/198) | | No putative conserved domains have been detected | | |

Fig. 10Y

| # | | | Sequence | Length | Description | Accession | E-value (identity) | | Conserved domain | | |
|---|---|---|---|---|---|---|---|---|---|---|---|
| 103 | 79528 | | YKLSRNGEYLELKRLRSTLPSSYGLDDNNQDIIRDNNHRCKIGYWYNPAVRKDNLKIIEKAKQYGLPVITEEYDANTVEQGFRDIGVIFQSLKTIVVTRYLEGKTEEELRIFNMKSEESQLNEALKESDFSVDLTYSDLGQIYNMLLLMKKISK | | [Staphylococcus phage K] | | | | | | |
| | 80595 | 665 | MRFEDFLTQELGEPKENTIGELRYCCPFCGEKSYKFYVKQALDSSNGQYHCKKCDETGNPITFMKTYYNITGKQAFDLLESKNIDIERAPLLTTNNKDLTESEKLILMLRGVHQDKGTTSIKPPRLPEGYKLLKDNLNNKEIIPFLKYLKGRGITLEQIINNNIGYVINGSFYKVDGESKVSLRNSIIFFTYDNNGNYQYWNTRSIEKNPYIKSINAPAKQDEVGRKDVIFNLNIARKKFLVITEGVFDALTFHEYGVATLGKQVTENQIKKIIDYVSIDTSIYIMLDTDALDNNIDLAYKLKTHFNKVYFVPHGDEDANDMGTRKAFELLKQNRVLVTPESIQSYKIQQKLKL | 355 | putative primase [Staphylococcus phage K] | YP_024506.1 | 0.0 (352/355) | DNA primase | DnaG, DNA primase (bacterial type) | COG0358 | 1.08e-12 |
| 104 | 80661 | 666 | MSNSKKDILEFVDEYITALRVGNEQRQHQLEEMGKEETATLTDVAKAITNLMLGVNEQMTDLEYNNELNLNILIDALYKAELINEDVLDYIQESIDKSQEEPKNEEEKGEQE | 112 | ORF127 [Staphylococcus phage G1] | YP_240943.1 | 2e-55 (111/112) | | No putative conserved domains have been detected | | |
| 105 | 80999 | 667 | MEKNISTHTKGISQADMEKWIEAVVQGTVDGKQVDEKTAKQLDRIGSRSVSLEEATRIAKVLNAVTAQEVTGDFNDAFNAIDLMMIMEDELGVTQEKVGKAKDKLNEKREAYLKEKQEELRQKQQEEAQKETESDSNEKVIQLKKNDEQ | 150 | ORF098 [Staphylococcus phage G1] | YP_240944.1 | 2e-78 (149/150) | | PHA02277, hypothetical protein | PHA02277 | 9.45e-43 |
| 106 | 81438 | 668 | MTNSKKKGDTFERKIAKELTAWWGYOFNRSPQSGGASWGKDNNAVGDIVVPQEANFPLVVECKHREEWTIDNVLLNNREPHTWWEQVINDSSKVDKTPCLIFTRNRAQSYVALPYDEKVYEDLRNNEYPVMRTDFIIDNIRKDKFFYDVLITTMNGLTSFTPSYIISCYDKKDIKPYKKVESNLSEVSKHEDELINDLLSDI | 202 | ORF064 [Staphylococcus phage G1] | YP_240945.1 | 2e-115 (201/202) | | No putative conserved domains have been detected | | |

Fig. 10Z

| | | | | | | | | | |
|---|---|---|---|---|---|---|---|---|---|
| 107 | 82063 | 82455 | 669 | MTSKERPLIVYFSGTGQTERLV NKININNSFETFRVKSGKEKVN KPFILITPTYMKGAIPKQIERFLE INGSPKEVIGTGNKQWGSNFC GASKKISEMFKIPLIAKVEQSGH FNEIQPILEHFSNKYKYVA | putative NrdI protein [Staphyloccocus phage K] | YP_024509.1 | 4e-68 (129/139) | Ribonucleoti de reductase protein | Flavodoxin_ NdrI | pfam07 972 | 2.44e-29 |
| 108 | 82470 | 84584 | 670 | MATYGKWIELNNEITQLDDNGK NKLYKDQEALDEYLKYIEDNTR KFNSEVERIRVLTKEGTYDKIFD KVPDTIIDEMTKLAYSFNFKFPS FMAGQKFYESYASKQYDENKK PIFVEDYEQHNVRVALYLFQND YVKARELLVQLMEQTFQPSTPT YNNSGQANRGELSSCYLFVVD DSIESLNFVEDSVANASSNGG GVAIDLTRIRPKGAPVRNRPNS SKGVIAFAKAIEHKVSIYDQGGV RQGSGAVYLNIFHNDILDLLSS KKINASESVRLDKLSIGVTIPNK FMELVKEGRPFYTFDTYDINKV YGKYLDELNIDEWYDKLLNNDS IGKVKHDAREVMTDIAKTQLES GYPVVFYIDNANDNHPLKNLGK VKMSNLCTEISQLQEVSEIYPY SYSNQNVINRDVVCTLGSLNLV NVVEKGLLNESVDIGTRALTKV TDIMDLPYLPSVQKANDDIRAIG LGSMNLHGLLAKNMISYGSRE ALDLVNSLYSAINFQSIKTSMLM AKETGKPFKGFEKSDYATGEY FVRYIRESNQPKTDKAKKVLDK VYIPTQDDWDELAKAVKVHGL YNGYRKAEAPTQSISYVQNATS SIMPVPSAIENRGYGDMETYYP MPYLSPITQFFYEGETAYKIDN KRIINTSAVVQKHTDQAVSTILY VESEIPTNKLVSLYYYAWEQGL KSLYYTRSRKLSVIECETCSV | putative ribonucleotide reductase large subunit [Staphyloccocus phage K] | YP_024510.1 | 0.0 (701/704) | Ribonucleoti de reductase large subunit | RNR_I, ribo-nucleotide reductase | cd01679 | 3.18e-130 |
| 109 | 84598 | 85647 | 671 | MDITQKVKQHNKNAVLKATNW NIEDDGMSDIYWEQGISQFWT PEEFDVSRDLSSWNSLTESEK NTYKKVLAGLTGLDTKQGGEG MNLVSYHEPRPKYQAVFAFMG GMEEIHAKSYSHIFTTLLSNKET SYLLDTWVEENDFLKVKAQFIG YYYDQLLKPNPTVFDRYMAKV ASAFLESALFYSGFYYPLLLAG | putative ribonucleotide reductase minor subunit [Staphyloccocus phage K] | YP_024511.1 | 0.0 (347/349) | Ribonucleoti de reductase minor subunit | RNRR2, ribo-nucleotide Reductase | cd01049 | 1.74e-63 |

Fig. 10AA

| | | | | | | | | |
|---|---|---|---|---|---|---|---|---|
| | | RGQMTQSGAIIYKITQDEAYHG SAVGLTAQYDYNLLTEEEKKQA DKETYELLDILYTNEVAYTHSLY DPLELSEDVINYVQYNFNRALQ NLGREDYFNPEPYNPIVENQTN VDRLRNVDFFSGKADYEKSTNI KDIKDEDFSFLDSKEYNTAKEF L | | | | | | |
| 110 | 85665 | | | | | | | |
| | 85994 | 672 | MDRKEAMDLLSKAEILFKKHDE FSCVSDINDPMKLFSSSKDAKA DDTSKSFQLEFMHDMTMYTLS YGSGQLKLIDLAEGYEAOKATV VNSFPEIIKTLEKDDSEDGKNE | 109 | hypothetical protein KgORF82 [Staphylococcus phage K] | YP_024512.1 | 4e-55 (106/109) | | No putative conserved domains have been detected |
| 111 | 86298 | 673 | MEKMNSLVDLNTAIRQKKDVIV MITQDNCGKCEILKSVIPMFQE SGDIKKPILTLNLDAEDVDREKA VKLFDIMSTPVLIGYKDGQLVK KYEDQVTPMQLQELESL | 106 | thioredoxin-like protein [Staphylococcus phage K] | YP_024513.1 | 8e-54 (106/106) | Thioredoxin-like protein | PHA02278, thioredoxin-like protein | PHA022 78 | 1.12e-45 |
| 112 | 86505 | 674 | MDELISKSRRYIMRDENHYMLF NEKYNNDRLIEKVCKHGGKVT YYTDSVLPYYVLKDLSSHPDSE VVYRMRNGFTAKEVDNIALSF MGTKVIIDISVVFPYVNPYDIIRS LHDIKTNVDEVHLSFPRILEVDE KQEKFYFFDGEAYDLKPEYKV DFADKIRVSLSVWKMYIYILTSS RDFEDVDNVTKLKQQRKIKI | 198 | hypothetical protein KgORF84 [Staphylococcus phage K] | YP_024514.1 | 5e-109 (196/198) | | No putative conserved domains have been detected |
| 113 | 87111 | 675 | MSTANRRDIARKISENTGYYIQ DVEEILSAETDAISDLLEEGYTK VKNHKFMQIEVIERKGKKAWD GLNKEYFHLPNRKAIKFKPLKE LEEVIDRLNEEEK | 101 | putative integration host factor [Staphylococcus phage K] | YP_024515.1 | 2e-51 (101/101) | DNA binding / bending protein | Bac_DNA binding | pfam00 216 | 4.22e-12 |
| 114a | 87492 | 676 | MKVLILFDHIREEHFSVSKDGS VKSNVLNTPNGKTLKKLLEKCS NLKRDKTNRDYDIDFLYNAVPT PIRNDYGKIIKYQDVKQAEVKP YYERMNNIIIDNSYDMIPVGKL GVKYLLNVTAIGKVRGVPSKVTI ENETSSHDVWVLPTYSIEYTNV NKNSERHVVSDLQTVGKFVEQ GEEAFKPKEVSYELVDNIERVR EIFNKEVKNDNYDGVDITAWDL ETNSLKPDKEGSKPLVLSLSW RNGQGVTIPLYKSDFNWENGQ DDIDEVLELLKNWLASKEDIKVA HNGK | 290 | putative DNA polymerase [Staphylococcus phage K] | YP_024516.1 | 6e-167 (289/290) | DNA Polymerase | DNA_polA_I Ecoli_like exonucleas e | cd06139 | 3.30e-09 |

Fig. 10BB

| | | | | | | | |
|---|---|---|---|---|---|---|---|
| 115* | 88530 | 89042 | 677 | VYQLNRGGTVKKDYMTSVKNN KKVCRRCNEELDLSNFKTYKK NDKIYYQSMCIPCRKEYNKLDK TKNTIKKCYDKNGDKYRKQGN EYNTSDRGRELNKKRSRKYRE NNSLKAKARNSVRTALRNGSLL RPSKCSECNKECIPEAHHPDY NKPLEIKWLCKSCHEDTHHKK | 170 | hypothetical protein KgORF87 [Staphylococcus phage K] | YP_024517.1 | 4e-79 (145/156) | | No putative conserved domains have been detected |
| 114b | 89178 | 91508 | 678 | MSTENFKDFESIQDTKVGWYL AVTQEVKESLRLSDLAYEVTDV GGYDKPLEDFKLWFVTKLLRFF SDKIKEIQKENKKIAKKEYDVKA PEYKEWLENKLNETVVELDDT EKKFRVSELEKKYIQLGLSPEIV NMNLVMNNDEFISIAEQSPEYM GLSDYAKSYTLNTAINLINEYRD VKDVVNDIDGGNFNYDWFPIEL MHPYASGDTDVCRRIHCDVVK KLKEQDRPKSMHLLEVNYPRL TKSLARIESNGLYCDLDYMKEN DESYESEMAKNHATMREHWA VKEFEEYQYNLYQMALEEHEK KPKDRDKDIHQYRDKFKDGKW MFSPSSGDHKGRVIYDILGIQL PYDKEYVKEKPFNANVKEADLT WQDYKTDKKAIGYALDNLELKD DVRELLELLKYHASMQTKRNSF TKKLPNMINKQKRTLHGSFSET GTETSRLSSSNPNLQNLPAHTS DVNKFDYKHPIKRSFVSRFENG VLLGADYSALEMRIIGLFTKDPD MLQSFLNGEDIHKATASIVYNK PVEEVTKEERQATKAVNFGLAF GESPFSFAGKNNMEVSEAEIF EKYFQTKPSVKTSIDNVHEFVQ QYGYVDTMHGHRRFIRSAQST DKKIKNEGLRQSFNTIIOGSGSF LTNMSLTYLDDFIQSRNLKSKVI ATVHDSILIDCPPEEAKIMAKVTI HIMENLPFDFLKAEIDGKEVQY PIEADMEIGLNYNDMVEYDEEE IDTFNSYQGYIKYMMNLQTLED YKESGKLTDEQFEKATNVVKS EKHIYQEI | 776 | putative DNA polymerase [Staphylococcus phage K] | YP_024516.1 | 0.0 (770/776) | DNA Polymerase | DNA_pol_A pol_I_C cd08637 8.00e-72 |
| 116 | 91577 | 91819 | 679 | VNTGEIRFNRSMDEWIITSMYQ DELGDMNIVTFYNREENKHG STVLPTESSTGEVTEELANLEE | 80 | ORF181 [Staphylococcus phage G1] | YP_240959.1 | 7e-37 (77/80) | | No putative conserved domains have been detected |

Fig. 10CC

| | | | | EYPLALPLSSISVNI | | | | |
|---|---|---|---|---|---|---|---|---|
| 117 | 91836 | 92318 | 680 | MEIHIDSLDFTNFTIKDRNGNSQ EFDITDELRITEYTIQEDFMQQS AKYAFWASILEKVRAYSEMEQ RNLETIGSKLNLTIRQEYEQQG KKPTKDMIESSVYIHDSYQQQL KVVEAWNYKVKQLQYVVKAFE TRRDMMIQLGAELRQTNKNGG ITNPFSH | 160 | hypothetical protein KgORF91 [Staphylococcus phage K] | YP_024519.1 | 5e-90 (160/160) | | No putative conserved domains have been detected | |
| 118 | 92405 | 93676 | 681 | MDFNQFINNEASKLESNNSSFN NNVESYKPKNPVLRLGNIKDAN GNKVVKENAFVRVLPPAQGTN- VFFKEFRTTGINYSKKDGSQGF TGLTLPAEEGSSVLDPYIQDWI TNGVQFSRFPNKPGVRYYIHVI EYFNNNGQIQPKTDAQGNVMI QPMELSNTGYKELLANLKDTM LKPSPNAPHSFISANEAFLVNIV KAKKGEMSWKVSVYPNAPLGA LPQGWEQQLSDLDQLAKPTEE QNPNFVNFLINNVNNTELSHDN FKFNRETNVLGEEPSEPKQAP TQQDVDSQMPSNMGGQPNQP QQGQVGGYAQQGQSNGQGQ QLQGTQQPINNTQFGQGTPSG QQPSNTGSVDWDNLAQQQSQ PDSNPFNDFDVSSVDDSQVPF ETQPQNTQQAPEPHQTTQEFP KQKQTQSIDDVLGGLDLDNL | 423 | hypothetical protein KgORF92 [Staphylococcus phage K] | YP_024520.1 | 0.0 (421/423) | | No putative conserved domains have been detected | |
| 119 | 93736 | 94992 | 682 | MARAKKGKEVDLTDLNTIDLGK ELGLTLLSDTNRADIKNVIPTMV PQYDYILGGGIPLGRLTEVYGL TGSGKSTFAVHLSRIATQLGVIT IWIDIEGTADNNRMEQLGVDVS KLFSIQSGEGRLKNTVELSVEQ VGKELEYWIDTFNEKIPGVPIVF IWDSLGATRTQKEIDGGIDEKQ MGLKASATQKVINAVTPKLNDT NTGLIVINQARDDMNAGMYGD PIKSTGGRAFEHSASLRIKVHK ASQLKQKSELTGKDEYHGHIM RIETKKSKLSRPGQKAEADLLS DYMVGKEDDPILLNGIDLEHTV YKEAVERGLITKGAWRNYVTLN GEEIKLRDAEWVPVLKDNRELY LELFSRVYGEHFPNGYSPLLNN KVIVTQLEEYQALENYYKEWAT | 418 | putative DNA repair protein [Staphylococcus phage K] | YP_024521.1 | 0.0 (417/418) | DNA repair protein | recA | cd00983 | 1.99e-34 |

Fig. 10DD

| | | | | | | | | |
|---|---|---|---|---|---|---|---|---|
| | | | DNKQEEQEEELKGESQEKDSE | | | | | |
| 120 | 94996 | 95349 | 683 | MDNLIDKNMSQVKESLGNANS SDVLPLPYKDIAKKFEEVKEKG ESIIIEEGGFPYTDSTVMYIEHV TDRWAGGYSLIRHEGEEVKVP KTIHFSDIYYKDKSHKVRIIFEGA NPYEES | 117 | ORF121 [Staphylococcus phage G1] | YP_240963.1 | 3e-61 (116/117) | | No putative conserved domains have been detected |
| 121 | 95336 | 95998 | 684 | MKKANNGNRYVIDIDGIPVDFE RDLDSLLNRYKNLRWSLYHRY AGILSNDFERQELREYIDEQFIK LVKEYNIRSKVDFPGYIKAKLTL RVQNSYVKKNEKYKRTEIIGKK DYTVESLTEDLNEDFEDNQIMS YVFDDIEFTEVQSELLKELLINP EREDDAFIVSQVAEKFDMKRK EVASELTELRDYVRFKINAYHE YYAKKELNNHRVNTENHIWEN | 220 | putative sigma factor [Staphylococcus phage K] | YP_024522.1 | 1e-122 (220/220) | Sigma factor | No putative conserved domains have been detected |
| 122 | 96126 | 96758 | 685 | MAKKNVNDVLQQESVTVADKY LQVKVNRDGYTRTHEGQYAYK VVSEGEELFLYPVQTDGKGTL NVMKKSPIAYTDGDNIHFVVNT VVDPYNHSFIRTEDIKGLDKGK QLIQAFLAFVEDRFKFGVYNVF VANNKEDVLSIVDPTDNDADEV KDSLEHAHEDVIADFPASPARK DVKGVDSGEGQGDTSEPSAPK NVQVTPKEDGADVSAE | 210. | hypothetical protein KgORF95 [Staphylococcus phage K] | YP_024523.1 | 1e-117 (210/210) | | PHA02283, hypothetical protein | PHA022 83 | 5.30e-71 |
| 123 | 96781 | 97293 | 686 | LAKLNLYKGNELLNSVEKTEGK STITIENLDANTDYPKGTFKVSF SNDSGESEKVDVPQFKTKAIKV ISVTLDVDSLDLTVGDTHQLST TITPSEASNKNVSFESDKSGVA SVTSEDLIEAVSAGTANVTVTT EDGSHTDIVAVTVKEPIPEAPA DVTVEPGENSADITV | 170 | putative major tail protein [Staphylococcus phage K] | YP_024524.1 | 3e-88 (168/170) | Major tail protein | Big_2 bacterial surface proteins containing Ig-like domains | pfam02 368 | 1.61e-03 |
| 124 | 97308 | 97535 | 687 | MEKTLKVYSNGEVVGSQVANN DGATTVSITGLEAGKTYAKGDF KVAFANDSGESEKVDVPEFTT KTPTEEPSGDA | 75 | ORF189 [Staphylococcus phage G1] | YP_240967.1 | 1e-34 (75/75) | | No putative conserved domains have been detected |
| 125 | 97631 | 97891 | 688 | MDIPTILFRNPYDYTKVKKLME NKEQYIVVKFDSVSVHNLNVQ GMMNVIQDYLHYGYRVKEYG QENSSKDDERDVKGYLYERVG E | 86 | ORF174 [Staphylococcus phage G1] | YP_240968.1 | 2e-42 (86/86) | | No putative conserved domains have been detected |
| 126 | 97895 | 98650 | 689 | MGIIVNSNHIQSDTLYEYDSFFD | 251 | hypothetical protein | YP_024525.1 | 1e-141 | | PHA02284, | PHA022 | 1.74e- |

Fig. 10EE

| | | | | | | | | | |
|---|---|---|---|---|---|---|---|---|---|
| | | | | IEKVDTFEEGLLSIQDEPTVLAG FIYDDITFNKVINSNSDIDDYIKN NDIYYVSDIGLLPDTFITVDSDR KYYSLLQQITELSKDPFPKWVE DDAKGLTKYYNFQDFEDVFDL NSFYKKEVDMVREKCYNNGNV YLLYEVLPDYKLPLAYSLLSNIK EHGIVIIGSQTRSNNDILTFYVK GMDAKAIASMFNVEHDYDSNIF HTFVNSHINILGNQITKFIREKG SSYE | | KgORF97 [Staphylococcus phage K] | | (251/251) | hypothetical protein | 84 | 41 |
| 127 | 98643 | 99893 | 690 | MSNYKTIEEVQAVIIGVLFKDEG KIITSKFNKITKEFGLDRIGKDDL KEIVEDIRQDAYLNELKNKAIKG KVTLGDLKDVADNQVFEGNNY HEEVSTYVVAKEKELSHLREQ RKHNRHTAYPQIMFDELKEHM VKELQGETLVEHHGSKANINDT ELIVLLSDFHIGSIVSDMTNGKY DFEVLKARLNHFINTTVKEIEDR EISNVTVYFVGDLVEHINMRDV NQAFETEFTLAEQISKGTRLLID ILNVLSNVVSGELRFGIIGGNHD RMQGNKNQKIYNDNIAYVVLDS LLLFQEEGLLNGVDIIDNREDIY TIRDTFGGKSIIINHGDGLKGKG NHINKFILDSHIDLLITGHVHHFS VKQEDFNRMHIVASSPMGYNN YAKELHLSKTKPSQQLLFINKE NKDIDIKTVFLD | 416 | hypothetical protein KgORF98 [Staphylococcus phage K] | YP_024526.1 | 0.0 (413/416) | | | No putative conserved domains have been detected |
| 128 | 99907 | 100275 | 691 | MDTIFIIGVAFITFATFNIVFRLFD LWTTEKKMVSQGQPPLSNFEY YHVIVPYLVGVIVIILSIIFRDSLY SAQSGFGVIITSFIYMLVYVIIGL VGSFVLTIFQARKARQYQTQED NNEVQ | 122 | hypothetical protein KgORF99 [Staphylococcus phage K] | YP_024527.1 | 5e-63 (122/122) | | | No putative conserved domains have been detected |
| 129 | 100262 | 100573 | 692 | MKFNDIYEQLIKNDTVQNIHES QDDKGNIYTIQFDKGNDKYLFN VINDGFLKEMTNGMVDHPEGQ PYSVSLINKETPSMSVKQYLTD VEDIVPTIRKMEKDFL | 103 | hypothetical protein KgORF100 [Staphylococcus phage K] | YP_024528.1 | 5e-53 (103/103) | | | No putative conserved domains have been detected |
| 130 | 100637 | 101173 | 693 | MDFNFSAFDNSSLAMRISEGV YYFNDTPYYFIEHVEEEMSEYV IVYDIHDREEKENPQKKYRIEPY QRTIPGGTPLSNLIKSMMPQRK YPKKVTEDPIFVANVIPLGTDTV TGKTGKGFFERDKDRTIYSQKE | 178 | ORF075 [Staphylococcus phage G1] | YP_240973.1 | 8e-100 (178/178) | | | No putative conserved domains have been detected |

Fig. 10FF

| | | | | | | |
|---|---|---|---|---|---|---|
| 131 | 101166 | | PTKVVHGQYTGVFIGLTSVKW NRTYTPLESVVEYYKRVKGDR LNV | | | |
| | 101933 | 694 | MSNDVVKFYEKDIKDLIRTKKH MFKDDEITSDINIDIRIFNEKVICQ GKCRTDCLVLDRNGTVMGIEIK TERDSTQRLNNQLKYYSLVCK YVYVMCHDKHVPKVEQILKRY KHNHVGIMSYISFKGKPVVGKY KDATPSPHRSPYHTMNILWKT NLMTILRLIRDPHTYRTGYSYN ASGRYSGEGNFSQTQSKR MKKPAIINQIIHYVGVDNTYKLF TRGVIYGYNNRWEVIEEDFFNT MKNGVRVINEQRQTK | 255 | hypothetical protein KgORF101 [Staphylococcus phage K] | YP_024529.1 | 5e-149 (255/255) | No putative conserved domains have been detected |
| 132 | 101911 | 695 | MSKDKPNRRKEIQHQPVNFAP TNTLTGANNSFFAKNPSEPKDA TSVIEYRILFIKRFDNVTSTDVKL QKKYALNLISEALDVKETYLSLK QKGKKTESILHTDRVYYVHRGK KLIGKCSIREQRTFKGKHLIFIFK TRHRVKAERKDK | 148 | hypothetical protein KgORF102 [Staphylococcus phage K] | YP_024530.1 | 2e-80 (147/148) | No putative conserved domains have been detected |
| 133 | 102357 102357 | 696 | MLKGFSEHVDKPTTSKTLYKTL TSGKVELLGVSYDSDYFPSGV TVQSYIEDIGNEDEGLQFVNKV NVVESMKQAVVGMNNQLGSS GLGYVRTEQLKKELEETGLMT DLLARGTNLTSTKKVDIVSTFIE PEVTYQNITIAKDIKLRLRYKVEE ESPLNGYTHIVYLLTTEKLYDG QTLFGMLSKKDKLSKGDTDKLL AFFRNNSLISKSVFCVKLLSKD YYFNLYNTHETGIFFLEDTDVITI ACGQSYVKVNTKDIKSSYVKIE DKTHKLTELVINLKGDDTLTILF | 287 | ORF036 [Staphylococcus phage G1] | YP_240976.1 | 1e-160 (286/287) | No putative conserved domains have been detected |
| 134 | 103592 104323 | 697 | MARKKNLRNKNSDIKVVPDKE KESILSKLYHNKLLRSKVDNAL DEDMSYDDIIELCKEYDLESK SAITRYKSKRKEAIENGWDLGE LIDKRKKTSVKDIKEKETPILEEE QLSPFEQSKHHTQTIYDDIQVL DMIISKGAKGLEFVETLDPALMI RAMETKDKITGNQLKGMSFIGL RELQLKQTAQDTAMSEVLLEFI PEEKHEEVLQRLEELQNEFYK NLDLDEESRKLKEALDRVGYTI | 243 | hypothetical protein KgORF103 [Staphylococcus phage K] | YP_024531.1 | 6e-136 (243/243) | No putative conserved domains have been detected |

Fig. 10GG

| | | | | | | | |
|---|---|---|---|---|---|---|---|
| 135 | 104341 | 104799 | 698 | MADEISLNPIQDAKPIDDIVDIMT YLKNGKVLRVKQDNQGDILVR MSPGKHKFTEVSRDLDKESFY YKRHWVLYNVSVNSLITFDVYL DEEYSETTKVKYPKDTIVEYTR EDQEKDVAMIKEILTDNNGNYF YALTGETMLFDENKLNKVKD | 152 | ORF094 [Staphylococcus phage G1] | YP_240978.1 | 3e-82 (151/152) | No putative conserved domains have been detected | |
| 136 | 104864 | 105307 | 699 | MFISLNQEEKELLTKEESKYTPL ETSREFNTPKEEFIVTSYNEGK PLDYIAKEAKVSMGLIYTVLNY KVGKRNKKSPVEERIAHILKDK NLVKEIIKDYQYMNLQDIYSKYN LHKNGLYYILDLYHVERKSELK DKALEEDNIVE | 147 | hypothetical protein KgORF105 [Staphylococcus phage K] | YP_024533.1 | 2e-77 (147/147) | No putative conserved domains have been detected | |
| 137 | 105324 | 106028 | 700 | MRNKKSFQEQLNDMRNKEKW VSEEEFTEEVAPSEEPEVEEEK LYTLNELKENLLDAQGLKDVVA DFPASKDLYEPNKLYICTIPKGY RSTEVQPGQYIGISTGLLSESE DFSHLRGQMPRNLYETSHVLK PLVRINNTNLEYQQHELLEDIKD DKKIYDVELEDLRLVTGEEISHL EIVDSKFFESRINEILDRYTELT DSDDLLIYYSKLRELVGSDKMIY CSLLDKCVKIID | 234 | ORF106 [Staphylococcus phage K] | YP_024534.1 | 3e-118 (223/234) | PHA02290, hypothetical protein | PHA022 90 | 4.62e-30 |
| 138 | 106091 | 106489 | 701 | MSRKASIFYILVVIVLAFSISSYYI SSFMYHDKAKNEVSTELSNTG KIKEEKNVEFVGDYTLKKVENN KAYFMETLPTYLPGRTGDNSID MRYYKTSRFKEGVNFKLIRVYT EDGEDNPIHKYRFEAVPTKK | 132 | hypothetical protein KgORF107 [Staphylococcus phage K] | YP_024535.1 | 5e-70 (131/132) | PHA02291, hypothetical protein | PHA022 91 | 7.32e-18 |
| 139 | 106636 | 106878 | 702 | MEMADLERFDTFVRLVSDDEL SEERALELSVDLLNPILEGGTA YQAKKRIRSKFGKIEAKNFKRN YKFLLKSIAQIDQRR | 80 | ORF182 [Staphylococcus phage G1] | YP_240982.1 | 2e-35 (74/80) | No putative conserved domains have been detected | |
| 140 | 106883 | 107440 | 703 | MIEREKLVKEIEDANRDIQLRLK EVDDYKDSIRSKGTRNYVSTKV LDSVMVGLIISFFILVMLRVLEYF VTGNAVYSPLAPAVIIMFVLALG TWKVSKMNKIVSYRGTIKMYW ELSNAEQNQAKVFKYPNDEVDI VSKHNLRQITFSEINILHLKYMR YNKAVEQHTKLSKELFKKDKET VDKNK | 185 | hypothetical protein KgORF108 [Staphylococcus phage K] | YP_024536.1 | 1e-66 (120/135) | No putative conserved domains have been detected | |
| 141 | 107476 | 107652 | 704 | MVIPSIKAQNKFKNELEYYKQG | 58 | ORF240 | YP_240984.1 | 8e-25 | No putative conserved domains | |

Fig. 10HH

| | | | | | | | |
|---|---|---|---|---|---|---|---|
| | | | HISESKMLELAFDYIQELEQNN EYVTNLLEEERYGE | | [Staphylococcus phage G1] | (58/58) | have been detected |
| 142 | 107645 | 107893 | 705 | VSKFIGVYLFNLLVVALIYTVGF LFFYGVASLVIILTHATIDPFVLA TFLGIGFLVIRTAHRIMARVIND AVAKAIKDKENE | 82 | No significant similarity found. | | No putative conserved domains have been detected |
| 143 | 107886 | 108119 | 706 | MNKGEFIMDKTLPKFSVYEVIV KTVIMTPTEGSSDLESFYFSTR ELAERFVEENTVETKNGKRVSF AVKERKVNQPG | 77 | No significant similarity found. | | No putative conserved domains have been detected |
| 144 | 108200 | 108688 | 707 | MKVSEEVKQSYLENRANTKMD KISWSELRSSPLGITLGDIIFYSV VIIDNIIAILTLTLIGTITDSIESTL AQIIVGMFIIITYGILSALIPILVHK AVSPGWSYTEWNESYYIRLPG EENYKYYSKWYLDLLGVKEFY YKRDNGEEVKEKIYHGLFKLK | 162 | ORF076 [Staphylococcus phage G1] | YP_240985.1 | 2e-52 (104/112) | No putative conserved domains have been detected |
| 145 | 108724 | 108843 | 708 | LLTNRPLTILEYKKLKKLLDKESEI RKQEDLEEYKQYNSN | 39 | ORF076 [Staphylococcus phage G1] | YP_240985.1 | 5e-13 (39/39) | No putative conserved domains have been detected |
| 146 | 108858 | 109106 | 709 | MISSFDSILLVIYIIIAFAVAMAIIY LVFKGMTILLDKLMMLLSKTTL DVEACSMIMAVISTIVFGIIVLLI WLAVNNILL | 82 | No significant similarity found. | | No putative conserved domains have been detected |
| 147 | 109118 | 109294 | 710 | MDFNDFINSESDRVGKPKQKK KVENKLPSSTPIEDKEKKLKEIR KKSLYIDLRRKRND | 58 | ORF241 [Staphylococcus phage G1] | YP_240986.1 | 1e-23 (58/58) | No putative conserved domains have been detected |
| 148 | 109287 | 109583 | 711 | MTKETNVLYKDKYRDYTIVVRL AGNIIVTEVDKKHKTAFTPIIFDN GVEGVELVMRIGSVELSMTDL REFTKEVSTAQKALEYFNKKLY IKGLTDEAF | 98 | ORF152 [Staphylococcus phage G1] | YP_240987.1 | 1e-48 (97/98) | No putative conserved domains have been detected |
| 149 | 109631 | 109813 | 712 | MLLGILWFIWGFVSYFVLMFGI EFWKDRWMPGVIGAGALLLFL FWIMKSIHNAMTVVYLY | 60 | hypothetical membrane protein MbpK [Staphylococcus phage A5W] | ACB89144.1 | 3e-25 (60/60) | Membrane protein MbpK |
| 150 | 109826 | 110197 | 713 | MIDILVIHYEETNKRVLKETIQTI QNHLNDEHGLVKMTATKLSRE NIEKRFNNYNIVIAEDDPDNSYH YGEAVEDADFIIDIPISYLDIHAGI EWDVDNPVDMLDRNPDFIEAV NKLNEDLML | 123 | ORF119 [Staphylococcus phage G1] | YP_240989.1 | 9e-63 (119/122) | No putative conserved domains have been detected |
| 151 | 110210 | 110557 | 714 | MLNEKLKNLEDTKVYMINSIASL LSASTGKSSKVFFDEGTIKVSG | 115 | ORF124 [Staphylococcus | YP_240990.1 | 9e-60 | No putative conserved domains |

Fig. 10II

| | | | | | | | |
|---|---|---|---|---|---|---|---|
| | | | | ETKAVEVIDNLVHPHSGRLPIKT TERIALGRLTDSLQFVISEIEVV KDQIIDEENEAYIDFVMEDWNW D | | phage G1] | (115/115) | have been detected |
| 152 | 110557 | 110835 | 715 | MPMDLLTIASVAFIAVVIIDLIND DMSYMLTGTAILINIWAGFYGW FFLLQAGMLLFLLLARKVKDDK ESILYSSASLICALGMIINLLSFS | 92 | ORF162 [Staphylococcus phage G1] | YP_240991.1 | 1e-43 (92/92) | No putative conserved domains have been detected |
| 153 | 110905 | 111210 | 716 | MSKETIRRQFSNAIEIMATTKE WWNFPKSFDTNKEFKIKTFKN DTLVFEVREGSRNLGSFVVFTN IDFDYDKLEGTSTQYMINYFAK KLTKDMFNYHKLQL | 101 | ORF140 [Staphylococcus phage G1] | YP_240992.1 | 4e-52 (101/101) | No putative conserved domains have been detected |
| 154 | 111225 | 111575 | 717 | MREELKPFNRKQVNVKGYLDD VKYSKRRRHKGNQHGCVKITV TDVKINGIPIDHVNIEVGISFYEK LKELQGKRIQFVGTVYKYVKHA RGRKGRIKGFYKEDYSVTLDKK LQKEEK | 116 | ORF122 [Staphylococcus phage G1] | YP_240993.1 | 2e-59 (116/116) | No putative conserved domains have been detected |
| 155 | 111575 | 111754 | 718 | MTEWYALLCYYDKVGKKKIPRQ VRAHRDISVLEELKERLEERNP NTEYSIKTTKEFDEER | 59 | ORF237 [Staphylococcus phage G1] | YP_240995.1 | 6e-21(46/59) | No putative conserved domains have been detected |
| 156 | 111980 | 112390 | 719 | VKLEDKVLERIDSLGGKLGDIS QHAWEALVKYQIIYGIIDLIVGIV VIALTLFLWKVFINQHKKVNDM DRDDDYSLLFEDCEDLSGIGLF YVIVTSLISLFAFIYLYIGIPMDIIK IILNPEVFAVKDLIEQAKGGN | 136 | ORF107 [Staphylococcus phage G1] | YP_240996.1 | 3e-34 (81/136) | No putative conserved domains have been detected |
| 157 | 112392 | 112685 | 720 | MKQRDFEFEEDFVLTYECEDC KHFEDWGHDEEPEECSECGS SDLINNTSHEDTECDMCKGYID MWQDGYRYMGDNKAYLEKED SGLICEDCYEKLDI | 97 | gp ORF160 [Staphylococcus phage A5W] | ACB89153.1 | 4e-47 (93/97) | No putative conserved domains have been detected |
| 158 | 112701 | 112988 | 721 | MNKAVEQASNAVGQGFSAMV WHQVLVGLGFILLGLILSLLVWV LVKKFHVPFNHPTAFVVYSIML VSIVASFIWGGLHVINPEYYAIL ELKGFIK | 95 | ORF157 [Staphylococcus phage G1] | YP_240999.1 | 3e-37 (93/95) | No putative conserved domains have been detected |
| 159 | 112999 | 113112 | 722 | MTKEELEQRVKELEAENKELKK QIERFEDEGGKTKDE | 37 | ORF362 [Staphylococcus phage G1] | YP_241000.1 | 6e-10 (36/37) | No putative conserved domains have been detected |
| 160 | 113105 | 113371 | 723 | MNSRQKKILTLTVSNFLILALDT VALIRYKKGKIKQENYNTGQITR MIATTANSLGILYLEEEQERKEVK | 88 | ORF170 [Staphylococcus phage G1] | YP_241001.1 | 2e-31 (68/86) | No putative conserved domains have been detected |

Fig. 10JJ

| | | | DIKVGTFEIGALKRFTNNK | | | | |
|---|---|---|---|---|---|---|---|
| 161 | 113449 | 113754 | 724 | MKGIIIFYKEETKEDLGYFLGFIN FKLEGLSYTTEGTLVDNDVVVL KDNQINEDNLEQFSMSNNNLVI GILGHSSLSVRIYEKGIRQEFDR VEEYLEELRQ | 101 | No significant similarity found. | | No putative conserved domains have been detected |
| 162 | 113754 | 114155 | 725 | MIFILIFGLLFILSLLGIFIYSIVLR KKKQLIEERESFGIYNRTKEKL GDVTRLGYEEDVYKLIHNQSNK TIIEDKKSKVVDTIKMYELELT SVDVSKVEGLSPLDTEPMTNM KLLSYKLDREGLYSLSKFI | 133 | No significant similarity found. | | No putative conserved domains have been detected |
| 163 | 114166 | 114402 | 726 | MEFIDKNNVIKAYDIPNVYLKGY VLQACDKNGDTTAYDGYDQIH YKEGRVLTFPFDKPLRKINVLS GYYKLFKKEDII | 78 | No significant similarity found. | | No putative conserved domains have been detected |
| 164 | 114399 | 114926 | 727 | MIYFVSDLHFGHDNIREFEAPT RSHWNSVEEMNEGLIELWNNT ITNNDIVYNIGDFFFNMKPSKVE DILNRLNYKEMILAGNHDHKKL IKLYERNGITVKYADMIKKDGKR FYLSHYPTLIGRKNMFNIHGHIH SQLMGTEYHINVGYDVEGKIAY SFDDIISRAGEYNGEIQR | 175 | phage protein [Staphylococcus aureus subsp. aureus TW20] | CBI49957.1 | 1e-66 (124/165) | Phospho-esterase or phospho-hydrolase | MPP_AQ15 75, metametallo- phosphatas e family | cd07390 | 2.83e-37 |
| | | | | | | gp43 [Listeria phage A511] | YP_001468613.1 | 2e-18 (65/174) | | |
| 165 | 114907 | 115218 | 728 | MEKFKGKDLYKTRIRKQTIKNL VIKTEKLHNKHGKYRPIGHVYY YPKTKEFTLSKPEQKIFIEYMKA LGFSVKHKRRKKIIIVYKNVLDE YLSMYQEAIESTC | 103 | No significant similarity found. | | No putative conserved domains have been detected |
| 166 | 115264 | 115443 | 729 | MKHFILILGIVILVIALGIVLPAWIL QLVLSAFGVKVSIWVCIGIFILIS AVGSMFSRN | 59 | ORF236 [Staphylococcus phage G1] | YP_241002.1 | 3e-22 (58/59) | | No putative conserved domains have been detected |
| 167 | 115458 | 115721 | 730 | MAKYESNINGENYIATPSQALR EALAELIREEKNFAEYQTKGEE QYESQLQLRHFDSMISQYEEAI RVLEDRYSPQIFIPKDNKEEK | 87 | ORF171 [Staphylococcus phage G1] | YP_241003.1 | 3e-39 (80/86) | | No putative conserved domains have been detected |
| 168 | 115724 | 116041 | 731 | MKAESIARFFQDKVLQIEGYKV RFTQASSSYILDIDTMDESVLFL DTVVFTLSGKYLLDTHITINKPE TLSSNELYTEISNKLQEIVGDQT KTDIELSKYFKEVK | 105 | ORF137 [Staphylococcus phage G1] | YP_241004.1 | 4e-42 (88/105) | | No putative conserved domains have been detected |

Fig. 10KK

| | | | | | | | |
|---|---|---|---|---|---|---|---|
| 169 | 116042 | 116722 | 732 | MSSEAITNHLLNLNQIKIKEYNIH AYIKKSVCSGIENADFEVRINYI ADKDPNYIRTINSIIFVDYSNRN PKEILLQFKEKILSIVKEQVEIDN DFIEAIKDINTNHELEKLEPFINK EYYSMFKSSIEKEVPVALSSEV LNRCTGKTSTLAYLAIEKDLPLI VSNNSMMKMLKKDYPSVKVSS VEDFSNYNIKGEIVLIDEVDVDQ LYSADRVSVDALLVGIIKN | 226 | ORF055 [Staphylococcus phage G1] | YP_241006.1 | 4e-84 (158/226) | No putative conserved domains have been detected |
| 170 | 116800 | 116958 | 733 | MVGIIILLVGLILFLASGYKLVLGK YYDDIDI KMI FTIFGIGAII I I TG FIL | 52 | ORF263 [Staphylococcus phage G1] | YP_241007.1 | 4e-12 (38/52) | No putative conserved domains have been detected |
| 171 | 116974 | 117198 | 734 | MNYKEVLEVIKKNKPCKVRFTG SILAIVNKEFNADTDKGILQIDVS NINKNDYIKLQQYCLERDDYTV AGAILF | 74 | No significant similarity found. | | | No putative conserved domains have been detected |
| 172 | 117211 | 117411 | 735 | MNYRDFITDCISCGYKVHISVTE KRVHIISEMTSASYPKKEINLDE LQAYVYYMNNFGSQITTEGL | 66 | ORF211 [Staphylococcus phage G1] | YP_241008.1 | 5e-30 (64/66) | No putative conserved domains have been detected |
| 173 | 117412 | 117702 | 736 | MELVINIAVLLGMYGIYI-YVI KF-STGLSGILIVLGMAVGLYFYLDY LNVRENVIRLVSVMFGAFLFSIE MIYNKIMFEIKKSKYDKTVRTYR GDQ | 96 | hypothetical membrane protein MbpQ [Staphylococcus phage A5W] | YP_241009.1 | 3e-40 (85/96) | No putative conserved domains have been detected |
| 174 | 117853 | 118206 | 737 | MNARKARKNTKNHKDSSVVTK EQHLTYIYNKINYI IANSSSQGK TYVVMNLRTGYPDEFSLSKLKY LKEIKQHYKDLGFTVQTQVRKS RWSEKSIIRYYFNLGYIDSVLVP IIHISW | 117 | hypothetical protein KgORF115 [Staphylococcus phage K] | YP_024543.1 | 4e-57 (107/117) | No putative conserved domains have been detected |
| 175 | 118225 | 118398 | 738 | MDNPNLNKKTLRAVIKFEMDKDI EERAEALRREETRLSIARDNRK RLYIELESILEEE | 57 | No significant similarity found. | | | No putative conserved domains have been detected |
| 176 | 118401 | 118625 | 739 | MDFNLKDYAVRPITDKEGNMV VRTVVCLKREYSDWVVDKVY GRQESSETWLKFMQEIRNIERA KLRVEKWQVN | 74 | No significant similarity found. | | | No putative conserved domains have been detected |
| 177 | 118652 | 118810 | 740 | MSLSELLEYHKNSGKERAEYIS DNGNCRVAIMHYDKWAVVGDL ENAVFTIEK | 52 | No significant similarity found. | | | No putative conserved domains have been detected |
| 178 | 118816 | 118917 | 741 | MYLFAKIIISIDVIPI MSIIVVQI IT DYNDRI-I | 33 | ORF445 [Staphylococcus phage G1] | YP_241021.1 | 2e-04 (24/33) | No putative conserved domains have been detected |

Fig. 10LL

| # | | # | Sequence | Len | Match | E-val (%) | Domains |
|---|---|---|---|---|---|---|---|
| 179 | 119523 | 742 | MIIPLILMMTFGTFAFSYVAHDAYRVDEKGIMYAMVVGIVVINVIGLEMIIVECL | 56 | No significant similarity found. | | No putative conserved domains have been detected |
| 180 | 119709 | 743 | MIDIYLHSEYDKDKLKFILKAIRDFSPRELTYDFRNPKADVSIQELLGDDIDIFESIALDYPNDINILVGDSGYSIVVQNDFLTISGLSTAMKEVIG | 97 | gp ORF182 [Staphylococcus phage A5W] | ACB89175.1 | 2e-08 (38/92) | No putative conserved domains have been detected |
| 181 | 119999 | 744 | MIGFTILSTIMVILVIAMYTQVLVDMIQSIRYDRFDKVLNIVTFIVMTVVLVSGILIMFDI | 61 | ORF231 [Staphylococcus phage G1] | YP_241023.1 | 7e-11 (37/61) | No putative conserved domains have been detected |
| 182 | 120293 | 745 | MKAIVYCAKRYSKHTLKHILEELEAENSDLTFSTEISDLGEVDIVVQHTKLPFSELMDLCSKVSKGSDRFYVFVGNHSGYYINGDLYINEIGKFITSRETNVMM | 104 | No significant similarity found. | | No putative conserved domains have been detected |
| 183 | 120621 | 746 | MIEIRLVEGYDKSQLKFMLKKIKRVAPRELTYDIEAGIDSVDVNIEDVLPHKSPQEYERYSMLLEEDLWIVILESGYIAYWDGKKYGGEALDDIIYNMFKGRGRL | 105 | hypothetical protein KgORF117 [Staphylococcus phage K] | YP_024545.1 | 1e-22 (56/99) | No putative conserved domains have been detected |
| 184 | 120938 | 747 | MIEVFLSKDYDKDLLKAYLEYIRKSASRELKYNTNHTKGTDVNIENIISYTNQEVHHFSSYGMYRDDLCVFIDNTRVSEYLNGEPVGVDTIYKYIKEM | 98 | gp ORF185 [Staphylococcus phage A5W] | ACB89178.1 | 6e-19 (48/98) | No putative conserved domains have been detected |
| 185 | 121238 | 748 | MFKVYYTVYHRQSMKTIKDKLDRSGLIYFLYETWYKDINNVCPSNYNPEFGSLNKDIDIDRLIEAVNEEGILLINHGNYVTVEEW | 85 | ORF175 [Staphylococcus phage G1] | YP_241027.1 | 2e-33 (70/85) | No putative conserved domains have been detected |
| 186 | 121593 | 749 | MIDIEIKIWDETLRMQVEEEDVLSFLSKFKNKTTGDKEESYGVGLDESKWKVHPFYTRYEVHPEGYVRLKDTKTPVIFTKYRKELHHKPQFISSNIMDDEGKHTVALHKLVADTFIPIPWYLQGYNYTDLSVGLKDGDYENKEAVKAYNLAWYVGRIRGNAPMIKLMDLEDDRVLYFASIPQIENFIRDNKLDPKRFNYKTE | 202 | No significant similarity found. | | No putative conserved domains have been detected |
| 187 | 122667 | 750 | MEFKFEGTKEELNKEVHNLLKKVNYVYQVNIFENELRNLIDVKEKDYLFSLSVDYNWLMEEKQKDGYNDLASAIYEEYIETYLN | 84 | No significant similarity found. | | No putative conserved domains have been detected |

Fig. 10MM

| | | | | | | |
|---|---|---|---|---|---|---|
| 188 | 123008 | 751 | MDVKEIANTIMELWQMDGYRC TEPPLYESTLNHTRTYTALIVSI KGNYDTVQMFRKTPIMSMRGQ AQPASMLVNVIDDVIIIVYENVV YGVQNKEIKFIEEI | 102 | ORF145 [Staphylococcus phage G1] | YP_241031.1 | 5e-52 (99/102) | No putative conserved domains have been detected |
| 189 | 123520 | 752 | MTNKNYLYEEAHTVQGNEITAF RIPNDANGNPRYVHFMDLNIK LADYDNINKLYGFNKYRAKWF GGGVVFQSYNIEDTLNFALDKV KEIEAVKN | 95 | ORF159 [Staphylococcus phage G1] | YP_241032.1 | 1e-38 (76/88) | No putative conserved domains have been detected |
| 190 | 123857 | 753 | MKFKIEKNNSDIKTLWNLAKNG YMSYQTVHNIFKNESDEFIIFNS KQTYNKFMELRYNRSAIQ | 63 | ORF221 [Staphylococcus phage G1] | YP_241033.1 | 6e-28 (62/63) | No putative conserved domains have been detected |
| 191 | 124566 | 754 | MLKFKWKNKTIKSTQKTDNILL IIGGLVATITPKLVNWFLLLQDNI NIFLR | 52 | ORF253 [Staphylococcus phage Twort] | YP_238667.1 | 0.012 (21/38) | No putative conserved domains have been detected |
| 192 | 124794 | 755 | MKKITTTLNLIGMKNNERFTEEL KNYRQDVTFLKANKIVKYSK | 43 | ORF297 [Staphylococcus phage G1] | YP_241036.1 | 1e-15 (43/43) | No putative conserved domains have been detected |
| 193 | 125091 | 756 | MKFIKTIENLLTKAENKGQAILN GRYYDGYRNGELEEKYAIEIEG NKLVMRHWGTQTIEIDLGMKEI VSYYGESNSDRDSLNTLVYCL GIAPNFRYLPSKDLFIYEN | 107 | ORF135 [Staphylococcus phage G1] | YP_241037.1 | 2e-50 (97/107) | No putative conserved domains have been detected |
| 194 | 125514 | 757 | MFKLQNKVEIIVPKYTNSGKEIS SPAIKEAVNNATKICGGCTITEI KGQWWSDDEQRIMEDDNLNL EWYYDKGMQDMNDQQGLLQA LSKIARQLIVFVEQEAISIKINGT LYIIDYEDLDLLSYDLYELMFKN | 133 | No significant similarity found. | | | |
| 195 | 126409 | 758 | MNRLEIVKDTAMEYILMMDNSV MDGVMTQEEYNEAVSFEKVYD YTLSEANQECKFLGGKVLTFLV HEAIEEYA | 73 | No significant similarity found. | | | |
| 196 | 126711 | 759 | MRYEIVTLVNGELFMFATFKKA EAENKYQEWCDLYGQENVSM EKN | 45 | No significant similarity found. | | | |
| 197 | 126919 | 760 | MTKTIKQLESQLERLERKSDEQ LANGYYEAFERTCAQIRELDLQ IELKKNSETV | 54 | No significant similarity found. | | | |
| 198 | 127321 | 761 | MKLLNRDNEIVISIATLESVKQA LIWEYIDHIDNNILDSEIYDQEAV VVTSKTLQSIKFADTMEDLQEYI | 78 | gp ORF194 [Staphylococcus phage A5W] | ACB89187.1 | 1e-30 (66/78) | No putative conserved domains have been detected |

Fig. 10NN

|   |   |   | ADINWKLV |   |   |   |   |
|---|---|---|---|---|---|---|---|
| 199 | 127649 | 762 | MTNTIKGFLQTEEASTVKDVAT HGVQSGAIGRLIYTSDVVKFFD RHYSDIEAVVLDFLEGFTGQRY YDLLDYDLMRELEEHANVEFE DEDEYNNIQFDLAENIASDEIEG FEDMDEAEQADAVIEAMDDVE LEILDTDKVQFVNLAVEIVAQQ MQEA | 157 | ORF092 [Staphylococcus phage G1] | YP_241038.1 | 3e-63 (120/154) | No putative conserved domains have been detected |
| 200 | 128202 | 763 | MTIKEIINQLQAVENKELELFVC DKEGNNISIKDITLFDSEAEHTE NNPLGINY | 54 | hypothetical protein EFP_gp130 [Enterococcus phage phiEF24C] | YP_001504239.1 | 0.001 (23/55) | No putative conserved domains have been detected |
| 201 | 128378 | 764 | LNIREVHNVVKSAKSKLLQEQN NINNVMIDDYITEELHRRTQRS GTIQMNNNTASYSNGSYGSLE EIREAYDLSSLSTNEIKELLETF V | 89 | ORF166 [Staphylococcus phage G1] | YP_241041.1 | 7e-33 (70/89) | No putative conserved domains have been detected |
| 202 | 128732 | 765 | MRDLQERKRELKTLLFNLAIEK NRATDETLRSVLEEAHQEVGN QLRKVRKEIEILVEEKEREFWN DFDFNGLD | 73 | gp ORF003 [Staphylococcus phage A5W] | ACB88994.1 | 2e-28 (64/73) | No putative conserved domains have been detected |
| 203 | 131537 | 766 | MPHLKAYDKEGNILAIGYNVYT EQGSVIIPNLKPHTKYPQGEFY VSWEGDNYESEKTVVPEFTTL ESSYKEITFYAKDILTVKPKTAY DIAVDNGFTGTEEEWVKSIKGE PGEPGKPGEPGKPGEPGKTG EPGKDFTFDRFTEEQLDSLRVF VNPSDSNLQEVNKTMEDSLIVY PDNGEDIRLYPSTVDKTYFSNIT IRNSIPENTMNPDGSFTLNSNG WLFYTVKAVEKLAPGKTFSAKII TDDVPDPKASFEYSIQDSDGSY IQTITQLNKIND TTFAINNINIPEN SSKISLRIDTRQVTSPVNIKQFL LFDGSSTKKIQTVNNEEFIKGLI KEIDNMKISMKKETSYKIPVFTP VDYLIKDHPLVNNIFTDGLGKFS TSLNMENFKLRGGKSYYVDGE NGNDTNDGLSQSTPFKTFKKA QGIINNGDTLYVSDGDYFRVGG TLLPPISNKSINIGLGSNVNLFM ADEPTWTKTSGRDSTYEFTRS AVRRVVDFNNDREFTNVTSLD KVDTTLFSWYSDGTKVYVNNG | 759 | ORF002 [Staphylococcus phage 37] | YP_240100.1 | 4e-105 (251/690) | No putative conserved domains have been detected |

Fig. 1000

| | | | Sequence | Length | Top Hit | Accession | E value (Ident.) | Putative conserved domains |
|---|---|---|---|---|---|---|---|---|
| | | | SIEPNKKVVPLLSSQHLIVSSVP TDFYIENLNLYGGARPARFELN QDNSVYINNCVLSYASQVNGN GLEIVGGKEVIVNNSVANINNYM DGFNYHIGADSSKPLVIEINCTA LENGFEKGTAGTKSNNGSTTH DGLKAIRVNGIYARNDGGNVAD VNEGTESWNLGCTAFESYQGK DFQTSSGSHMWLDSCIAYGST NSINSSDPNSKIYTRLGSYQNK LILGEEIKY | | | | | | |
| 204 | 131859 | 767 | MKLYQVEHDNCEPYEDNFHFR EDNVYTNKEKLIKRIKEECYRE ETNYRGEQEFIKGDPRGFDGM DMITIHELNIVDCDINIKKGN | 85 | gp ORF004 [Staphylococcus phage A5W] | ACB88995.1 | 8e-31 (65/76) | No putative conserved domains have been detected |
| 205 | 132119 | 768 | MEFFIDRTSTINKKPIEGAYIKKL ELVDQKGNPFTLERWCVEINSL EELTEISKHEGEVIINTRGDSPF SPYLEIYDYYRE | 81 | No significant similarity found. | | | No putative conserved domains have been detected |
| 206 | 132289 | 769 | MERFKVKRIITTEEVRYIDAETE EDAWYSVEYEDEGTDTAHFNA EYGEWSYEKEEN | 56 | gp ORF005 [Staphylococcus phage A5W] | ACB88996.1 | 1e-19 (49/56) | No putative conserved domains have been detected |
| 207 | 132773 | 770 | MNKTFFKAIGKNTLEYSKQGLG FLVALLIMLIILSVFLAFIIGIPAGII YGLYALDINNYFITMLVTVEWFII LYGIVRTQDNKKPFVKLKLKDY LLTILYLTTITATSVLESVLLFKVL PFTGDTRAVITLLSFLLFLAVNR GICKIVIKSYKEYKEEN | 160 | ORF087 [Staphylococcus phage G1] | YP_241049.1 | 4e-65 (129/160) | No putative conserved domains have been detected |
| 208 | 133017 | 771 | MIFKKHKEEEVKKDINFIRIHDV SGTSTIIKQKDTKTNLNSFIGGL VFNGVKFLESNKGDTSIWFKD NIIHIDTVYYKEVADE | 83 | No significant similarity found. | | | No putative conserved domains have been detected |
| 209 | 133262 | 772 | MAYEYKNKIQDIITDNENYWCID NEKELEELQEVYQKAEAFDEIV NEFHYQLQNLESWNTLDQKDC QTLKQILEENIKEEE | 81 | ORF103 [Staphylococcus phage G1] | YP_241047.1 | 3e-17 (46/51) | No putative conserved domains have been detected |
| 210 | 133682 | 773 | MNIKYIDLVLENCDVVRLEPKD VKRFHVDGITEGIDYYGTSHISR TRRCTYFGILIDNPKEISQVGFA YPDNTNAYEMITAYSDITAIDIIY DDDTNEYTYVDFNEYNDYYNIN QKNEYNNMLEVTITESNSIEE EG | 138 | hypothetical protein KgORF2 [Staphylococcus phage K] | YP_024433.1 | 2e-61 (121/141) | No putative conserved domains have been detected |

Fig. 10PP

| | | | | | | | | | |
|---|---|---|---|---|---|---|---|---|---|
| 211 | 134191 | 133697 | 774 | MKETKEYIMFWGKEDIYSNFYP ITFKHHGKRTFNNSEQAFMWRK AQYFKDWQIAGEILNAKHPNHA KSLGRKVRNFNEEQWNKVRY DIMVEVVKDKFMTTHLKQKILD TDLRKDFVEASPYDKIWGVGIK ANDPKILDESNWKGQNLLGKV MEDVRVHCVYNRFK | 164 | hypothetical protein KgORF4 [Staphylococcus phage K] | YP_024435.1 | 1e-84 (146/162) | | Riboflafusio n conserved hypothetical protein, ribA/ribD-fused | TIGR02 464 | 2.80e-55 |
| 212 | 134602 | 134204 | 775 | MKKRYFKGLKLNDFEKEVFGL KKNKKYKKMNKELGRNEPKYW NYDMSFFIQLYADLNAFVESSN HVDMEYHTFTDIEGKERTQIDM IKHILSLIQFYHESMDSFDVDNE DEIEQVQNKILDNFKIVLPSLWN | 132 | hypothetical protein KgORF5 [Staphylococcus phage K] | YP_024436.1 | 2e-55 (114/132) | | No putative conserved domains have been detected | | |
| 213 | 135306 | 134599 | 776 | MAIYVPDIHGEYQKLLTIMDKI NNERKPKETIVFLGDYVDRGKR SKDVVNYIFDLMSNDDNVVTLL GNHDDEFYNVMENVDRLSIYDI EWLSRYCIETLNSYGVSTVTLK YSSVEENLRSNYDFIKSELKKL KESDDYRKFKILMVNCRKYYKE DKYIFSHSGGVSWKPVEEQTID QLIWSRDFQPRKDGFTYVCGH TPTDSGEVEINGDMLMCDVGA VFRDIDLPFIKLEGNS | 235 | putative protein phosphatase [Staphylococcus phage K] | YP_024437.1 | 1e-130 (227/232) | Phosphatas e | Putative protein phosphatas e | PHA022 39 | 6.31e-126 |
| 214 | 135957 | 135406 | 777 | MVNVLPSVYDAEKGEWVTLLA KPIAEEVFKIMKADYLEHKGNIG FFISKYKDGDSSIEQHNVVVFY NEKDYDTMELTESELTDALNEY IDYTLDGKYKPFSLNNFINYLED YGYRLPVNFEVDVTIILSDGQK FTYPRTSSITNNASIVDALKSED QYIEVKYIYNDHAIDDKKLAHGN DTLK | 183 | hypothetical protein KgORF7 [Staphylococcus phage K] | YP_024438.1 | 6e-99 (180/183) | | No putative conserved domains have been detected | | |
| 215 | 136293 | 135976 | 778 | VERTLNLYDSKGKLLKSSEKIT GASAKIIIEKLTPNTVYSQGSFKI SWTINGKESILTDVPEFTTKSN EDKQEIVFNTLNIDSNSFVVSET EPSDKSKLWFKPIN | 105 | ORF138 [Staphylococcus phage G1] | YP_241056.1 | 1e-51 (104/105) | | No putative conserved domains have been detected | | |
| 216 | 136999 | 136928 | 779 | GGACUCUUAGCUUAAAGGUA AAGCCAACCGCUCAUAACG | | | | | tRNA1-Met | | | |
| 1b | >137359 | 137279 | 780 | KYLLKHSKEADIRSTSKIMDSID KLT | 26 | hypothetical protein KgORF8 [Staphylococcus phage K] | YP_024439.1 | 2e-14 (25/26) | | No putative conserved domains have been detected | | |

Fig. 10QQ

| orf | Putative function | orf | Putative function | orf | Putative function |
|---|---|---|---|---|---|
| 29 | tail completion and sheath stabilizer protein | 127 | EndoVII packaging and recombination endonuclease VII | 192 | DNA topoisomerase subunit |
| 30 | deoxynucleoside monophosphate kinase | 128 | anaerobic NTP reductase large subunit | 196 | rIIA protector from prophage-induced early lysis |
| 38 | tRNA1-Tyr | 130 | anaerobic NTP reductase small subunit | 197 | rIIB protector from prophage-induced early lysis |
| 39 | tRNA2-Lys | 133 | glutaredoxin | 199 | endonuclease IV |
| 40 | tRNA3-Asn | 142 | sigma factor | 202 | nuclear disruption protein |
| 41 | tRNA4-Asp | 147 | alpha-glucosyl-transferase | 205 | topoisomerase II medium subunit |
| 43 | tRNA5-Met | 148 | recombination endonuclease subunit | 207 | activator middle promoter |
| 44 | tRNA6-Gln | 149 | recombination endonuclease subunit | 217 | AsiA anti-sigma 70 |
| 46 | tRNA7-His | 151 | RNA polymerase binding | 218 | holin |
| 47 | tRNA8-Ser | 152 | sliding clamp DNA polymerase | 219 | distal long tail fiber assembly catalyst |
| 48 | tRNA9-Ile | 153 | clamp-loader subunit | 220 | L-shaped tail fiber protein |
| 49 | tRNA10-Trp | 154 | clamp-loader subunit | 221 | hinge connector of long tail fiber distal connector |
| 50 | tRNA11-Gly | 155 | translation repressor protein | 222 | hinge connector of long tail fiber proximal connector |
| 51 | tRNA12-Pro | 157 | DNA polymerase | 223 | long tail fiber proximal subunit |
| 56 | tRNA13-Met | 159 | immunity to superinfection membrane protein | 224 | RNaseH ribonuclease |
| 60 | tRNA14-Leu | 160 | thymidylate synthase and pyrimide hydroxymethylase | 225 | dsDNA binding protein |
| 61 | tRNA15-Arg | 161 | beta-glucosyl-HMC-alpha-glucosyl-transferase | 226 | late promoter transcription accessory protein |
| 62 | tRNA16-Thr | 163 | RecA-like recombinase protein | 227 | loader of DNA helicase |
| 71 | nudix hydrolase | 164 | head vertex assembly chaperone | 228 | ssDNA binding protein |
| 73 | lysozyme | 165 | DNA primase-helicase ATPase | 235 | dihydrofolate reductase |
| 75 | internal head protein | 167 | protein spackle precursor | 237 | thymdylate synthetase |
| 79 | autonomous glycyl radical cofactor | 170 | DNA primase subunit | 240 | aerobic NDP reductase large subunit |
| 81 | RegB site-specific RNA endonuclease | 172 | dCTPase pyrophosphatase | 241 | homing endonuclease |
| 83 | valyl-tRNA synthetase modifier | 174 | small outer capsid protein | 242 | aerobic NDP reductase small subunit |
| 87 | thymidine kinase | 178 | ADP-ribosylase | 243 | endonuclease II |
| 90 | putative lysis inhibition regulator | 179 | Srd anti-sigma factor | 244 | RNA ligase A |
| 92 | putative lysis inhibition regulator | 181 | DNA helicase | 245 | inhibitor of host transcription |
| 120 | thioredoxin | 183 | exonuclease A | 250 | polynucleotide 5'-kinase and 3'-phosphatase |
| 125 | protease inhibitor | 186 | cef modifier of suppressor tRNAs | 254 | dCMP deaminase |

Fig. 11B

| orf | Putative function |
|---|---|
| 257 | head assembly cochaperone with GroEL |
| 258 | lysis inhibition accessory protein |
| 268 | DNA ligase |
| 270 | RNA polymerase ADP-ribosylase |
| 272 | baseplate tail tube initiator |
| 273 | baseplate tail tube cap |
| 274 | baseplate hub subunit, tail length determinator |
| 275 | base plate distal hub subunit |
| 276 | baseplate hub subunit |
| 277 | baseplate hub assembly catalyst |
| 278 | baseplate hub subunit |
| 279 | baseplate wedge subunit |
| 280 | recombination, repair and ssDNA binding protein |
| 282 | RNA-DNA and DNA-DNA helicase, ATPase |
| 283 | RNA-DNA and DNA-DNA helicase, ATPase |
| 284 | minor capsid protein |
| 285 | outer capsid protein |
| 286 | DNA primase-helicase subunit |
| 289 | RNA ligase |
| 291 | precursor of head vertex subunit |
| 292 | precursor of major head subunit |

Fig. 11C

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 1 | 1321 | 2 | 782 | MKKNKLIEKWQPLENEALPEIV GASKKALIAKIFENQEADINQAP EYRDEKIAEAFGSFLSEAEIGGD HGYDAQNIAAGQTSGAVTQIGP AVMGMVRRAIPNLIAFDICGVQ PMSNPTGQVFALRAVYGKDPL AAGAKEAFHPMYAPDAMFSGQ GATEKFEAVKAGAALTVGDIVV HDFAQTGRAHLQVVEDFTVDA GATDAAKLDAAVTAALEAGKVV EIAEGMATSVAELQEAFNGSKD NPWNEMGFRIDKQTIEAKSRQL KAQYSIELAQDLRAVHGMDADA ELSSILATEIMLEINREVVDWINY SAQVGKSGMTQTVGSKAGVFD FQDPIDRGARWAGESFKALLF QIDKESAEIARQTGRGEGNFIIA SRNVVNVLAAVDTNVSPAAQG LGRGYNTDTTKAVFAGVLGGR YRVYIDQYARQDYFTIGYKGAN | 440 | gp23 major head protein [Enterobacteria phage IME08] | YP_003734314.1 | 0.0 (379/400) | major head protein | Major capsid protein | PHA02541 | 0.0 |
| 2 | 2154 | 1342 | 783 | MLKELLMTEAKTIDASVALDSIF ESVQLSPEAKANFSTVFEATVK KHAVALAESHIEKIAEKAEEKVE EEKEKAKEEAREELKEAASKYF DHIAAEWMAENQLAVDRGIKAD LFESMFVGMKELFVEHNVVIPE ESVDVVAEMEEELAEQKAETA RLFEEVSKRDEYINYAQREYAI QEATRELTDTQKEKVVSLTEGM DYSDAFSTKLKAIVEMVQGSVE QSVTESADINTIDKEADGLNFTT EAVEETPATKTPSVMDAYVAQA ARLS | 270 | gp22 prohead core scaffold protein [Enterobacteria phage IME08] | YP_003734313.1 | 1e-89 (187/272) | prohead core scaffold protein | Prohead core protein | PHA02557 | 5,11e-58 |
| 3 | 2837 | 2187 | 784 | MENLNEQLLIEHWGQPGDVIDG KPMLESIIVEGENESGLKPGLYI EGVFMQAEVVNRNKRLYPKRIL ETAVSRYIKEQVATRQALGELN HPPRANVDPMQAAIIIEDMWWK GNDVYGRARIIEGDHGPGDKLA ANIRAGWIPGVSSRGLGSLKDS GKGYNIVQEGFRLTVGVDAVW GPSAPDAWVQPKQISENTSAQ VANSADDAFMALAEKLKAL | 216 | Prohead core scaffolding protein and protease [Enterobacteria phage RB69] | NP_861875.1 | 4e-95 (175/212) | prohead core scaffolding protein and protease | Peptidase_U9 | pfam03420 | 2,86e-88 |

Fig. 12A

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 4 | 3262 | 2837 | 785 | MLILPENHELVIDTVEALLPEAQ ARFDKLSAALSKDDINKIVENLV VSEPDLAIALGSINESLQLNEFIV KHVDSKGTITRTKDRKTRERNA FQTTGLSKAKRRQIARKAVKSK RANPSAQTRGLRKRKKALKRR QALGLS | 141 | gp68 prohead core [Enterobacteria phage RB51] | YP_002854127.1 | 8e-48 (105/141) | prohead core protein | Prohead core protein | PHA02586 | 2,69e-42 |
| 5 | 3486 | 3262 | 786 | MENYISAIESRDLVAAKKAFGAI MAERTSGLIEERKKFIAASVMIE GEEPDEDEDEDEDEDKSDKD EDDEEDE | 74 | gp67 prohead core [Enterobacteria phage RB51] | YP_002854126.1 | 2e-05 (29/50) | prohead core protein | Prohead core protein | PHA02608 | 2e-07 |
| 6 | 5054 | 3486 | 787 | MAFHILDLFAPWEKRDEAEYKQ QINNDLESITAPKFDDGAREVE SNENEIQYNSFNQMMFGSNEP GMKTTADLINTYRSLMNNYEVD NAVEEIVSDAVVYEDGHPVVSL DLDSTDFSQAIKDRILEEFNTVL TCLNFERKGADHFRRWYVDSR IFFHKIVNTKKMKDGIQELRRLD PRNLQFIREIVTADDAGTKIVKG YKEYFIYDTGKESYYADGRLYS AGTKIKIPRDAIVYAHSGLVDCS GQNIIGYLHRAVKPANQLKLLED ALVIYRITRAPDRRVFYIDTGNM PSRKAAAHMQHIMNTMKNRVV YDASTGKIKNQQHNMSMTEDY WLQRRDGKAVTEVDTLPGMSG MSDMDDVRYFRTALYMALRVP LSRMPDANNQGGVQFDAGTAI TRDELDFAKFIRRLQHKFEEIML DPLRTNLILKKVLSKDEWEDEIN NIKIVFHKDSYFTELKDAEVMER RINMLTMAEPFIGKYISHKTAMK DFLQMSDEEIEQEAKQIELESK EARFQDQENEEDF | 522 | gp20 portal vertex protein of head [Enterobacteria phage JS10] | YP_002922513.1 | 0,0 (404/502) | portal vertex protein of head | Portal vertex protein | PHA02531 | 0,0 |
| 7 | 5672 | 5085 | 788 | MFCTYLTIYTGNKLPRRYIGSTS VSRIIDENYHGSVKSKKYKDLW KSEQHDNPHLFKTRILNTYETR EEASKAELELQIKYDVVKSSSYI NMALAQPNGFFGMSTKGRKMS EESKEKQRHQRLGIKRPDHSIK LSGRKRPDHSKAMSGERNPMF GKEHPNKGKKINQPRMTCPVC | 195 | No significant similarity found. | | | | No putative conserved domains have been detected | | |

Fig. 12B

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | GVESTRSAIMRYHKACLSSI | | | | | | | | |
| 8 | 6203 | 5712 | 789 | MELTDITRAFESGDFARPNLFE VEIPYLGRNFSFKCKAAPMPAG IVEKVPVGYMNRKINVAGDRTY DDWTVTIYNDDKHEVRKAIIAW QAQAHAQGNDISGMTPADYKK VATVRQFSRDGKTITNEHTITGL WPTNVGEVQMDWDSNNEIETF ETTFAIDWWE | 163 | Tail tube protein gp19 [Klebsiella phage KPP95] | ASS46617.1 | 2e-92 (162/163) | tail tube protein | Tail tube protein | PHA025 51 | 5,59e -72 |
| 9 | 8304 | 6331 | 790 | MPLVSPGIELKETSVQSTVVLN ATGRAAIVGKFQWGPAYQVTQI TNEVELVDMFGGPNNQTADYF MSAMNFLQYGNDLRTVRVNR EAAKNASPLVDNIEWTITTAGS NYEVGDKITVKYADQTVDDTGS VTEVDSDGKIKSVFIPTSKIIAYA KSINQYPDLGSSWTTTITSQSS GVSAVITLGKIISESTVLLTEHET AHEEMTKTEFQTALAQYKMPGI VAAYPGELGNQLEIEIVSKAAFD KGEQLTIYPSGGQRASTAKAVF GYGPQTDTQYAIIVRRDGAVVE SAVLSTSRQDKDIYGNNIFMDD YFSKGSSRYVFATAQGWPEGF SGVIRLGGGVSANESVTAGDLI QGWDLFGDREALRVNLLIAGAC AGETDEIASTVQKHVSSIADER QDCLALISPPRSTVNIPLTRAVD NLIDWRQGDGTYDSANMNINTT YAAIDGNYKYQYDKYNDVNRW VPLAADIAGLCARTDDIAQPWM SPAGYRRGQILNCIKLAIEPRQA HRDRMYQAGINPVTGQGTGEG FILFGDKTATTVPTPFDRINVRR LFNMLKNNIGDSSKWQLFELND NFTRSSFRMETSQYLAGIKALG GVYDFRVVCDTTNNTPAVIDRN | 657 | Tail sheath protein gp18 [Klebsiella phage KPP95] | ASS46616.1 | 0,0 (645/657) | tail sheath protein | Tail sheath protein | PHA025 39 | 0,0 |

Fig. 12C

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and Identity | | Name | Acc No | E value |
| | | | | EFVASFYIKPARSINYITLNFVAT ATGADFDELIGPQ | | | | | | | | |

Fig. 12D

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 10 | 10176 | 8338 | 791 | MEQTQPFNVLSDAHPLNDGKL TVIRHPSEMETKIENGVRFFKS QWDDKWYPEKFEDYLKLHGIV KIRLQGEDPAHFQTFKDKNNKR TRYMGLPNLKRANIKMQLTREI VAEWKKCRDDIVYFAETYCAIT HIDYGTIKVQLRDYQRDMLEIM AAKRMTCCNLSRQLGKTTVVAI FLAHFVCFNKDKAVGILAHKGS MSAEVLDRTKQAIELLPDFLQP GIVEWNKGSIELDNGSSIGAYA SSPDAVRGNSFAMIYIDECAFIP NFIDAWLAIQPVISSGRRSKIITT TPSGLNHFYDIWTAAVEGKSGF TPYTAIWNSVKERLYNDEDMFD DGWQWSLQTISASSLEQFKQE HCAEFHGTSGTLISGMKLANMD WIEVTPDSHGFYKFKEAEADHK YIATLDSAEGRGQDYHALNIIDV TTSEWEQVGVLHSNTISHLILPD IVIKYLMEYNEAPIYIELNSTGVS VAKSLYMDLEYENVICDSIVDLG MKQTKRSKAVGCSALKDLIEKD KLIIHHRATVQEFRTFSEKGVS WAAEDGYHDDLIMSLVIFAWLT TQQKFADFVDKDEMRLASEVF KRELEDMNDDYAPVVFVDAVN SAEYAPQEHGLSFV | 612 | gp17 terminase DNA packaging enzyme, large subunit [Enterobacteria phage T4] | NP_049776.1 | 0,0 (506/608) | terminase DNA packaging enzyme, large subunit | Large terminase protein | PHA02533 | 0,0 |
| 11 | 10663 | 10154 | 792 | MSELQLDMAKLLDIEGIPGIEGQ EIPVYEKLELVEVKSNPNDRKP DLEDDYSVVRKNMHFQQOML MDAAKIFLETAKNADSPRHMEV FATLMGQMTTTNKEILKLHKEM KDITSEQVGTGKGANPQQGMN IQNATVFVGSTADMMDEFGDA YEAQEAREKIVNGTDSTV | 169 | gp16 terminase DNA packaging enzyme, small subunit [Enterobacteria phage T4] | NP_049775.1 | 0,0 (130/160) | terminase DNA packaging enzyme, small subunit | Small terminase protein | PHA02585 | 2,22e-59 |

Fig. 12E

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 12 | 11484 | 10660 | 793 | MFGHWYNSSLRRYIVLGDLFS HVQIARWREDTGLKYIKVPITYA SKEKFLSQLGKWTAIQSTENKA KIETVLPRMNLHLVDMQYNAMY KTSQLNRTKSYKTPSKITSQYN PTPIKMIFELGIYTRNQDDMYQII EQIVPYFQPHFNTTITELYDKDT SFNRDVRIVLQSFSQDEAVDGD NITRRRLEWSLMFEVNGWLYP PVAEIDGEIRTIYLDFFANSKELT PEGNFESVDSEVTPRDVQHEN WDGSSKQTYSHDIPIPVNPEAP GPRGEK | 274 | gp15 tail sheath stabilizer and completion protein [Enterobacteria phage JS10] | YP_002922508.1 | 4e-113 (194/273) | tail sheath stabilizer and completion protein | Tail sheath stabilizer and completion protein | PHA02556 | 3,5e-117 |
| 13 | 12302 | 11526 | 794 | MSTFDSRLFAKLEDYRGYNKTN ETEILNPYVNFYNHRNSQTLAD ALSAEAIQMRGIEFYFLPREYNN PDLLFGEDPSSKFTKAWKFAAY LDSFEGYSGDNTFFSKFGMMV NDEVNLTINPNLFKHQTNNSEP KAGDLIYFPMDNSLFEINWVQP YDPFYQLGQNVQRKITAQKYIY SGEQLOPELQRNEGINIPEFSE LDLEPIKNIDALADISDIQYAESD EINKEASEYVHPYYVNNGRGLE SPPKADSFDDGFFE | 258 | gp14 neck protein [Enterobacteria phage JS98] | YP_001595290.1 | 4e-115 (199/258) | neck protein | T4_neck-protein | pfam11649 | 7,29e-94 |
| 14 | 13247 | 12306 | 795 | MSYNTYNPKTLKDAILRRLGAP VINVEVTEDQIYDCIQRALELYG EYHFNGLNKGYQVFYIGKDEAD NARFLNGVFDLRGRNVFAVTQI VRTNVGSLTSMDGNATYPWFT DFLMGMAGINGGMGSSCNKSY GPNAFGADLGYFTQLMTYWSM MQDLLAPLPDYWYNSDNEMLK VMGNFMKGDIIVCECWTKSFM NTDAMVGNTAGYGFAGPQTAD HWGLGDRYQNPDLRNNGQYA GEGNTNREGAYNNRWVKDYA TALTKKLWGEILFKHQGLQLAG GVTVDGQTLKVEAQEEIERLRE ELDLLDPGCPILLG | 313 | gp13 neck protein [Enterobacteria phage JS98] | YP_001595289.1 | 2e-123 (223/314) | neck protein | Neck protein | PHA02554 | 9,45e-117 |

Fig. 12F

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and Identity | | Name | Acc No | E value |
| 15 | 15071 | 13305 | 796 | MTKLVDSLPFVDGIPDDFQQRI NWIKNTEPLNGASTRYGNDGE LNRASVQIQKNVVQVHNDLNNV GTAVENIQVDVDQIKKSLEITGS SDAIEQVYINKKNIEKHDGQILKL EEDTEKLRTDLDFLEEDVGVYD SSKDDYYRTVRDNIVWVKREIG AYPGQDINGQPKQDSPGSGMK YRIINNASAIVKHDERIQALEDAY NDSDVGSLTIEVNDLRKEVGPK SGATSASIYARLVNNADAISAAN NEIFAINQAIDFTNPVKIGARTTR LENDYRIVDATLNFAGTGLVPR VNNIDARLGSSDKPDTIEGKISS LSTDQGYISDVVGRDTSSGLOG QVAWINQQVGIVPSEQPIPPGSI LARMTNVEGMQNSQQSAIQDI QVELGNNNEGLKGSVFTLQTQ MNGDFSSENPVQRDGVYATVV ELQDKFVTAVTDVEQAGAYLRK QGEWFKKPSSIGEFSKEDFTVD LSSDALVNPNSLVAAPFNAGIRI VDDIVVDDDGVFCVETDTVIEA SDSDKGVKIVILVNNIEVFSYGL GVKAVTGEQLIKTKKLIEFSSGD AIKIVYRAASEESQVLVKIKSLDI TIHPAV | 588 | Fibritin [Klebsiella phage KPP95] | ABH10666.1 | 3e-124 (221/225) | fibritin | wac, fibritin | PHA026 07 | 3.25e -111 |

Fig. 12G

| orf | Start position | Stop position | SEQ ID NO.: | Aminoacidic sequence | Size (aa) | Homologous/similar proteins ||| Predicted function | Conserved Domains || 
|---|---|---|---|---|---|---|---|---|---|---|---|
| | | | | | | Name[organism] | Acc No | E value and identity | | Name | Acc No | E value |
| 16 | 16426 | 15080 | 797 | MAQNNYNHYSDLAKYTIFDPTN TQWPVAIKDVQSALELIGSWAR TDTGLPVASPTVAGVIRTATQA EVDAGTIGNAAVTPATLKSTVT RPEATTTVLGLTRYATNTEAAA LTAGNRTITAAALGHVFKTVKA QENVDGTVRLTTAAQAQAGTD ETTAVTPKRVVEMIGKFSVSPP SYTSATESNLGLVRVATQAQVA AGAVHDGYAVTPKTFMASKAS DSVFGIVKFAKDSDVASATSNN LAVTPKSLQALKSTKDKYGLTR LSGSPTTDASLAAAATDAVFKT RRINGKTLDNDITITNNDINCYT RQESDGRYMPAGTRVGNVTW VEGQSWISRGATFTCNAPWEA SSRLALNVNVKFERNNDGYDN RIFRFVVIVNGSQWGGELTLNIE NTKGGRNGHSWRFEAYASSNF FFNNIPPNATVQIRPTEDSRIIFY DCMLTFCTNRP | 448 | gp12 short tail fibers [Klebsiella phage KP15] | YP_003580043.1 | 2e-52 (123/310) | short tail fibers | Long tail fiber, proximal subunit | PHA02584 | 3,81e-17 |
| 17 | 17097 | 16426 | 798 | MTIETKTREGAKVNSRLAAFSE YRVDPQNIAVGNTAPIGSLTFE QMDLGVWYPNTEAAINDLMSL QSAEIGTIICNDTGISPQPAQQIT RATFSGVVALEPKEDGSVGDP VIIHILGLPIRIANGDDFAAVATR WYDKVKELEAVGKVVQQVTQS PATPQYVDIIHLDYQNHNFETYK KYGLTVEFTITSPAKAGYGQWD AIGNESKTFGANTFTFHYFRRM G | 223 | gp11 base plate wedge completion tail pin [Enterobacteria phage RB51] | YP_002854115.1 | 5e-27 (68/215) | base plate wedge completion tail pin | Baseplate wedge subunit and tail pin | PHA02058 | 4,15e-49 |

Fig. 12H

| orf | Start position | Stop position | SEQ ID NO.: | Aminoacidic sequence | Size (aa) | Homologous/similar proteins ||| Conserved Domains ||||
|---|---|---|---|---|---|---|---|---|---|---|---|---|
| | | | | | | Name[organism] | Acc No | E value and identity | Predicted function | Name | Acc No | E value |
| 18 | 18922 | 17099 | 799 | MKQNLIVGQSVDDGSGDYLRK GGLKINNNFDDLYSELGDGSVP FAAGAWKTFKASPTGTTLNAKF GQAFAINTQAARVNVQLPKGTA NDYNKVIKLRDVWSTWRLSPIT VIPAQGDTLKGSASPKIFNTNFQ DLELVYCAPGRWEYIENKTVDK LTNGNLSTVAKKSIIATAGQTDF LNIFDGVEYNEDSLNVYRRGNIL YYGETSVMDKANADYGSPGTV AGQLVELNGKDIRLKVPCVEGE VITFETFLDGIGVYRSSYNKLAI QIRDSAQTTSQTIPGSIIVDNLTA LRRITLDDMGVLPGVGVNPNSL EISLNGKELLEAGTAGLPLFYCE GAEGGYAEDCINNGGQWVNS NQDYRLEFDSTGTNVEAIIFGEA FEDKDLLTVRWFNNNIGTTMDI DDIMAETDQVYMNAEQLVTLKN RIEYTNYDEPNQKNMRPVADDI MIKVNNIAAFFDVIYPIGTIYENA HNHANPADYMGFGVWKLYSQ GRVTAGWNNDSSDPYFSRNN NNLNENGQPSLTAGGTVGDLT FTLGKEHIPELMSRDKVLISDPE HGSVVIGGCQLDPDAQGPGYS KYREDTVAVNNGVVPNDITKIQ PTITVYRWIRVG | 607 | gp10 baseplate wedge subunit and tail pin [Klebsiella phage KP15] | YP_00358004 1.1 | 0,0 (323/611) | baseplate wedge subunit and tail pin | Baseplate wedge subunit and tail pin | PHA025 82 | 0,0 |
| 19 | 19833 | 18922 | 800 | MYTDKGKKIIDVGEIGNASTGDI LYDGGVKINDNFDAIYNAFADQ RLFAAGGGALNQKIHATSYYQK IKFGDANSAGTVPMGSCIDADC SEGAVQIRLSKGKAGEAVFVVN SNGSASKARSIKITTNGEGVAD AFKDGSRELIINTPRCRIELWCV EVKANGAAVWDYSISSMFGST YSPLEATYNLTSSPINIRLGYND DYSTVKLLLSFSANPGGQTIKR QSSEVMLMIDPTITSSAPNGRV FDTEYAVLRSGESSENEKMYSI SYSINAQKDLICTASTSYGNARL AVKVIATQTVGVSQ | 303 | gp9 baseplate wedge tail fiber connector [Enterobacteria phage JS98] | YP_00159528 4.1 | 6e-60 (134/302) | baseplate wedge tail fiber connector | Baseplate wedge tail fiber connector | PHA025 81 | 6,6e-67 |

Fig. 12I

| orf | Start position | Stop position | SEQ ID NO.: | Aminoacidic sequence | Size (aa) | Homologous/similar proteins | | | Predicted function | Conserved Domains | | E value |
|---|---|---|---|---|---|---|---|---|---|---|---|---|
| | | | | | | Name[organism] | Acc No | E value and identity | | Name | Acc No | |
| 20 | 20924 | 19899 | 801 | MSNSTRASSTRSTIYRAIITSKF RTEKMYTFYKSIGPGTDQNTLY VSFGKSTPWSDNESEPGFAPP YPADNGDGVVDVWTNMMGAV KIESSMLDCVVPRRDWGDTRY PNPRTFLIGDIVVANSAPYNRTD AGFGWMVYRCIDVPKDGMCSI GNLTSKEECIKLGGKWTPSTIS GSAPRGRGDANGTVDLGDGYL WEYLYEIPADVSINRCTNEYIVV PWPEEIEESPARWGFQNNLTW QQNDFNLIYRMKCNTIRFKAYL DAVYFPEFSLPGNTGFRQLSIIT NPLEVKPMPNSPNVKAEKGWY SASGLERQSGEMIYMENRQPII RSMDQTEELNLIFEF | 341 | gp8 baseplate wedge subunit [Enterobacteria phage JS98] | YP_00159528 3.1 | 9e-146 (238/330) | baseplate wedge subunit | Baseplate wedge subunit | pha025 80 | 1.08e -164 |
| 21 | 24015 | 20917 | 802 | MTIAPFVTSLRIHKLSANQVNIR WDDVGANFYYFVELAETRNRA GEIIPADNLSWSSLGYTADNDW FEQNRIEPLTYYKMRVQTTSAG FEPSEWVETEEFQTFEENAYTF EHMQEFSLVKEFIKQKFSLNNM SYVNFNTSAMMASLMTESFQF SPEYSHLSAIENFVVGESGYHEI QGPIEAVCVDKNRTMLGEIDGIL YLFERFQHMVKVSNDKGQNW QYVQLFNDRVGNPVSRVVIYQS STTSYVLGYDKIFYGRKSSDVR WSSNEVKFSDNEVTFAKLGDO LKLGFEVELFGTYASLPADVTK YAEAFTCNDDHLYVVAKDTVRR VKLKDAPIDTDPLSPTFGEKVFE KEASHITGNPKSVCFKMDSVG GKIFALITGEVKTLGLDPTDPRN VVDSATKGVYVYQEDTNTWKR VFGNTDEEKRRIEHLWTSMSTD GKEIFFSSANFKTTEYTQDIELE TKYPELISTAVKNVNPIQYHSDK HYHMMSFRADEFSRWETFVPG PMRFYAEPWFVWMAREGNRC WISTADHAVVIYNDILYQKRVDA AAQGTTERVLSEVWDKGDATF YCPPVSFNGFLQYASGIMFHEP | 1032 | gp7 baseplate wedge initiator [Enterobacteria phage IME08] | YP_00373429 5.1 | 0.0 (667/102 9) | baseplate wedge initiator | Baseplate wedge subunit | PHA025 79 | 0,0 |

Fig. 12J

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | DGKLIGYYAFDYRVRDQVTLN WKPTDVMFKAFLQNQTREEDW TPEHTPGLRDPDLRPYLTKMM PDSYLLQDSNFEQFCKYYLQFL SDGNGTHYNSLVNLVKNKYPR EENAWEYLWSEYYKRNIYLSKD ARDAVVRFFEARKNDFYATKGI EDSYKFLFKLLYNEDVEIDIESK NTTEYDIIVESTNISDDLVGRTIY TASGRSNVTYIEREYRDGRLLW RITIHNLSGRFIEGQEIKSERTDF EGIIVQGVRGKDMLSNNIDYINR SRSYYVMKIKSQLPTSRFRDDV LRFVHPVGFGFIGITLLTMFINS GLNMKHVETIINKLKNYKWDAG LPSVYPDRVAIIASDDTIERDPIT NEPRYSSRAQAGEPFPLPANY NQENNNSIIAGQNPGQRRKPLS PTFDQSAVTFANYRDLVNQRLK DDAGNPRDPENPTQVKIDE | | | | | | | | |

Fig. 12K

| orf | Start position | Stop position | SEQ ID NO.: | Aminoacidic sequence | Size (aa) | Homologous/similar proteins | | | | Conserved Domains | | |
|---|---|---|---|---|---|---|---|---|---|---|---|---|
| | | | | | | Name[organism] | Acc No | E value and identity | Predicted function | Name | Acc No | E value |
| 22 | 25970 | 240120 | 803 | MAIKEPLNYQLTRTANAIPDAFT GATFDEIKNQLINWLSGQKEFQ DFDFAGSRLNVLLDLLAYNTLYI QQFSNTALYESFIGTANLRSSV VQAAQQNGYLPSSKSAATASIM LEVTHMNPSSTLRVVIPRGTKF LAYSKSDKANPYNFVVTENVVA IRDNDQKYWPIVNLAQGRIIRTQ LSYDPKKPIVIRDQSIDRKQVKL WVDGAEWTNWTDRSMVHASS ISTIYMRETVDGNTEFFFGEG VAEASVAGGVLESNFIGGLKPT KGAQVVIEYIRTDGEAANGATE FSYADTLQYIVVNRIIENWSDSP DYVGADGGEPEDIERIRELAQ IKRESQMRCVSKTDYESFVSSR FGSIVQAVQCFTDQDKPGYAFI AIKPKSGLQLTAVQREDIQDYLK PFCLAPITPSVMSPDYLFIRHNI KASYALNKLQESEQWLQSKIID SINRYYVDEVEMFNKNFSKSKL LTYIDDTDHSIIGSSVDIQMVREI VNYFTLPSAGIKYYNTITPRTLR SGDLVFTVTPTAEPYSVNIVGT DPDKNGKGNMVIGPFKPGDIKE NTHIQPYTENDFDRTTIGERTR WYKIGEVDYYGDNIYWSLGAIG ADPLQFEDQSIELYSTPTQDIVF ARDGTLIVFENDLRPQYTTIKLE PITQ | 652 | gp6 baseplate wedge subunit [Enterobacteria phage JS98] | YP_00159528 1.1 | 0.0 (443/650) | baseplate wedge subunit | Baseplate wedge subunit | PHA025 53 | 0.0 |
| 23 | 26263 | 25997 | 804 | MAGLSFNKCLTAGHSAYPPTEV NATQSKVFTGGIAVLVDGDSITP HTKTVDPHDTHGGVVQPRTSK VFVTGKKAVQMADPISCGDTVA QSSSKVFIH | 97 | gp5.4 conserved hypothetical protein [Enterobacteria phage JS98] | YP_00159528 0.1 | 9e-39 (76/76) | | No putative conserved domains have been detected | | |
| 24 | 26767 | 26264 | 805 | MADILPINTTLREVIEGEYVEQY FTAQLSTNETLKSINIIDYOPVSD ISVSETHYKGNYNSVFTFGNDV LKYREGDELKSASAWEDLPNP KTADLYLWKAPRTLEKTFTYTV EIIYTVTEESSGGSGGSSAPIIT EHKKQKIYSQTVKGNWSRWGD QLRAYVYAGN | 167 | Hypothetical protein EME08_gp142 [Enterobacteria phage IME08] | YP_00373429 2.1 | 2e-40 (86/177) | | Hypothetical protein | PHA026 06 | 4.54e-48 |

Fig. 12L

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 25 | 28500 | 26770 | 806 | MIEMNDSLKWFTGVVEDRQDP LKQGRVRVYGLHPFEKVQG AITGLPTEDLPWMSVIQPTNSA GISGVGSSITGMVEGTSVFGLW LDEFKTAGLVIGTYSAHRKTKP NYTEGFSDPTGQYPRQVGSDT NPLVQGDETGYSAIPNIIQDRNL DIGINPDDADLSDIPEDPNPAITI TDMLNRDEGLRLKVYWDTEGY PTVGIGHLIMAQKVRDMSVINKT LSNQVGRTVTGNPGIITMDEAV ALFKKDRDKMLSDIKTNSRVGP VYAKVNKSRQMALENMSFQMG VGGLAKFGKMLDAMLIGDWKT AYTEARNSVWFNQTKGRASRV SMIILTGNMESYGVPAPKPEGK NLSAAYVEPKSGGNPEDPWTP EDSRILFKEPESSYNGQYPYVH TMETESGHIQEFDDTPGYERYR IVHPTGSYEEVAPDGRRTRKTV ADLYDMTQGDGNILISGDKKVN VGGNETYYNMYNRRQQIDGDN TLYVRGNETKTIEGNGTIFVKGN IKIVVEGNADIQVNGDATTKVDG NHDVTVGGNLTWQVAGTVNW NVGGAWTETMASMSSIAQGQY TVDGSRIDVG | 576 | Base plate hub subunit and lysozyme [Enterobacteria phage RB32] | YP_803092.1 | 0,0 (391/576) | base plate hub subunit and lysozyme | Bacteriophage_T4-like_lysozyme | cd00735 | 4,39e-65 |
| 26 | 29135 | 28497 | 807 | MLFSFFSPIDYSAKTVKGAKAK AIPTADIFRNYRKYFDTVAENYL LQTYYISGAPRPEELAYILYGNS QLYWILLMCNNVYDPFRDWIKT QDACYQFAQQKYADVGGDQIL YHVDAYGNRYYNLEQYPENSG VWYDKGDFNHQYPQYTGALAG VDIYEDSIIENEKLRQININPSDI EAFLSDIIREMEKAPDSEYESG RYKSQTTIGEVL | 212 | gp53 baseplate wedge subunit [Enterobacteria phage JS98] | YP_001595277.1 | 1e-66 (121/199) | baseplate wedge subunit | Baseplate wedge subunit | PHA02578 | 4,62e-75 |
| 27 | 29185 | 29634 | 808 | MAYSGKFMPQNLHKYKGDFRK ITYRSTWEQYMMRWLDNHPDV VQWNSEEVVIPYFSNADGKKR RYFMDFWAKFSNGGQQFFFEVK PKKETRPPVKPTKLTTSAKKRYI DEIYTWSVNVDKWKAAQATAS | 149 | gp4 head completion protein [Enterobacteria phage JS98] | YP_001595276.1 | 2e-67 (122/149) | head completion protein | Head completion protein | PHA02552 | 1,15e-63 |

Fig. 12M

| orf | Start position | Stop position | SEQ ID NO.: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | KMGIEFRLITEDSLKKLGWKG | | | | | | | | |
| 28 | 29634 | 30461 | 809 | MAIFEFITEAAESPKAKSRSENQ WVALGVEYSAARKKGMTSKSF AESKGINPATFSKAMARHASRI KTAIKVAEIEKKPANKMTKQERA LVMVNSFRSSIKDKIRNEGAAV NNKSAKWFAETIKKNIRGHSVT KPQPGKLYAYMYDAKHKDTLP FWDKFPLIVVLGLGKQGTTTLM YGLNLHYIPPKARQQFLEELLK QYANTPVISNKTRLKINWSQVK GFAGADKMIKAYIPGNIKGALIEI KPADWANVVMLPLQQFMSKGK RYSATSVWKS | 275 | gp2 DNA end protector protein [Enterobacteria phage IME08] | YP_003734288.1 | 1e-188 (200/277) | DNA end protector protein | DNA end protector protein | PHA025 77 | 7.34e -107 |
| 29 | 30461 | 31063 | 810 | MSTGLFNQTNTTNFILEVPDGG LTQAFKANLQTAVVPGIHIPATD TVGSPQGMHRAKLPGSTFEFD AVPVRFLVDENLDSWVQMYKW MLSCCONYIDRDKSGWNNGGE GFPGAVLMHVLDNDKHDIVLTV RYIGGWVSDLSEIEYSLTEESD PAMVCVATLQYKYIEVEKDGIIIT GRPSVNDTRESQYQQKVMGM HPSMR | 200 | gp3 tail completion and sheath stabilizer protein [Enterobacteria phage JS98] | YP_0015952 74.1 | 2e-61 (111/197) | tail completion and sheath stabilizer protein | Tail completion and sheath stabilizer protein | PHA025 76 | 7.95e -65 |
| 30 | 31068 | 31811 | 811 | LKLLFLIGKKRSGKDTTADYIMD NYNATKHQLAGPIKDALADAML TEWYRDTSREFPRITRSMIEGID YDREQDLNLSTKDVIRIMANAIE YVHHDLPLPGVVVDNKRKILDG DTMEVIRKVVINKPVEPWSIRRL MQTLGTDIWCDKLDRMYWVKR FTLVMADTFGDYDYFIVPDTRQ DHELDVARAMGATVIHVVRPEQ EGSKKDTHVTERGLPIREGDIVI TNDGSLEELYSKINTILGIQNDY | 247 | gp1 dNMP kinase [Enterobacteria phage RB14] | YP_0028544 80.1 | 3e-69 (140/252) | deoxy-nucleoside monophosphate kinase | Deoxy-nucleoside monophosphate kinase | PHA025 75 | 2.45e -65 |
| 31 | 31801 | 32034 | 812 | MTTEQLQAQVDTLKVRVFDLSE TIQGLSALRAQYEEVLQKLIAVS GVEIGEDGQVKLDDLVAKIEAQ | 77 | No significant similarity found. | | | | No putative conserved domains have been detected | | |

Fig. 12N

| orf | Start position | Stop position | SEQ ID NO.: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | FAEETTEESE | | | | | | | | |
| 32 | 32034 | 32489 | 813 | MKFSDFSTGLYAAKFSEKTLD AIEDLQRELKVPNPVPRHKIHTT ICYSRVHPYVCASGSFEVATS GKLEWVDTQDGRTLVLKLDSE YLKFRHQYARALGATHDFPDYS PHITLSYNVGPAHFEGEVQVPV VLDREYQEPLKLNWSEDLK | 151 | gp57B conserved hypothetical protein [Enterobacteria phage T4] | NP_049750.1 | 6e-67 (120/151) | | Hypothetical protein | PHA025 74 | 4.25e-65 |
| 33 | 32486 | 32869 | 814 | MKSYQEFLMETEALLESTLPDY MIVKSFNVKNGYVIKFPIASVKP GADMSNDAGISVKVNVQFINYN SAKKSYDAKMTFSGGGEKVVKNI KLDYDESAESVKKRFGDKLVKS IMVHPTFKRDFTELYK | 127 | No significant similarity found. | | | | No putative conserved domains have been detected | | |
| 34 | 32935 | 33114 | 815 | MKRCELIRNVASAICLTAVGTSI FGAIFMGAKEIMVLVAAFLMG SISFIMDKISHEKD | 59 | Trna.4 conserved hypothetical predicted membrane protein [Enterobacteria phage JS98] | YP_00159527 0.1 | 5e-07 (31/59) | | No putative conserved domains have been detected | | |
| 35 | 33101 | 33280 | 816 | MKKIKQWFVKTYDLGREEVTKY DYVTLGVGLGALLAALHSSLLAI AVLILAHYSWKRK | 59 | No significant similarity found. | | | | No putative conserved domains have been detected | | |
| 36 | 33280 | 33465 | 817 | MYALLTWSNYYPAPGSDQIRG VYSTVEECYEALQGTYQDYFEI LNSRFETVAKGSTEAYKD | 61 | No significant similarity found. | | | | No putative conserved domains have been detected | | |
| 37 | 33482 | 33832 | 818 | MNIRAAFNTFYQENYKLLSHEY YDAQGVPIPSDLVTPKHVKTDS LDNEIQPGDLVSYYCGGSLSAA SVGILLGFTPKGYRVVPFHTSPI PEHRVLLSHMDSPHRVFLVKSK SSPIV | 116 | No significant similarity found. | | | | No putative conserved domains have been detected | | |
| 38 | 33915 | 33998 | 819 | GGGGAGUUAGACCGUAGGGG UAGCGGAGACAGACUGUAAAU CUGUUGCUCAAAAGGCUCGA GUGGUUCGACUCCCAUUACUC CCCA | 84 | | | | tRNA1-Tyr | | | |
| 39 | 34009 | 34082 | 820 | GGGAUACUAGCUCAGUUGGU UAGAGCACCGGACUUUUAAU CCGGUGUUACGAAGUUCGAA UCUUCGGGUGUCCCA | 74 | | | | tRNA2-Lys | | | |

Fig. 120

| orf | Start position | Stop position | SEQ ID NO.: | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| 40 | 34091 | 34172 | 821 | GGGUCGUUGGCUGAGAGGG UAAGCGACGGACUGUUAAUC CGUGUCAGAAAUGACUAGGC AGGUUCGAUACCUGCACGGC CCG | 82 | | | | tRNA3-Asn | | | |
| 41 | 34429 | 34502 | 822 | AGUGCUGUAGUCGAGAUGGU UAAGACACUCCCUGUCACG GGAGAGAUCGCGGGUUCGAC ACCCGUCAGCACUG | 74 | | | | tRNA4-Asp | | | |
| 42 | 34586 | 34984 | 823 | LTFDEWLSWWKATGKYHLRGR ASDNYCMCRKGDVGPYSLDNI YCATNAQNAKDAGANGRIISTG FTGHNHSDETKIKISENHAHKLN ADEISLRIDLYNSIDFTQRGALV KFANKLGISHTQARKFINKFIK | 132 | PHG31p119nc [Aeromonas phage 31] | YP_238848.1 | 2e-31 (67/134) | | No putative conserved domains have been detected | | |
| 43 | 35138 | 35211 | 824 | UGCGGAGUAACUUCAGUUGG UAGAAUGUUGGGCUCAUAUC CCGACACGCGCAGGUUCGAG UCCUGCCUCCGCCU | 74 | | | | tRNA5-Met | | | |
| 44 | 35221 | 35292 | 825 | UGAAUCAUAGCCAAGUUGGU AAGGCAGUAGGUUUUGAUCC UACGAUCCCUGGUUCGAGUC CAGGUGGUUCAG | 72 | | | | tRNA6-Gln | | | |
| 45 | 35367 | 35540 | 826 | MMDGVNIDVVVQLVEPEVVIL DVTDSNSVGHPNNEGMVEKYT ARKTLWLSLSELCL | 57 | No significant similarity found. | | | | | | |
| 46 | 35391 | 35463 | 827 | GUGGUCGUAGUUCAGUUGGU AGAACCCGAGGUUGUGAUCC UCGAUGUCACGGAUUCGAAU UCCGUCGGCCACC | 73 | | | | tRNA7-His | | | |
| 47 | 35564 | 35645 | 828 | GGAGAGUAGCGCUAGUGGUA GCAAACCGGACUUGAAAUCC GGGCCACCGAAACGGUGAG GGUUCAACUCCUUUACUCUC CG | 82 | | | | tRNA8-Ser | | | |
| 48 | 35715 | 35787 | 829 | GGGAGUAUAGCUCAUUUGGU AGAGCUCGACCGAUAAUC AGCGGUGACUGGUUCGAGU CCAGUUACUCCCA | 73 | | | | tRNA9-Ile | | | |

Fig. 12P

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 49 | 35797 | 35868 | 830 | AGGUUCUUAGUAUAAUGGCU AUUAUGCUGGGCCUCCAAACC CAGUGAUGAGGGUUCGAUUC CUUCAGGGCCUG | 72 | | | | tRNA10-Trp | | | |
| 50 | 35877 | 35948 | 831 | GCAUCCAUCGUAUAGCGGAU AUUAUGUCUGGCCUUCCACCC AGAAGAUGGGAGUUCGAUUC UCCCUGGAUGCU | 72 | | | | tRNA11-Gly | | | |
| 51 | 35957 | 36030 | 832 | CUCCGUAUAGCUCAGCCUGG UAGAGCGCUCCAUUUGGGAU GGAGAGGUCGAAUGUUCGAG UCAUUCUAUGGAGA | 74 | | | | tRNA12-Pro | | | |
| 52 | 36209 | 36361 | 833 | MKYYGFKTSHFGKAYRTENIDR RRAYYESLHKAGRSRARQEGQ KQAKEIE | 50 | Hypothetical protein RB43ORF088w [Enterobacteria phage RB43] | YP_239064.1 | 5e-13 (35/48) | | No putative conserved domains have been detected | | |
| 53 | 36358 | 36723 | 834 | MNIFIGVANNVNAITVKLQWNR PTNFALGLCKSERDLMLHADFA YTFDERKGMWVWWIKCRYEALIK YEYFSERDIQEVIAYHSGCKVS KLRQVIPFTNASNVEELITDFKRI YQAKYDERF | 121 | No significant similarity found. | | | | No putative conserved domains have been detected | | |
| 54 | 36707 | 36940 | 835 | MMKDSKGRDVQVGDIVFYGER TYNKGGRGSMRCGRITDIASGL AKVDNDYVAMRSKSFVKVSPM FATMWENGTIFEI | 77 | Hypothetical protein Ea21-4_gp102 [Erwinia phage phiEa21-4] | YP_002456125.1 | 7e-04 (25/72) | | No putative conserved domains have been detected | | |
| 55 | 36995 | 37219 | 836 | MKRIALIVDQEAMFAATGKFHP VSKFVARSEKIVGLVETVAGDVI VSIKTSEISPVVKVAVENDFWEV ADFMCE | 74 | No significant similarity found. | | | | No putative conserved domains have been detected | | |
| 56 | 37298 | 37371 | 837 | GGCCCUGUAGCUCAAUUGGU AGAGCGUUCCCCUCAUAAGG GAUUGGUUGCAUUCCGAGU CUUUGCAGGGUCA | 74 | | | | tRNA13-Met | | | |
| 57 | 37394 | 37594 | 838 | MMRLVKVVEESEYMGDSRMI EEFVTVEADSESEIVDKVYRHF DNMSDSYGTMYSIYRLDVIVHIN | 66 | No significant similarity found. | | | | No putative conserved domains have been detected | | |

Fig. 12Q

| orf | Start position | Stop position | SEQ ID NO.: | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| 58 | 37605 | 38162 | 839 | MHIRFGQVIPKGLAMAITTWEN DADRYSTQMVYGLEKEEINQVI HVLEWFSSNGRRGEYLGNNDY NHEAILEKLHTEQKYVTPEFSKK FFGVDVPAYDCTDEEFDAYLDN HYSCSNEVMYAIQAWLGNPIEY DYDFMRVFEKVEIFDIKEEIRIPD APVAFHVGITYKQKESPLKVDW LKYVKEK | 185 | Hypothetical protein EpJS98_gp138 [Enterobacteria phage JS98] | YP_001595267.1 | 2e-20 (63/162) | | No putative conserved domains have been detected |||
| 59 | 38162 | 38611 | 840 | MDIGSGSSYPSCALSNFAPHKF IYDGVECASMEGFLQSLKFSSP EMQAHVCTLVGKSAKFKGKKK RWWPTQTLYWKGVPIHRASEA YQNLLTGAYDALSKNEGFRKAL AATRNATLTHSMGKNKISETILT EREFCNQLYRLRNAINNQ | 149 | Hypothetical protein KP-KP15p076 [Klebsiella phage KP15] | YP_0035799952.1 | 4e-57 (114/146) | | Phage_30_3 proteins | pfam08010 | 4,60e-65 |
| 60 | 38757 | 38840 | 841 | GCGUCGAUGUUGGAAUUGGU AGACAAAGGAGACUUAAAAUC UCCCGGGAUUAAACCCGUAC GAGUUCGAGUCUCGUUCGAC GCA | 84 | | | | tRNA14-Leu | | | |
| 61 | 38846 | 38918 | 842 | GCCCUUAUAGUGUAAUGGAU AGCACACGAUCGUUCUAAGG UCGGUAGUCCGGGGUUCGAGU CCUGGUGGGGUA | 73 | | | | tRNA15-Arg | | | |
| 62 | 38923 | 38995 | 843 | GCCGAUUUAGCUCAGUUGGU AGAGCGCUUCACUGUAAUG AAGAUGCCGCGGGUUCGACU CCUGCAAUCGGCA | 73 | | | | tRNA16-Thr | | | |
| 63 | 39268 | 39852 | 844 | MKFKDFLTEEELFEAAPGRMTK SKWRDALVLVPRGERHDFSKF AASVEKIYGIGISDPKDYAKVAA AFESLGGKVTTPARGASPAQA PAAKPAPVKAKPKNIPGLKISGD HGDIIGSGELFKAIDKALPLVRD NGPLYKAVQFYFDNLWKYRES QGAKPSARETOHIGEVKTLLAK LNHHLVELSRQTELSYNV | 194 | No significant similarity found. | | | | No putative conserved domains have been detected |||
| 64 | 40040 | 40330 | 845 | MSKFNFIQIERGYNNYGTPDRY RAIWIKGEHEHAVFNVAETREL KDLIKHVRKDWPAVEEYYVRVY HEEAPTETVQIKFKAKTASALTKR IEAVINC | 96 | Hypothetical protein RB51ORF009 [Enterobacteria phage RB51] | YP_0028539964.1 | 7e-08 (40/93) | | No putative conserved domains have been detected |||

Fig. 12R

| orf | Start position | Stop position | SEQ ID NO.: | Aminoacidic sequence | Size (aa) | Homologous/similar proteins Name[organism] | Homologous/similar proteins Acc No | Homologous/similar proteins E value and identity | Predicted function | Conserved Domains Name | Conserved Domains Acc No | Conserved Domains E value |
|---|---|---|---|---|---|---|---|---|---|---|---|---|
| 65 | 40378 | 40971 | 846 | MSILKKLVEFIRSKFGTFVAQNT SVEDQYTMAANRIIDEITKLRTT HVKSVNEEKRLLKLADEKDQAG ASKEREIRRLMAEGMNVETHAK LGLLYRRTAKALRDKAAEYKEM RAQIEETVVKLDDQRLDLAVKL EYIRETRNASALGITSADDVIEIA ELAKVDVQDIMMKVETFSGTQP GIETTADVQEYLESLK | 197 | Hypothetical protein EME08_gp126 [Enterobacteria phage IME08] | YP_0037342 7.1 | 7e-68 (128/197) | | No putative conserved domains have been detected | | |
| 66 | 41042 | 41602 | 847 | MATPQIKELIAAGFPTEITDILGK FAYPDTRPENWKTRYNGYNT VLPRAIVLKDYSKLKNLISNISSI SDGVKLVDIFALRYGIYSFNDSP SNLKSARTNAGEYSTSGSTTYT IVIEIIHNKNSYRLGINLVKYVTS QDDYSNYLNYCVNELPSKVMS MFDSNNMVGKQLIIDEFIKYCRE RVQK | 186 | No significant similarity found. | | | | No putative conserved domains have been detected | | |
| 67 | 41599 | 41958 | 848 | MSNLYLPSEPPVYNYVYKFDQI DYALVPGIGATVGAMCTFAAIDI MHLTDITPAVLFGILLAWWGTSL LIMGLIECSRWVKWSRNNYKRK AEWKEQCKNLTLEWNRKKSFE FIKEVRRK | 119 | No significant similarity found. | | | | No putative conserved domains have been detected | | |
| 68 | 41955 | 42251 | 849 | MNEYKPDGFWNQDGLAPGFGI VTWLLYCAFVIVGGTFFGLNVS EFMIMLLFLGVFAFSLMWMLIA LINCCTFLAYRMKYKKWKEKED FNTWIRSCRK | 98 | No significant similarity found. | | | | No putative conserved domains have been detected | | |
| 69 | 42248 | 42574 | 850 | MIKTCYRGMIKSDEPGYFFLFLL IWFSLSAFVGFGTFWGFYFFSP VFGDALYYIGWMSGVGTWFAIL ARWLQFVSQRQRGVFDKPKVK KEKSKDDSRSETLSWIKEMK | 108 | No significant similarity found. | | | | No putative conserved domains have been detected | | |
| 70 | 42574 | 42810 | 851 | MAVAVHVKFENGDTRLLCYSD NESLSGIEISLKEELLGINGPICD FSVEGSDNCNDDLESMVYTAM EDILEESWNECQ | 78 | No significant similarity found. | | | | No putative conserved domains have been detected | | |

Fig. 12S

| orf | Start position | Stop position | SEQ ID NO.: | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| 71 | 42801 | 43253 | 852 | MPMKELSAGILFFTDDKRLLMG RMTNTYVQGRGSRWDIPKGHV EPGETPKEAAIRECKEETGFTE FDQDLLYDLGRHDYASNKDIHL FGYMLPVSPEMFRNCRCTAYH KDENGINFPEIDAFALIKPSQWK YVMGPSLYKIMTQMYSTAQ | 150 | NudE nudix hydrolase [Enterobacteria phage RB69] | YP_861819.1 | 6e-47 (89/144) | nudix hydrolase | Nudix_Hydro lase | cd02883 | 3.28e -15 |
| 72 | 43261 | 43569 | 853 | MEEAVELGIPHIYKHELRFIHDG KWISIFHPRDKMSRILMKSRYVF SDSEYIKSAYYIAEQLYPGFSEL PEDDKRDYVWWKDKWTPYEK CSLELFIAKCRAK | 102 | No significant similarity found. | | | | No putative conserved domains have been detected | | |
| 73 | 43599 | 44093 | 854 | MDIFGMLRIDEGYDSKIYKDSE GYWTIGIGHLLTKDPSKSLAISN LDKLVGRSTGGQITQAEAEVIFA KDVEKAIKGIVANATLSPVYNIL DDVRRAALINMVFQMGVSGVA GFPASMKLLLAKKWDAAAKELA NSRWYRQTPNRARRVIETMRT GTWAAYQGK | 164 | Chain A, E108v Mutant Of T4 Lysozyme | 1QUG_A | 3e-57 (108/162) | lysozyme | Bacteriophag e_T4- like_lysozym e | cd00735 | 5.01e -45 |
| 74 | 44094 | 44573 | 855 | MKTYQEFLNESRLATVGVMTE SVGSNLLKFKKGQKMTATLED GTEIEMDVVGYNYVVDGKLYNK SHAKFDSFDDFVSSVEDESSRK AVASGDARSLMAHGHMRIKSK QNKPGEDNFALVGYQSGKTSN GYQRTVTMYMRNGKIAFVNDR GAIRYAKSIK | 159 | Hypothetical protein RB32ORF123c [Enterobacteria phage RB32] | YP_803065.1 | 3e-60 (111/159) | | No putative conserved domains have been detected | | |
| 75 | 44766 | 45068 | 856 | MKTYKEFITEARVSAGKLEAAIN KKAHSHDLSDKDRKKLVSLYI DKERILALPGANEGKQAKPLNA VEKKIDNFASKFGMSMDDLQQ AAIEAAKVIKGK | 100 | lpII internal head protein [Enterobacteria phage IME08] | YP_00373425 9.1 | 4e-47 (93/100) | internal head protein | No putative conserved domains have been detected | | |
| 76 | 45272 | 45805 | 857 | MKYLTPIYLTLMHAFKDAADRR LNNPNYSFYEPSCLMREYGTLR LDGGRQTGKTAALCQFATDWL LEDGSVIILSTRYTQSSELMEGI LREYNSSHLINKLPANEIAKSIVP MTIREFLSNDSSYKFRGRKLGR ALIIIEEPMKVPDMMKFYDMYQ EAIRWSMPNDTLPLFFVIGMQ | 177 | Vs.8 conserved hypothetical protein [Enterobacteria phage JS10] | YP_00292245 8.1 | 3e-40 (91/180) | | Terminase_6 | pfam03 237 | 1.09e -03 |

Fig. 12T

| orf | Start position | Stop position | SEQ ID NO: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 77 | 54802 | 46113 | 858 | MMTQTEIVDMITVMENTGFADM KQLITMVTAGNLLEYKRYKFLS GPFKGAEFISNAPNTKWMNRY PNFRIEFISGKLKGVISSSLITYD QRIQEKTMQWLKLL | 103 | Vs.7 conserved hypothetical protein [Enterobacteria phage JS10] | YP_00292245 7.1 | 2e-10 (29/54) | | No putative conserved domains have been detected | | |
| 78 | 46095 | 46439 | 859 | MAEIVIRCPPHLVESFCEWFSN SGEQDFYEAHQNGTWNETTKQ WEEATTYIGTRGYGVNEPIEVE YDKETDEEVTYHEDKITYLEAA AKFHSDEWNKMSVITAYMRGW NKESN | 114 | Vs.5 conserved hypothetical protein [Enterobacteria phage RB69] | NP_861809.1 | 2e-10 (36/77) | | No putative conserved domains have been detected | | |
| 79 | 46448 | 46810 | 860 | MKAYQILEGELKGTIYIEDGDDA RVIVSKVLKEDTITDAETFYGYK AREVEIEYQPTVKIEGGQHLNV NVLRRETLLDAVEHPEKYPQLTI RVSGYAVRFNSLTPEQQRDVIA RTFTEAL | 120 | Autonomous glycyl radical cofactor [Enterobacteria phage AR1] | BAI83131.1 | 2e-51 (100/120) | autonomous glycyl radical cofactor | Autonomous glycyl radical cofactor GrcA | PRK111 27 | 1,37e -40 |
| 80 | 46810 | 47091 | 861 | MAIEDIKGYKPHTDEKIGKVNAI KDAEIRLGLIFKALEEEHVEKYM NLDVSTMSDKEFDLAHERITQIR NAIQHLKEASMWACRSVFQPE EKY | 93 | Vs.4 conserved hypothetical protein [Enterobacteria phage JS98] | YP_00159523 7.1 | 1e-35 (72/91) | | No putative conserved domains have been detected | | |
| 81 | 47155 | 47613 | 862 | MSTNPEVFIRRTKLRRKFEEAF RSLNLSVRARAKAEGKEPFFTK YSDHLLDRAIQREIDEEYVFSVL SKIPNHLKEINEFLAMPWLPIDP KDIDENIEYKPMRLEITDGNLWL GFTMDIPRPGKGPSIKCRMAFV NDKRLKGKISTKVIHIN | 152 | RegB site-specific RNA endonuclease [Enterobacteria phage RB69] | YP_00159523 6.1 | 2e-43 (90/148) | RegB site-specific RNA endonuclease | REGB_T4 | pfam10 715 | 1,91e -20 |
| 82 | 47621 | 48166 | 863 | MKKALIGLMALCSTAFGSEPTF SNVQLDNLHYAYNFGEQYQKS GKEKSPHNRYDNNGLGYIMAAI SWKESSAGANLKAGKGHHSYG VFQNYLPTVKARAKLEGKNLSD SEIRKMLKSRQNSAEWAYIELS YWLNIHNGNMRKALASYNAGW NVKRGNSYASDVLEKANFLKKH KMLHTKVE | 181 | Vs.1 conserved hypothetical protein [Enterobacteria phage RB69] | YP_861805.1 | 5e-59 (115/180) | | REGB_T4 | pfam10 715 | 1,00e -18 |
| 83 | 48166 | 48486 | 864 | MVKYAALLGLVLAFSANAENSM TDSLRIAKTFCNTNSECVDILAL ELDSAFSDGVKDSRSPAQWTT LINRKAKSMKDLCVNAPNENICL MYRDQLMARYMSGLSSK | 106 | Vs valyl-tRNA synthetase modifier [Enterobacteria phage Phi1] | YP_00146943 6.1 | 4e-13 (34/80) | valyl-tRNA synthetase modifier | No putative conserved domains have been detected | | |

Fig. 12U

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and Identity | | Name | Acc No | E value |
| 84 | 48483 | 48875 | 865 | MKKAAILLCCAFSVNAWEKLPG YPETVLAAQGTKIESNGPFKNNI EIAFVPSSRKLLMSFYNYQDKD DQVIVPLVEYNARGCGMQSDG VSVDGVMHPKEQGVLNPILNC NNAIFLRVYNNLNEYATYKIP | 130 | No significant similarity found. | | | | No putative conserved domains have been detected ||| 
| 85 | 48884 | 49351 | 866 | MITGYIKGNIVELFMKHECDIAH GCNCFTTMGAGVAGQLAKAYP PILDIDIDEDRYYDNNLAKLGTH TRAIHKKGTAYCYNLYTQYAPG PNVDYGAIFNAFHELNSGRIVY NRPLYIPKIGAGIAGGDWELIEK LINLATPDIDIMVVEYEEAKS | 155 | Tk.4 conserved hypothetical protein [Enterobacteria phage JS10] | YP_00292245 1.1 | 3e-41 (89/157) | | tk.4 | PHA025 95 | 6,30e -49 |
| 86 | 49375 | 49542 | 867 | MITEEQKTKLWQLIDDYAGAEQ VVAISAIYGNGLPEEYDELIRSK NAISDFMETL | 55 | No significant similarity found. | | | | No putative conserved domains have been detected |||
| 87 | 49542 | 50141 | 868 | MAQLYFNYASMNAGKSANLLT AAHNYKERGMGTLILKPAIDTR DSATEVTSRIGLRHEANTVDESI DILEFFKWAQTQRDIHCVFVDE AQFLTAEHVLQLCKIVDLYDVPV MAYGLRTDFRGELFEGSKALLS VADKLVELKGVCHCGRKATMV ARIDENGNAITDGEVVELGGED KYVSLCRKHWCELVGVYNEAK NV | 199 | Tk thymidine kinase [Enterobacteria phage RB69] | YP_861801.1 | 3e-81 (137/192) | thymidine kinase | Thymidine kinase | PRK042 96 | 3,20e -80 |
| 88 | 50122 | 50316 | 869 | MKPRTYNTILMLVLSMLFIWMG VAASIQSDRREELQNRLDSGCK VLAQGKDFIANTNGCYIKYE | 64 | No significant similarity found. | | | | No putative conserved domains have been detected |||
| 89 | 50600 | 50983 | 870 | MSRTIRRKGWHVVKSSKWNDQ NNNEFAYIKSYNEYVKTQKDKE NQQKYVELRISENSERPLEAKK LIAKSKRDGFWKTLRWTRYAM PVPRLFHKAEIKRALKYDEEYN WDEAGARTIEQGICEWLWD | 127 | No significant similarity found. | | | | No putative conserved domains have been detected |||
| 90 | 51030 | 51242 | 871 | MQHLSEKQLRNLTVEQLDELR REIGHGISHLQEEIRQHSSKADY TRKRTLEKYLKEVKAVLQHKRN TGQK | 70 | rI.1 conserved hypothetical protein [Enterobacteria phage RB69] | NP_861800.1 | 1e-20 (51/69) | putative lysis inhibition regulator | No putative conserved domains have been detected |||

Fig. 12V

| orf | Start position | Stop position | SEQ ID NO.: | Aminoacidic sequence | Size (aa) | Homologous/similar proteins | | | | Conserved Domains | | |
|---|---|---|---|---|---|---|---|---|---|---|---|---|
| | | | | | | Name[organism] | Acc No | E value and identity | Predicted function | Name | Acc No | E value |
| 91 | 51254 | 51541 | 872 | MAFNHICLALVLGCGISFPAASH DDISDYNSYVEGALQVYAKFKE PSKQESEQFYAFVQSKWKSES CSKDCDSLGRSAGEEYANRMR IQFDNEVQ | 95 | Hypothetical protein Acj133p120 [Acinetobacter phage 133] | ADJ19435.1 | 4e-13 (36/82) | | Hypothetical protein | PHA020 54 | 3,47e-06 |
| 92 | 51528 | 51914 | 873 | MKFNDFVDGKLTPQDEFIGLL MVSQAYFHSAHFDTKSYARHK AYEVFFNEIPDLIDAFGEQWLG FSGKSYTPALPSQKELPKDTIE MLDFILAKADGIYKSVPAALQSV LDDITGLCYKTKYLLSLQ | 128 | MobD.6 hypothetical protein [Enterobacteria phage T4] | NP_049716.1 | 2e-43 (79/128) | putative lysis inhibition regulator | rI.-1 hypothetical protein | PHA026 04 | 6,38e-44 |
| 93 | 52019 | 52507 | 874 | MIKLTTELQPGKIFYHVCGVNRT ETKPGEITRYIVASGTYDVELGL SGVYSRKSPFFQVICEYENYAG QTESYSTERSAHDMGIFKPGEK RSVHNLNRGFWTREEAEQFIKE LQENKFSDPDDQAYADRLTPS EDFRRQQEFMDSYLDSCDYDY YDFDDGEE | 162 | No significant similarity found. | | | | No putative conserved domains have been detected | | |
| 94 | 52599 | 52865 | 875 | MNGWGPSDDGFATREATIADG IEWARLQKQLQEQRESEEFCV DCDEEIPVARRLLVKGCQRCVE CQGKWDTVMTSAYNRRGSKD SQLR | 88 | Conserved hypothetical bacterial protein [Acinetobacter phage 133] | ADJ19431.1 | 1e-24 (54/88) | | Hypothetical protein | PRK110 19 | 4,8e-16 |
| 95 | 52868 | 53059 | 876 | MESILDSTNLDNPYSDVHVKVV NSYFTKKLSRVVLKQGNDIIHLD TKQIDSLIQFLIEAKDGE | 63 | No significant similarity found. | | | | No putative conserved domains have been detected | | |
| 96 | 53049 | 53282 | 877 | MASKLVWDGKPRKGDAVIEDE SPHVIDLYLTVFHTYEHNTIEIE RDGDCVAIDKSDAIELVKYLTA MIPTMKQDNL | 77 | No significant similarity found. | | | | No putative conserved domains have been detected | | |
| 97 | 53282 | 53782 | 878 | MNINKNSWHFKMNLWFKSGNI WKMPKTLCGYFWTTVLHILFSS AIAIFIGSVAWMFGWPLIAQTGIL AWIGVSLSAFWLNVVAVPVGAV FIATFVLAFVAIVFGFIFGLEKFK EYRKNKQFTKKLARVKAGLPAE SEPLVFIQYLKARKRKVCPMIDY VEGKTSEE | 166 | RB69ORF104c hypothetical protein [Enterobacteria phage RB69] | NP_861794.1 | 2e-14 (55/163) | | No putative conserved domains have been detected | | |
| 98 | 53772 | 53996 | 879 | VKNDQVYIVNGRKAVFRAKTER GIISTYPIAEFTFEDGEQIKIKYV PLSQTYRFIGGEIDLDIYYEGGV WKLKS | 74 | No significant similarity found. | | | | No putative conserved domains have been detected | | |

Fig. 12W

| orf | Start position | Stop position | SEQ ID NO.: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| 99 | 53978 | 54400 | 880 | MEIEIVTTKKKLSMSILKQMKM ASSSEIKFAMFDRVHRVLGYVN AFKWNKMDIQVAIINTGNDWAL VPMYDTHVIKTARREPHPDGQ EYHFHDVVYHTMQKIGNVHR NSKKSTDKEHVEACAKASNDLI KFAKGNHIYL | 140 | No significant similarity found. | | | | No putative conserved domains have been detected | | |
| 100 | 54397 | 55407 | 881 | MKTIVKSYFGSHLYGTSTPESD VDFKEIFVPHPRDILMCQAMNH TNCNTNNSATKNTKDDVDHELF SLKYFFKLAADGETVALDMLHT PPELVVASDLPEVWKFIQDNRA RFYTTDMKAYLGYVRKQAGKY GVKGSRLADLHKVLDVIRDVPE WKYDDRPQQKGINERWKVQDI AEKLPLGEFLEWTTFVDHKSGE QKFYNVLGRKFQTTITIKEMKYS LEKLDAEYGERARKAEANEGV DWKALSHALRAGLQLQEIYMTG DLQFPLTHAKMVKMVKAGELPF KEVQELLESVVDEVEILAHTAEK NGMPKKVDMKFWDDFVEKVYL ENHNSYYK | 336 | NrdC.11 conserved hypothetical protein [Enterobacteria phage JS10] | YP_00292243 8.1 | 7e-132 (241/336) | | nrdC.11 hypothetical protein | PHA026 03 | 8,18e -142 |
| 101 | 55412 | 55600 | 882 | MKVFLNYGRPHKGRRWYLEAV CRETGRRENAKFSARPTRKQIH QFMSWAGETLRFSLYWAEI | 62 | No significant similarity found. | | | | No putative conserved domains have been detected | | |
| 102 | 55597 | 55836 | 883 | MILLWSVVVPIVVAIIYFIVGWSV CKHLIKNGTIEKVGEYWFYLIFW FPAFIVGAIIMFFRWAGKLPKRI AENAINKHA | 79 | No significant similarity found. | | | | No putative conserved domains have been detected | | |
| 103 | 55955 | 56170 | 884 | MKTLEIVVNNIDKAFKAAEAHGV EFEPMMVGEAFSKLAIIRGETD NLIDFVDDFYLGSKVRPYYINEIL EK | 71 | No significant similarity found. | | | | No putative conserved domains have been detected | | |

Fig. 12X

| orf | Start positi on | Stop positi on | SEQ ID NO.: | Aminoacidic sequence | Size (aa) | Homologous/similar proteins ||| Conserved Domains ||
||||||| Name[organism] | Acc No | E value and identity | Predicted function | Name | Acc No | E value |
| --- | --- | --- | --- | --- | --- | --- | --- | --- | --- | --- | --- | --- |
| 104 | 56248 | 57225 | 885 | MSTITIKKGIYFGKEISGTYELLG EWFPDSLSAEDSRQGDGKVFV ELNGKKRGVWVFKDDITIDGVA AKIEVVESVDEMKERIKKRFNV MGLMTNGLIHGNIRSLIISGAAGI GKTYSLDKALQHAHDTNAIDYK SVNGKISGIGLYCRLWESREAN SVLLIDDVDVFSDMDILNLLKAA LDSGEKRKVCWSTASSFLEDK GIPNEFEFEGTVVFITNVDIDRE LERGSKLAPHLQALVSRSVYLD LGVHTNEEIMVRVQDVIMTTSM LQNRGLRNSEVIEVLEFMKDNV NRLRNVSLRTALYIGDFVATDR KNWRTIAEVTMLK | 325 | Hypothetical protein T4Tp097 [Enterobacteria phage T4T] | ADJ39814.1 | 2e-138 (243/325) | | No putative conserved domains have been detected | | |
| 105 | 57268 | 57414 | 886 | MATLISNDVKRVLFKGGMYIVD TPKGDTSSWTINEWINYIDENG AWVQ | 48 | Hypothetical protein [Enterobacteria phage AR1] | BAI83080.1 | 6e-07 (23/40) | | No putative conserved domains have been detected | | |
| 106 | 57411 | 57836 | 887 | MSLAAIKDIECWLNDIKVYPPGH IFAGKPKGKAEKACEAICEKLYK FNFGDKKNVLAEVHSSYHELRV MVNVFRAPPFIELRKEYANKVF DTFLANVQDAVKHLDEMHKQH QDLNAYYKPWRKSYQELKNRIE LIRYEVLK | 141 | No significant similarity found. | | | | No putative conserved domains have been detected | | |
| 107 | 57833 | 58171 | 888 | MKNWVMTESEAYAAYVSPDDR RSELFGYYGSYCVAEEAVKGQ SWWGSDGTVNRKPTELITFTD ENGESWTFPKSAAISVQEETPE AKRKRLEKIKESALAKLNPDER EALGL | 112 | Hypothetical protein Aeh1p086 [Aeromonas phage Aeh1] | NP_943964.1 | 1e-07 (36/107) | | No putative conserved domains have been detected | | |
| 108 | 58168 | 58488 | 889 | MSKEFSTTRMVDAFGYPCNGY REFIHPEVENQFKEVVRNILLNA FKTQGTNPRDLGIYLEEAIRDV QKSVSAKLHWAEENIAWSNKK RSDLNWPADREQIVNYAKG | 106 | No significant similarity found. | | | | No putative conserved domains have been detected | | |
| 109 | 58492 | 58782 | 890 | MFNTIVSIHAYYEGQLNAARTK YKRGMEESVECLKDIQTFAQKT QNLILMDRKQVSLAEELKASKMI IEDNRKHQLKLLKRRQHQSPW FNSDFRSF | 96 | No significant similarity found. | | | | No putative conserved domains have been detected | | |

Fig. 12Y

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 110 | 58863 | 59027 | 891 | MKAPTWNELQEMFNTEEAFGTI SEMVENLVDSPSEDNLLCLAQF IIETYIENQK | 54 | No significant similarity found. | | | | No putative conserved domains have been detected | | |
| 111 | 59024 | 59290 | 892 | MTVYVDVLMNHGWKMRGHQV KNCHMFSDNLDELHAMAEAIG MKRSWFQDKRVPHYDLRDVR RKQAVALGAVEVSRRDAVLLW RKFFTK | 88 | Bcep22gp48 [Burkholderia phage Bcep22] | NP_944277.1 | 4e-07 (31/79) | | No putative conserved domains have been detected | | |
| 112 | 59348 | 60136 | 893 | MKTLTEIISALVEENRVARQAHR AKVEKRAEELNAGWAKTRFGR EYFDKVVAPTWGKDDRPHAPF DGYLWENELGEVEAYHAGSYL PYVTELDSLDKPEYTGDHGWW KIRLTQEEYKELREYGYPLEVRI PYKEWKLQDGTNVVMAEVRAH KSILEAIQEHSKEVFDNIFNELN KNKGDAPEGRVTVSGTVTSVK VYEDYYGVQCKMMVVLENGAT VYGSLPKSIPFEYRGKVQFTAT FELAKDDKTHAFYKRPSKVIML DE | 262 | No significant similarity found. | | | | No putative conserved domains have been detected | | |
| 113 | 60207 | 61181 | 894 | MNKNELKMFVEAEFNKLKDKTL TKREKHVKVLSALHDLNPRAYD VAIAGNVARRVLNSMASHEANY AGFVVENIRRSRWLGAMSAEK QLKKFAIGNAKIYGQRYSFAAG AFKTEERHDRSAAQIFCSEFNA NLRRILNRSICLLKGDDRVKYQA SSTSSRNPKGVSFIRAEELDNV TVRIHNSHLSSGKYPARALLAQ VRTALDHMDVVKKSCCKQQGE NSSVLEVHLDPFKIFPKTLSTTP VIDEDVAHMYLNVVKPLPLTPV NHIEIAKNSITAEMESVKRFIDTK EAELAKHELTMADLVKSLNEYK ERYESLEYARSLL | 324 | No significant similarity found. | | | | No putative conserved domains have been detected | | |
| 114 | 61178 | 61438 | 895 | VKNQLKEDMVVDDNDLEIEFEY PPVPEFKIDWDACLEMVDRRE AAAKQVVPCEKCGSIQVQLVD WTTDILKMKCRTCKHRFERKLK | 86 | NrdC.2 conserved hypothetical protein [Enterobacteria phage T4] | NP_049700.1 | 2e-11 (34/78) | | No putative conserved domains have been detected | | |

Fig. 12Z

| orf | Start position | Stop position | SEQ ID NO.: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| 115 | 61435 | 61749 | 896 | MITKTITGANTKFFVEYANNLIK DKNFDNIIADMILDAYESGIDPM QLKEYLRATMDFTVLNMMLRT DTEFNEMIARRNEGKFNLTDDE VLACAAHEAWKKVIK | 104 | No significant similarity found. | | | | No putative conserved domains have been detected | | |
| 116 | 61746 | 62081 | 897 | MKTTGALWKEFYNDEAFWEGY YHDDTLILFDDVEVEEYEDPSP DAVVKIESGYVYKTDDDSFTSH DLSLETFFKRWKKKQTTRTMVV TVDKDDFAKVFETISNIPGVKKV K | 111 | Hypothetical protein phiSboM-AG3_gp129 [Shigella phage phiSboM-AG3] | YP_003358616.1 | 7e-09 (41/115) | | No putative conserved domains have been detected | | |
| 117 | 62078 | 62590 | 898 | MIDIKLDTYAVRQLFPEGTAARA QLQQSVINNIVKEMVLKDSQNK LKQAVQSEVNIAAVTIPDVRAEV KKQVQQMFHTRGWNDMSAKE EMSQMMRNAAQSCAKNAIDDM VRQTIDDAVKQAEGRIKMSIER ANLRIQEIIVNAMNKNFADQINA AIAAKLAEHFPVTANG | 170 | Hypothetical protein KP-KP15p225 [Klebsiella phage KP15] | YP_003580101.1 | 1e-05 (43/173) | | No putative conserved domains have been detected | | |
| 118 | 62583 | 62756 | 899 | MDKIDFSKLNIPRMGIPDDIAKQ LASVQPMPDNCIKDIFDALDGK TLVITTKAENGS | 57 | No significant similarity found. | | | | No putative conserved domains have been detected | | |
| 119 | 62746 | 63036 | 900 | MARKRYMEEAERVMLLMYSVY YNETGQIVDSSKLKGAMTRGR GFAQAAIDKEIISRLGIKYSSKM YLHPGWNQVQAQVFKEIEEDV HSFWLRQQHP | 96 | No significant similarity found. | | | | No putative conserved domains have been detected | | |
| 120 | 62999 | 63268 | 901 | MFTVFGYDSNIHKCVFCDNAKR LLDVKKQEYAFINVMPEKGVFD EVVISDLLRRLGRESQVGLTMP QIFAPDGTHIGGFDELRKFKFN A | 89 | NrdC thioredoxin [Enterobacteria phage JS98] | YP_001595211 | 2e-34 (68/85) | thioredoxin | GRX_GRXb_1_3 like | cd03418 | 1,52e-08 |
| 121 | 63261 | 63449 | 902 | MHDYRGTLLREGDIVALYYGYG GLETGEIKQIKNHRAKVEVTYS NGVKVMSKWKYGECMVKL | 62 | Hypothetical protein RB32ORF082c [Enterobacteria phage RB32] | YP_803024.1 | 9e-16 (42/62) | | No putative conserved domains have been detected | | |
| 122 | 63468 | 63638 | 903 | MSYDIGDLKAPCTVTISAEEFIR LQAIEELLWEIECALPSGLESWI DDEDLQKLRG | 56 | RB32ORF081c hypothetical protein [Enterobacteria phage RB14] | YP_002854418.1 | 6e-15 (42/56) | | No putative conserved domains have been detected | | |

Fig. 12AA

| orf | Start position | Stop position | SEQ ID NO.: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| 123 | 63640 | 64029 | 904 | MTNAELVKEIKHIAGVTGEWDD NYDFEYPPNAPDDAEEIFVLV EDDEWTQDHKYQSRSQIWYYP ARGVHFMVSESRSGSYHTDWY YNPPEVDIVTRHEKVVTRTEVE WRIEYDSVNDSAPAPCKAAKA | 129 | Hypothetical protein RB51ORF087 [Enterobacteria phage RB51] | YP_002854040.1 | 2e-12 (39/90) | | No putative conserved domains have been detected | | |
| 124 | 64008 | 64166 | 905 | MQSSKGIKPWYTARWETVEPE EDAIPEEDYNTSEPTINELLDYE DKVNGTYW | 52 | No significant similarity found. | | | | No putative conserved domains have been detected | | |
| 125 | 64150 | 64602 | 906 | MELIGKQFEVIENDDELTEQFP QFVPGFKFQVINAVNEDDLETC GITAVIDLLTNKIITINDPTPFGES WFWCFYSEDTMHQIKEIGQGE DVPNISEIKLDHFHGKIVPITKAL YAFAGQENCDSEEYDLMQKAA DYIVALETRLGVQYV | 150 | Pin protease inhibitor [Enterobacteria phage RB69] | NP_861778.1 | 1e-10 (50/144) | protease inhibitor | Inhibitor_I24 | pfam10465 | 4,84e -11 |
| 126 | 64595 | 64903 | 907 | MSKSCVTKTITVKILDFCDIHRIA REILRSHGYKIGDIIKFSNGYYD DDIGGMAWPKMSIIHKETNSYIE FNADDYEGIYAFCTSFCIKESNH NIYSSYSLI | 102 | No significant similarity found. | | | | No putative conserved domains have been detected | | |
| 127 | 64940 | 65413 | 908 | MLLTGKLYKEEKEKLYQAQNGL CPCCKRPLDEDIQKNHLDHDHA LEGDNAGKVRGLLCNLCNAAE GQMKHKFNRSGLKGQDIDYLE WLENILVYLRQNRKDSNIHPQY VADMAKRFSRLGKPEMIAEMEL HGFTYEESDGKSQLASKYKKQ LRKSLK | 157 | gp49 EndoVII packaging and recombination endonuclease VII [Enterobacteria phage JS98] | YP_001595204.1 | 6e-61 (115/157) | EndoVII packaging and recombinatio n endonucleas e VII | Endonuc- dimeriz | pfam09124 | 1,60e -16 |
| | | | | | | | | | | Recombinati on endonucleas e VII | PHA02565 | 2,43e -62 |

Fig. 12BB

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 128 | 65410 | 67248 | 909 | MNIELEIQGLINKTNKDLLNENA NKDSRVFPTQRDLMAGIVSKHI ANQVIPFSVMEAHKEGVIHFHD MDYSPALPFTNCCLVDLKGML QNGFKLGNAQIETPKSIGVATAI MAQITAQVASHQYGGTTFANV DLVLAPYVEKTFAKHVRDARKY QVALVKDYAISKTEKDVFDAFQ AYEYEVNTLFSSNGQTPFVTITF GMGTSWEEKLIQRAILDNRIRG LGRDGITPIFPKLVMFVEEGINL RKEDPNYDIKQLALECAAKRMY PDIISARNNRAITGSETPVSPMG CRSFLGAWRDSSGKPVLDGRN NLGVVTLNLPRIALDANYKSSD DSNKLFKLLDERLDICKEALLTRI KSLEGVTASVAPILYQEGAFGV RMKPDDEILELFKNGRSSISLGY IGIHEFDMLTFKGSGKLVLKYIN TKLNKWTEETGYAFSLYSTPAE SLCYRFCKIDQAKFGDVKGVTD KGWYTNSFHVSVEENLSPFEKI DREAPYHSIAKGGHISYVELPD MKRNLEGLEVVWDYAIEKLDYF GVNMPVDKCLSCGSTHEMTPT ENGFTCSICGETDPKKMNTIRR TCGYLGNPSERGFNLGKNKEIM HRVKHVRETNEAS | 612 | NrdD anaerobic NTP reductase, large subunit [Enterobacteria phage AR1] | BAI83088.1 | 0.0 (478/604) | anaerobic NTP reductase large subunit | Anaerobic ribonucleoside triphosphate reductase | PRK09263 | 0.0 |
| 129 | 67220 | 67453 | 910 | MLEKPMKQVDWNQLSEWGLI WKINKEVLHPLGIATRDPESGL SAGAIQTDEPWKYDAEVEARN EVRFNEFRQNLPF | 76 | Hypothetical protein RB16p170 [Enterobacteria phage RB16] | YP_003858470.1 | 1e-13 (37/66) | | No putative conserved domains have been detected | | |
| 130 | 67425 | 67895 | 911 | MNFDRIYPSDFVNGPGCRVVLF VTGCLHKCEGCYNKSTWNARN GQLFTMNTVKEIASHLSKSYIQ GLTLTGGDPLYPQNREEISNLV SWVKARFPEKDIWMMWTGYKFE DIKDLDLLQHIDVIIDGKYEKSLP TTKNWRGSDNQRLWVRNGST WTHD | 156 | NrdG anaerobic NTP reductase, small subunit [Enterobacteria phage T4] | NP_049688.1 | 1e-77 (135/156) | anaerobic NTP reductase small subunit | nrdG, anaerobic ribonucleotide reductase-activating protein | PRK11121 | 8,77e-46 |
| 131 | 67870 | 68004 | 912 | MVLPGHMIEEIYMLTYKIMFTLN HMATELFGPEFLAMTAFILTI | 44 | No significant similarity found. | | | | No putative conserved domains have been detected | | |

Fig. 12CC

| orf | Start position | Stop position | SEQ ID NO.: | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| 132 | 68013 | 68225 | 913 | MKFINAIRKFISNVIALVALTAGA FVAIPFIVLIIIADWINPTKKDEKL SNEEFQKRVNTLTAKLQQVMK | 70 | No significant similarity found. | | | | No putative conserved domains have been detected | | |
| 133 | 68222 | 68524 | 914 | MIEIYGIPEEVWRCPGCKAVRD LLDKLQLPYEFYNVINEVDGQP VYDRPLIESLAKRIGCYPSLAIR YPVIFMDNVKQYDIPTFKTNLIA AGHDPDIIED | 100 | NrdH glutaredoxin [Enterobacteria phage IME08] | YP_003734220.1 | 7e-26 (62/99) | glutaredoxin | Glutaredoxin | pfam00462 | 6,62e-03 |
| 134 | 68710 | 68898 | 915 | MNWLNWQEALEAMSKGCKVK HVHFTDDEYFLMKNKVICDENG YDMTRWVKGESWQNEHWYIA | 62 | Hypothetical protein AGC_0014 [Enterobacteria phage EPS7] | YP_001836934.1 | 3e-04 (26/59) | | No putative conserved domains have been detected | | |
| 135 | 68895 | 69137 | 916 | MKTFAVGDIVRTRIWDGLQFEV VYVVGSDGVLHRINNLIKWHL ERFVKYHEFNSYHCTVAPVASK EYYDMLEELKSLKD | 80 | Hypothetical protein RB14ORF100 [Enterobacteria phage RB14] | YP_002854436.1 | 7e-04 (28/81) | | No putative conserved domains have been detected | | |
| 136 | 69202 | 69534 | 917 | MSQAIKNALNAFAYYKVSAMLE EGRCVTPSLLDQWEVELHGTM KEEGQKIGKARIRELVVAYLLSE FGIKAFGVEPIVVGVGEISESAIR KMKNQRKKGFRDVKAVKAAK | 110 | gp55.2 hypothetical protein [Enterobacteria phage T4] | NP_049681.1 | 4e-29 (61/107) | | No putative conserved domains have been detected | | |
| 137 | 69531 | 69806 | 918 | MKLNQNGCPSRVRFCILELRSN IVVIDEYTTIVGVGQYLDRRFDT RTHMKYGFPGKCKFYPMSADH QSVVNDEYKWAEGLTLKELEE YLDA | 91 | No significant similarity found. | | | | No putative conserved domains have been detected | | |
| 138 | 69799 | 70080 | 919 | MRKVILYTEIFTSRWVFDSVRIS NASKEDVRNAQRLAYDEAGKS PAFVKIEYIITDSALIHNVSESVL KKFCVDRINKGTSMEYFLLARE LKW | 93 | No significant similarity found. | | | | No putative conserved domains have been detected | | |
| 139 | 70074 | 70298 | 920 | MVEEQIAEIGLLGWFVSKTKDG RNLIETPEGEFIIEEDFDAFWIYE RSGENEYTSVDAFSKFEDAIDS VKAWLK | 74 | No significant similarity found. | | | | Formyl-methanofuran-tetrahydro-methanopterin formyl-transferase | PRK02114 | 1,51e-03 |
| 140 | 70286 | 70564 | 921 | MAKVNQIMIVVEGIGGFTIDSYM GVWFDNEEGMYWETHASMLN ETHYESLYSSFMEMMHEVDES DWFELSLVEFKRIMEQLFQCYR | 92 | Hypothetical protein RB14ORF65 [Enterobacteria | YP_002854401.1 | 3e-08 (32/89) | | No putative conserved domains have been detected | | |

Fig. 12DD

| orf | Start positi on | Stop positi on | SEQ ID NO.: | Aminoacidic sequence | Size (aa) | Homologous/similar proteins | | | | Conserved Domains | | |
|---|---|---|---|---|---|---|---|---|---|---|---|---|
| | | | | | | Name[organism] | Acc No | E value and Identity | Predicted function | Name | Acc No | E value |
| | | | | IMKGEL | | phage RB14] | | | | | | |
| 141 | 70561 | 70806 | 922 | MKIQLTLTHENIKGVFCLENSQI TFAQDGTYWYAESDDIAGYGM ERVFEDFEAVIDVPLDFTYNDF YRIMMKLIACAELIK | 81 | No significant similarity found. | | | | No putative conserved domains have been detected | | |
| 142 | 70873 | 71421 | 923 | MSNYVNNIKELYKSICSWKEKC RESEAAGGPRVVKQNDTIGLAI MLIAEGLSKRFNFSGYTQSWK QEMISDGIEAAIKGLINFDETKY DNPHAYITQACFNAFVQRIKKE RKEMAKKYSYFVHNVYDSRDD DMVALADETFIQDIYDKMTQYE STAYKAPGSAKKSEPTSDGPNL EFLYEAED | 182 | gp55 Sigma factor for T4 late transcription [Enterobacteria phage T4] | NP_049679.1 | 4e-76 (139/180) | sigma factor | RNA polymerase sigma factor | PHA025 47 | 1,38e -71 |
| 143 | 71405 | 71635 | 924 | MRLKINLDGFLEDVQDLDAIPYL LKMYLREVLDLDIHIDPKNPHDA DFRSDSAIIEHSYNWTDTEFTFE INYHPKE | 76 | a-gt.5 hypothetical protein [Enterobacteria phage T4] | NP_049678.1 | 2e-15 (40/68) | | No putative conserved domains have been detected | | |
| 144 | 71637 | 71939 | 925 | MNNITQEERDELQQKLMEAAE EQAIARANKIVRKNRREIIERLKA HAGDAVLDNNFPAYKYAIEKLR TILKQPFTDEIILTCWNTSRKSV WDILNAGTSKI | 100 | a-gt.4 conserved hypothetical protein [Enterobacteria phage JS98] | YP_00159519 0.1 | 2e-20 (51/99) | | a-gt.4, hypothetical protein | PHA025 71 | 1,02e -22 |
| 145 | 71917 | 72114 | 926 | MLVQVKFKRVRKDAGFTLNTAT GTMAVKVADNQYRVLGSTEGC KLIDKNSLVWVDTFQVKRWYE W | 65 | a-gt.3 conserved hypothetical protein [Enterobacteria phage RB69] | NP_861758.1 | 7e-08 (31/66) | | No putative conserved domains have been detected | | |
| 146 | 72146 | 72391 | 927 | MGSNPGHDWPEGNYACRCSN CSERYTGPKRSYFCYKCDTAR REAPAPDYEAIRNAKIDMLKRF EEAKRICEAAGYVYKKI | 81 | No significant similarity found. | | | | No putative conserved domains have been detected | | |

Fig. 12EE

| orf | Start position | Stop position | SEQ ID NO.: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| 147 | 72461 | 73657 | 928 | MKINILMARGLEGCGVTKFSLE HREWLVKHGHEVNIIYAKDKAF TRNRAHSYKDVTIPVSLADDYD KTLSLLNACDILIINSVPAVNAPE AAIDNYKKLIENIKPEVRVVVYQ HDHRALSLRRNAGLEETVKRA DVLFSHSSNGDFNTVLMEEYFP SGGLSFFDDSDSAPPVYNFQP AMNIKAIRDKYWKDFSAIDFDIH RWIGRTTTWKGYFLMFDFHES HLRPAGKTTILEGLERSPAFINIK ERYEIDYCRHYHQVKTGPGLNP QVLDRYVNSEMLERMSQSGFG YQLSRLPDKFLERSLEYTHLEL GACGTIPVFHKATGDALKFRVD GKPLTSHDSGILWLNDENKNEV FERMKHLSSDQKLYDKERNKA FEFLVEHQDSEHCFKEQFELMT K | 398 | Alpha-glucosyl-transferase [Enterobacteria phage RB32] | YP_803002.1 | 6e-164 (273/401) | alpha-glucosyl-transferase | AGT, alpha-glucosyl-transferase | pfam11440 | 1,80e-143 |
| 148 | 73728 | 74750 | 929 | MKIIHSGDWHLGVRADDPWVQ DVQRHGIKQHIDYAKKHGIKTII QYGDIFDVRKAITHKTMEFAREI AESLEKEGINLITIVGNHDMHYK NTLTPNASTEVLGKYKHITVIEK PVTIMDFDGTLIDLCPWMCEEN TSEIMKHIKESSAEYCIGHWELN GFYFYKGMKSHGLEPDFLKKY KQVWSGHFHTISSAANVKYIGT PWTLTAGDENDPRGFWVQDTE LSTFDFVPNEITWHRKLIYPVTG QVDFEEFRNLAVRIIITAVDEDL PKFESELEKVVHELRTVSKVDN SVESEDGEEVEVKSLLDLMEEY IQALEDLSADDIKALKVMSKQLY IEAQNQ | 340 | gp47 recombination endonuclease subunit [Enterobacteria phage RB32] | YP_803000.1 | 6e-144 (237/337) | recombination endonuclease subunit | Endonuclease subunit | PHA02546 | 2,02e-136 |

Fig. 12FF

| orf | Start position | Stop position | SEQ ID NO.: | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| 149 | 74747 | 76429 | 930 | VKTFKLNRVKYKNIMSVGQAAI DIQLDKCQKTLTGKNGGGKST MLEAITFALFGKPFRDIKKGQLI NSFNKKDSVVELWMEYDGHSF YIKRGQKPNVFEILRDGNKLDE AASSKDFQSYFESLIGMSYTSF KQIVVLGTAGYTPFMGLSTANR RKLVEDLLEVSLLADMDKLNKT QIREINQQIQVNDVQREALTNEI KTHHEYAEKQKKLSGDNVARL QAMYDEQVNEARGYKAELETL QRELLELVIGDDPAESIQEVQG KTFKIRSKIESYSKVLGLYDKGG HCPTCLQDLHSNDTLITKINHHV EECNTILGELKTRQSELDELAR EYNTVRARARDIKTQMGSLKQ MTITAVEKARRIKAAIDKASQEFI DNSDKIKLLQEELDKIILVKTNLV MEKYRRGILTEMLKDSGIKGAII KKYIPMFNKQINSYLKIMEADYS FTLNEEFSETIKSRGREEFSYAS FSQGEKARIDIALLFTWRDIAEK VSGVKINCLFLDEVYDSATDAE GVKATAILNKMVDANVFIISHRD HDPQAYGQHLQMKKVGRFTV ME | 560 | gp46 recombination endonuclease subunit [Enterobacteria phage RB14] | YP_00285439 0.1 | 0,0 (382/563) | recombinatio n endonucleas e subunit | Endonucleas e subunit | PHA025 62 | 0,0 |
| 150 | 76426 | 76620 | 931 | MNEFTTGQHLLAFPELKRYVLV NLFSDERHLVTEEMLRDAFTGN EYNRVMSNRNPGWMVEDYYD | 64 | gp45.2 hypothetical protein [Enterobacteria phage RB51] | YP_00285401 1.1 | 3e-17 (41/64) | | No putative conserved domains have been detected |||
| 151 | 76631 | 77008 | 932 | MINFVDVKDIQVKNVRADSNPN NQNRIRKSWVLALTEETKQAIK DKIKDSEARFAFYKSIDDEVAEK WIELMRKHYNESIKAGAKIVTDR HGGERLENDYCVDADEQLVAA GQIVAEELTATFAA | 125 | RNA polymerase binding [Enterobacteria phage RB32] | YP_802994.1 | 5e-35 (71/123) | RNA polymerase binding | Phage_Rpb A | pfam10 789 | 1,19e -28 |

Fig. 12GG

| orf | Start position | Stop position | SEQ ID NO.: | Aminoacidic sequence | Size (aa) | Homologous/similar proteins | | | Predicted function | Conserved Domains | | E value |
|---|---|---|---|---|---|---|---|---|---|---|---|---|
| | | | | | | Name[organism] | Acc No | E value and identity | | Name | Acc No | |
| 152 | 77044 | 77745 | 933 | MKFSKETLNILKNFSTINSGIML KPGNFIMTRAVNGTTYAEATIS DTIDTDVAIYDLNSFLSILSLVGD DADIIMQEDGNLAIKDARSTIFW PAADPSTIVFPTKPIPFPVANVII DFKGEDLQQLMRVSRGMQIDTI AITNVDGKIVLRGYNKVEDAALT RPKYSLTLGDYEGEGNFNFIIN MSNMKMTIGDYKLMLWAKMNG SKKQTAAKFEGASASYVVAME ADSTFDFE | 233 | gp45 sliding clamp DNA polymerase [Enterobacteria phage RB32] | YP_802993.1 | 1e-94 (173/232) | sliding clamp DNA polymerase | Sliding clamp | PHA02545 | 1,26e-86 |
| 153 | 77794 | 78756 | 934 | MKLTVNEADFMWEQKYRPGTI SECVLPAEDKEIFSALVAKGKIP HLILHSTSPGTGKTTVAKALCN DINAEMMFVNGSDCKIDFVRGP LTAFASSASIAGKQKIIVIDEFDR AGLAESQRHLRSFMEAYSTNC TIITANNLDGIIKPLQSRCRVINF GKPSPSDVKPMQIEMLKRCLAI CENEGVVVEDKKVVAALVKKNF PEFRKTINMLDHYSSKGVIDAGI LSIVLNDRGSIEDVIEAIKTKNIKE LRALAPKYAADYTWFVDKLSSE LYTMVTGPSIIRMYEIIGENNQY HGIAASIELHLVYMLIQLVEMQ WK | 320 | gp44 clamp-loader subunit [Enterobacteria phage RB32] | YP_802992.1 | 1e-140 (231/318) | clamp-loader subunit | Clamp loader, small subunit | PHA02544 | 3,56e-154 |
| 154 | 78756 | 79322 | 935 | MSLFEDDDQYNEHQIAWLGKD WTKVQELSDSYKEKAENQFFTII GSINEKQEHLNISTMDYSKFMV ENALSQHPDCMPSVYVMNLVG QGLSDQAHYNYMMASVPRGR RYGKWAKLTENIQDALILQVIMT YYKVNAIDARMYRETLEAKNKL KPALKKMKGLVTDELVKTITKNV KEQKNLKKTALEW | 188 | gp62 clamp-loader subunit [Enterobacteria phage RB51] | YP_002854007.1 | 2e-65 (118/188) | clamp-loader subunit | Clamp loader small subunit | PHA02593 | 4,34e-63 |
| 155 | 79316 | 79687 | 936 | MVKMIEITLKQPEDFLKVKETLT RMGIANNKDKVLYQSCHILQKQ GRYYIVHFKEMLKLDGRPVTIDL EDEIRRDSIAQLLADWGLLSINR GQTLAQMQNNFRVITFKQKHE WTLKSKYTIGA | 123 | Translation repressor protein [Enterobacteria phage RB69] | YP_861747.1 | 4e-48 (96/124) | translation repressor protein | regA, translation repressor protein | PHA02543 | 1,68e-55 |

Fig. 12HH

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and Identity | | Name | Acc No | E value |
| 156 | 79687 | 79887 | 937 | MTDQEFYDKLKNIRITAPEWFS LPIDEQIQYQVKETLEKYPGRKV MMCFTYDKNRVPRIQKQVIEV | 66 | No significant similarity found. | | | | No putative conserved domains have been detected | | |
| 157 | 79980 | 82688 | 938 | MKEFYISVESLGNDIVERYIDST GEERMRRVPYSPVMFSHCMEE TKYKDIYGKYCKKNTFPTMKDA RDWMRRMEDMGMEAMGMDD FKLAYISDTYGSEIVYNKKFIRIA NCDIEVTASQFPDPMKAEYEID AITHYDSVDDKFYVFDLLHSLY GSVSEWDKKLAARLDSEGGDE VPQHILDRVVYMPFNSEKEMML EYINLWEQKCPAIFTGWNIEGF DIPYIMNRVKQILGERAMKRFSP LNKVSSKIITNMYGDKEIYSIMG VTILDYMDLYKKFSFTNQPTYKL DFIAYYETKKGKLAYDGPINKLR ETNHQRYISYNIIDVESVQAIDA VRGFIDLAISMSYYAKMPYQGV MSPIKTWDAIIFNSLKEQDKVIP QSRSHVKQSYPGAYVKEPVPA AYRYIMSFDLTSLYPSIIRQVNIS PETIVGQFKLHPLGEYINKTAPR PSDEYSCSPNGWMYRKDVDG VIPVEIAKVFYQRKEWKNKMMG AKRNQELIKKVLNDKKFGTIDKF AEVNVYEDFSDDMKAELLTYTE ECLDKLMFECKHAEILGNTNQL NRKILINSLYGALGNIYFRYYDL RNASAITLFGQMAIQWIERKVN EYLNKVCGTEGHSFVVAGDTD SIYVCVDKVIEKVGLERFKETND LVEFLNQFGKKKMEPWIDQSY REMCEYMNNKEHLMFMDREAI SCPPLGSNGIGGFWKAKKRYA LNVYDMEGTRYAEPHLKIMGM ETQQSSTPTAVQNALEESIRRM LQEGEESLQQYYKQFESEYRE LDYKVIAEVKTANNIGKYDDGA GYPDKGTPYHVKGALAYNRAT AGFEGITPIMEGEKVMVIPLREG NPYGEKCMAWPSGTELPQEIR QEVLVWLDHSVLFQKSFVKPLT | 902 | gp43 DNA polymerase [Enterobacteria phage T4] | NP_049662.1 | 0,0 (675/900) | DNA polymerase | DNA polymerase | PHA025 28 | 0,0 |

Fig. 12II

| orf | Start position | Stop position | SEQ ID NO.: | Aminoacidic sequence | Size (aa) | Homologous/similar proteins | | | | Conserved Domains | | |
|---|---|---|---|---|---|---|---|---|---|---|---|---|
| | | | | | | Name[organism] | Acc No | E value and identity | Predicted function | Name | Acc No | E value |
| | | | | GMSEAAGLDYEEKSSLLDMFD F | | | | | | | | |
| 158 | 82758 | 83201 | 939 | MKSLLAVIVALTLTGCQMPQGD IVPASSVGQVRAIGGTVGYYRA SNQVSAESLAVERRLAKEKANP NRQLSAMELDMIEQNIKHELEEI KRLRKTQKERTCTAQAAAVND QIRLTDFANGGLSYNEHKQRM EQLKSLQNHIYNKCMSN | 147 | No significant similarity found. | | | | No putative conserved domains have been detected | | |

Fig. 12JJ

| orf | Start position | Stop position | SEQ ID NO.: | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| 159 | 83212 | 83418 | 940 | MEAVFGLIILFFIYFLPTFVACSR KHKSRGGIFITNLVFGWSIIGWLI ALIWSASNAQQNTIIIQQVK | 68 | Immunity to superinfection membrane protein [Enterobacteria phage RB32] | YP_802986.1 | 9e-08 (31/61) | immunity to superinfectio n membrane protein | No putative conserved domains have been detected |||
| 160 | 83427 | 84161 | 941 | MIVTPMTVQDIRQEFADALLNK EFVIDKTGVKTIEIVGASFIADEN LIFGAVNDGYIARELEWYKSQS LFVKDIPGETPAIWKAIASKHGEI NSNYGWAVWSTONYSQFANC AKELINNPDSRRGIMIYTRPQM QYDFERDGMSDFMCTNNVQYL IRDNRVHAVVNMRSNDVVFGY RNDYAWQLYVLEQLTKLLNAS GKNYSVGDIIWNVGSLHVYSRH FYLVDNYAHTGETHIAKKDYKG EWK | 244 | gp42 dCMP hydroxymethylase [Enterobacteria phage RB51] | YP_002853999.1 | 2e-103 (177/246) | thymidylate synthetase and pyrimidine hydroxy-methylase | Thymidylat_s ynt | pfam00 303 | 1,55e -21 |
| 161 | 84158 | 84994 | 942 | MIQFVIPSYKRAGAVTALTMFPE GYVPHLVVRESEKEAYETWHG HAAKIVTVPDDVDGIAGTRRLIT EMYAGQRIWMLDDDTTIHLTEI RERDDRRVPLGVGEAMSQEVF DDMVKYVETAMDCGYYHGHA RLPIFKITSSWGHYRENSFGFT NTFYDLTKLTAEDIGYGIIDLNED AYAFLKLINMGHPHLALFKYLVK SGKVQSPGGCSTQRDTARQN RALEQLHAAFPNQARWKSKDG ERRGLFGDDEPLKSIRMCINTR VKSQAFHEFGKVEPYL | 278 | Beta-glucosyl-HMC-alpha-glucosyl-transferase [Enterobacteria phage AR1] | BAI83052.1 | 4e-106 (180/277) | beta-glucosyl-HMC-alpha-glucosyl-transferase | No putative conserved domains have been detected |||
| 162 | 84991 | 85242 | 943 | VRAKALQGPLMNIYDKSDVAGN IFKAEEFRCFVCKSDEFVHEGT TGSDGMHCWWHGMCVGCKIH YEIDMETVVYNTKKKWNFC | 83 | No significant similarity found. | | | | No putative conserved domains have been detected |||

Fig. 12KK

| orf | Start position | Stop position | SEQ ID NO.: | Aminoacidic sequence | Size (aa) | Homologous/similar proteins ||| Predicted function | Conserved Domains || E value |
|---|---|---|---|---|---|---|---|---|---|---|---|---|
| | | | | | | Name[organism] | Acc No | E value and identity | | Name | Acc No | |
| 163 | 85325 | 86500 | 944 | MSDLKSRLIKASTSKMTAELTK SKFFNEKDVVRTKIPMLNIAISG ALDGGMQSGLTIFAGPSKHFKS NMSLTMVSAYLNKYPDAVCLFY DSEFGITPAYLKSMGVDPDRVI HTPVQSVEQLKIDMVNQLEAIE RGEKVIVFIDSIGNMASKKETED ALNEKSVADMTRAKSLKSLFRI VTPYFSIKNIPCVAVNHTIETIEM FSKTVMTGGTGPMYSADTVFII GKRQIKDGSELEGYQFVLNAEK SRTVKEKSKFFIDVKFDGGIDPY SGLLDMALDIGFVVKPKNGWYA REFLDVETGEMIREEKSWRAK DTSSTEFWGPLFKHEPFRDAIK ARYQLGAIDSNAAVDEAVAEMI NSKVSTKVDGVKLPESGSVSAA EVEDELENFMNED | 391 | RecA-like recombinase protein [Enterobacteria phage RB32] | YP_802982.1 | 0.0 (342/387) | RecA-like recombinase protein | recA | cd00983 | 4.14e-13 |
| 164 | 86490 | 86840 | 945 | MKTEFDLESELEKFEQESPSEE GDFERQERVFKKSHEIIQEAMK TVIQEIVKLNGQSHLVYVHKLNI SPSGEVTIEFSTPSEAHKDELY PHVEACVKQQIQSALKTKKKSL WKIF | 116 | gp40 head vertex assembly chaperone [Enterobacteria phage IME08] | YP_003734187.1 | 1e-13 (47/108) | head vertex assembly chaperone | Phage_head_chap | pfam11113 | 2.81e-12 |
| 165 | 86850 | 88289 | 946 | VVETILANLIYNQAFFTKVWPYM DKEYFEQGPAQTVFNIIKKHVN EYTAIPSKTALCVALDNSSITET EHEGAKKLIDKLSDAPEDLNWL VKETEKYVQEKAMYNATSRIIEI QTNAQLEPNKRDKRLPDIGAIP DIMREALSVSFDSYIGHDWMED YEARWILSYQNKARKVPFKLSIL NKITKGGAETGTLNVLMAGVNV GKSLGLCSLAADYLQMGHNVL YISMEMAEEVCAKRIDANLLDV SLDDIDDGCVSYAEYKGKMEK WRSSSTTLGRLIIKQYPTGGANA NTFRALLNELKLKKNFKPTVIID YLGICASCRIRQYTENSYTLVKA IAEELRALAVESETVLWTAAQV GRSAWDASDMDMSDIAESAGL PATADFMLAVIETPELAQMKQQ LIKQIKSRYGDKNINNKFSMGVH | 479 | 41 helicase [Enterobacteria phage RB69] | NP_861732.2 | 0.0 (386/484) | DNA primase-helicase ATPase | Helicase | PHA02542 | 0.0 |

Fig. 12LL

| orf | Start position | Stop position | SEQ ID NO.: | Aminoacidic sequence | Size (aa) | Homologous/similar proteins ||| Predicted function | Conserved Domains ||
|---|---|---|---|---|---|---|---|---|---|---|---|
| | | | | | | Name[organism] | Acc No | E value and identity | | Name | Acc No | E value |
| | | | | KANQRWVEIEQQNDPTKPNPSNTVREGAGAQNRVAESNRQERVSRSKLDALAEELKF | | | | | | | | |
| 166 | 88300 | 88533 | 947 | MIFVFSVIRDQSGRSFVVTASDSVHRGVIAYNKADLSSYDYGEVKAYNDEGIWVNSAIYLPTKNLTSDEVLEKLFKR | 77 | No significant similarity found. | | | | No putative conserved domains have been detected | |
| 167 | 88594 | 88887 | 948 | MKKIVLALIFAVSSCSAVPALANYDKDLCEWSMTADEKDVAEQIRADVGHIIDNTDPSKMKEVQAEISNDGAAIKLNYALYCDANFDNFTIASWILG | 96 | Protein spackle precursor [Enterobacteria phage AR1] | BAI83046.1 | 6e-21 (47/96) | protein spackle precursor | No putative conserved domains have been detected | |
| 168 | 88884 | 89102 | 949 | MITYVLVMAIMTGAGGVSTEKLSFTGMNESSLAQKCEDAGKQFTGIKADSGFGSPSVYTTYKCIRIDGGNNK | 72 | No significant similarity found. | | | | No putative conserved domains have been detected | |
| 169 | 89115 | 89282 | 950 | MKTFKEFVKLNEEMVAGDAGGNPQNIASGTTSGAVVNKGPETLPKKKRDKSKPET | 55 | gp61.1 hypothetical protein [Enterobacteria phage JS98] | YP_001595156.1 | 6e-13 (38/48) | | Gp23 | pfam07068 | 3.47e-05 |

Fig. 12MM

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 170 | 89322 | 90344 | 951 | MSWVDNEFAIRAISHLPKFRHV TTSSTFKLNCRCPICGDSQKDI NKARFWIFDAGQGLRCHCFNC EYNKWLSQYLKDNEPDLYREY LLEKRKEQVFDKPKTVEPSEKI NAKLPVIEKLNFCERLDRLPKEH PIVKYVTARCIPSTSWKRLWFT NQWPSLVNSVNPGTYKNETNE PRLVIPIFNKKGEIESFQGRALR KNAPQKYITIKAHEHATKIYGLD TIDESKLVFVMEGPIDSLFIDNAI AITGGSLDLAQVPCHDNRAWIM DHEPRHPDTIKRMKRLVDAGEK VVFWDKSPWKSKDINDMIMKE GATASEITDYINQNISQGLMAKL RLDKYAKI | 340 | gp61 DNA primase subunit [Enterobacteria phage JS98] | YP_001595 15.1 | 2e-143 (243/344) | DNA primase subunit | DNA primase | PHA025 40 | 9,49e -155 |
| 171 | 90554 | 90363 | 952 | MSEVKRECKDKGGFGRYLYVG IATAALAAWNYVVVPLASTHGL VLPPMPLEKVVSFIMTGGLL | 63 | No significant similarity found. | | | | No putative conserved domains have been detected |||
| 172 | 90621 | 91142 | 953 | MPHFNECSQLIAGADKAEARYA GIVRKVGGDPLQVMLDMQKSL QVRLANDKPGTNMHPDELAQA GDIVQWLRNQKDYIDDEFRELL TSLGGMSNGEKAASAVWKPW KSDHVKMQETYIKDLSDKDQLE IKFEMIDILHFVLNMFMALGLDS EEIFKLYYLKNAENFARQDSGY | 173 | gp56 dCTPase [Enterobacteria phage JS98] | YP_001595 14.1 | 1e-73 (136/173) | dCTPase pyro-phosphatase | dCTP pyro-phosphatase | PHA026 02 | 1,24e -79 |
| 173 | 91142 | 91279 | 954 | MAKRISKRRLKIIRKQKERALVL ALREEITREIDKEILKALTAAI | 45 | No significant similarity found. | | | | No putative conserved domains have been detected |||
| 174 | 91310 | 91546 | 955 | MAYVNIKTFDHTTADGEVKGTE VSVAFKVYSDSHRIANAQYQIF PSEKAAYSTVVDDAATWATTN AKMFEAVPSDAEV | 78 | Soc small outer capsid protein [Enterobacteria phage RB69] | NP_861717.1 | 2e-19 (48/73) | small outer capsid protein | No putative conserved domains have been detected |||
| 175 | 91625 | 91816 | 956 | MICYTKPWYQSSLKKSHFDCW YRGVRAAALLLKAAPALIKAND KWFEDNNMTEGALCGKRKNL | 63 | No significant similarity found. | | | | No putative conserved domains have been detected |||
| 176 | 91794 | 92318 | 957 | VANAKIYNAKIYKVSLQRAVQS RSDANGVLRLDQDRIFTVALYS TFDKDFKDLVNKFEAFGWCPS EDYGIIKTAHVFDVDTVPGSPVA ILRALHLKGYTNVCHETSLYEYE NDIISRGKKIIDSTDSLIEFTKLV WLYMGADFIKLTPSPLLQKAAD | 174 | No significant similarity found. | | | | No putative conserved domains have been detected |||

Fig. 12NN

| orf | Start position | Stop position | SEQ ID NO.: | Aminoacidic sequence | Size (aa) | Homologous/similar proteins | | | | Conserved Domains | | |
|---|---|---|---|---|---|---|---|---|---|---|---|---|
| | | | | | | Name[organism] | Acc No | E value and identity | Predicted function | Name | Acc No | E value |
| | | | | GYNSSSCLYRNNEWFM | | | | | | | | |
| 177 | 92318 | 92506 | 958 | MDLFEMMEEPQEEVQVHPVIS KDIKDEYRIIIQKYGIKAPEALLD ELASIWSDPPPWSPWAK | 62 | ModA.2 hypothetical protein [Enterobacteria phage T4] | NP_049637.1 | 7e-12 (36/62) | | No putative conserved domains have been detected | | |
| 178 | 92578 | 93267 | 959 | MAISLNPSISVKLSKVIPIEKPIRS IDVLNFARESKGLPLYDLSVWE ALANRFDCKEQSILWQCMNNKI GEEFHKKLDSIVRRHQIDNSDIL YRGLSCRESKAFYDALIKGEKF GFGKVASFTTDETIAREFAGKW HYSTFVVIEVNNCHQSFDYHTN MKSLLITAPDSEFMRPNDVIDNI AQRRSADIEMIDKEQERMLPM GTKFKVVGHNKVEKSGLLMDY FSVTIA | 229 | ModB ADP-ribosylase [Enterobacteria phage RB69] | NP_861709.1 | 5e-19 (59/178) | ADP-ribosylase | No putative conserved domains have been detected | | |
| 179 | 93345 | 94103 | 960 | MMKFTAETAKIYTRLITTLGSAQ RRNKEFNLTPEYLFNIMQOTHC AYSGEKFGTVKGNHPDSMTLE RWNNDLGYVMGNVIPVKQKYN TLRGNNTIEGLERKANEIAARIV RSSDSVKPTSDKEASRLEKIRE YEKTITSIKTNLHNRENHLSQFV QKEKNGTATSADLELINALRTRI SGGKSELAKVERKLSAILASVP NRPSDAEIRVQSIRLIVSSLRRL EECSMLDKLKLKKGLPLTASFF QLLRGKM | 252 | Putative Srd anti-sigma factor [Enterobacteria phage RB69] | NP_861707.1 | 3e-34 (96/246) | Srd anti-sigma factor | Seryl-tRNA synthetase | PRK054 31 | 1.55e-04 |
| 180 | 94103 | 94417 | 961 | MQHYGYVVAYKDKDGFDHPVT TDMYDGERCVVFTNEESANKA RIRTMSVLTDKLAKGNFTGKSK TKGMLWWKTTELVYEPLSDVE REKLKAKIKNLHVVRVKVA | 104 | No significant similarity found. | | | | No putative conserved domains have been detected | | |

Fig. 1200

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 181 | 94414 | 95745 | 962 | MITFDQLKESQKAIFNKVIEMVK QGAKGQHITINGPAGTGKTTLT KFIIDALISQGISGIALAAPTHGA KKVLSKLSGMQASTIHSLLKINP TTYEENVLFEQKKVPDMASIRV LICDEASMYDRKLFKILMATIPA WCIVIAIGDKAQIRPVEPGSSNEP ALSPFFTHKDFLQLHLTEVMRS NAPIIEVATEIRNGGWIRDCVVD GHGVRGFTKGTALKDFMLNYF NLVKTPEDLFENRMLAFTNKSV DKLNEIIRRRIYETERPFVVGEIV VMQEPLTKELKFEGKKFSEILFN NGQFVRILDAIETTSFLGARGVP GEYLVRHWVLDIETYGDDEEYA REKICVISSEEEMNKFQFFLAKT ADTYKNWNKGGKAPWSEFWD AKRKFHKVKALPASTFHKAQGI SIDRSFIYTPCIHMADASLAQQL LYVGTTRGRYDVFYV | 443 | DNA helicase [Enterobacteria phage RB14] | YP_00285435 2.1 | 0,0 (323/442) | DNA helicase | DUF889, PIF1 helicase | pfam05 970 | 5,03e -08 |
| | | | | | | | | | | recD | TIGR01 447 | 4,61e -15 |
| 182 | 95752 | 96006 | 963 | MFELKLEDLQTMIVGLQESKFE APDNVKRAINIKIDIVLNELRDIA DNANAITWFTGYDPKYYLSEYI GCQLREIKFMLEAQNG | 84 | No significant similarity found. | | | | No putative conserved domains have been detected | | |
| 183 | 95999 | 96688 | 964 | MAKDFIIDFETFGNVSSSSVIDL ALITFDSDPEVLESFDELVKRGH RIKFDLKSQKGHRLFGKSTLEW WKKQSAEARANLASTPDDLSVI AGIKEAQQYLIDNGIHPWDSFG WCRGQSFDFPIFVDCLRDVQR AQGISEEEIDTFKEEPCKFWNQ RDIRTAIESLLLTRGLTTTPLPKG TLNGFIAHDSIHDCAKDILMLKY AQRYALGLSEAPSPEDTDPLSL PKGRG | 229 | Exonuclease A [Enterobacteria phage RB32] | YP_802954.1 | 8e-89 (154/225) | exonuclease A | dexA, exonuclease | PHA025 70 | 4,05e -86 |
| 184 | 96688 | 96855 | 965 | MEEFEFDENFEEWFNREILPKI SPTMVLVAKALMAKGWDAGYM FGVDVGCEISHR | 55 | No significant similarity found. | | | | No putative conserved domains have been detected | | |

Fig. 12PP

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name [organism] | Acc No | E value and identity | | Name | Acc No | E value |
| 185 | 96916 | 97359 | 966 | MMKNLVVGENVKVIGGKHIGKE GVIVGIFNRSNKMSSYLLQLEN EDKAVYSLQKFVVALESRDLLD SMFNESYLRKWVHVNSLDNVIT QSVSSTNSATNLSLHKNVLVTD EWEEDGKTLVNVVFQGNYAVL PKADVEPTESQRQGLV | 147 | No significant similarity found. | | | | No putative conserved domains have been detected | | |
| 186 | 97424 | 97639 | 967 | MKTENTVKITAEAFEDILFNPDLI VVQKEKTFGKEEHWTWLYVFA NHGDIVPVRTFARVITVDGPEY MEIV | 71 | Cef modifier of suppressor tRNAs [Enterobacteria phage JS10] | YP_00292235 6.1 | 3e-07 (32/64) | cef modifier of suppressor tRNAs | | | |
| 187 | 97639 | 98004 | 968 | MNFKEGVQYKFVNDEAEEEFS SRYEVNEDFVVELYENGGSFTV TKVDRQNNRVSGIMWANGTEC DEVGGEDLVIFDSEFKYFTEVG TSANVIPTDLVMNLSIHNRGQAI AAIAALQSAYQC | 121 | No significant similarity found. | | | | No putative conserved domains have been detected | | |
| 188 | 97998 | 98333 | 969 | MLNLAPIFEASKLSYPIPNRSIG NVMLQLSSETGEMCDWINRPW RQKEEFEGECADVINCVVDAL WLHFRNRHKNDTHVSDDEISM MVTRALNEQIMVKTQKWKDAV NANV | 111 | Hypothetical protein 44RRORF011c [Aeromonas phage 44RR2.8t] | NP_932366.1 | 3e-10 (37/102) | | No putative conserved domains have been detected | | |
| 189 | 98320 | 98496 | 970 | MPMYDYKCEVCGKKIEIMRKIS HRDYTVNCFNPKCEGQMKRVV SAPAVHYDGLKSGDY | 58 | No significant similarity found. | | | | CxxC_CxxC _SSSS | TIGR02 605 | 5,16e -07 |
| 190 | 98582 | 98830 | 971 | MKKILITLALAFMMIGCTDADNAT RVLENAGFTEVDITGYKFFSCS EDDFQHTGFKAVGPTGKTVKG TVCSGIFLKNSTIRFE | 82 | Hypothetical protein T4Tp006 [Enterobacteria phage T4T] | ADJ39724.1 | 8e-26 (52/81) | | No putative conserved domains have been detected | | |
| 191 | 98913 | 99110 | 972 | MKYIILTLIALVISIGVLVSLADST ESSNEVQKSSIGIVNGQVGVK ISDNLCVNPSTGAAEVCF | 65 | No significant similarity found. | | | | | | |

Fig. 12QQ

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 192 | 99151 | 100989 | 973 | MIKNEIKILSDREHIIKRSGMYIG SSACEAHDRFLFGKFQSVKYVP GIIKLIDEIIDNSVDEAIRTNFKHA NKISVDIKGNKIIVTDNGRGLPQ APVVTPEGETIPGPVAAWTRPR AGGNFGDDAERKTGMNGVG SALTNIFSVSFTGATCDGKNEII VRCSNGSENISWEEHPAKDKE FIKDKTGTVVSFIPDFSHFESTG LTDVDQSIIHDRLMTLAVVYPDI EFKFMGKRVQGKFKAYAQMYD ENAVVQDSDTCAIAIGRSDDGF RQLSYVNNIHTKNGGTHVDLVL DELSNELIPALKRKYKLEVNKAR IKECLTVIMFIRDMSNMRFDSQT KERLTSPWGEIRSHIDIDYKKLA NAIMKSEDIHMPIIEAMLARKLA AEKAAETKAAKKAQKAKVAKHI KANKYGKDADTTLFLTEGDSAI GYLLTTRDRELHGGYPLRGKF MNTWGMSAADAMKNKEVFDIC AITGLTIGEPAENTNYRNIAIMTD ADVDGVGSIFPSLLAFFSNWPE LFEQGRIRFVKTPVIILTKGKEQ RWFYSLGEYEDHKDDFKGWKL RYIKGLGSLEEDEYERVIQDPV YDVVSLPENWKELFELIMGNDA APRKTWMSE | 612 | gp60plus39 DNA topoisomerase subunit [Enterobacteria phage RB51] | YP_002853958.1 | 0.0 (441/612) | DNA topoisomerase subunit | DNA topoisomerase II large subunit | PHA02569 | 0.0 |
| 193 | 101030 | 101182 | 974 | MQRYWITLVSGDYGYMFAEKK PLPGTWVTIWVENSDGSKHEV YGRVSRVH | 50 | No significant similarity found. | | | | No putative conserved domains have been detected |||
| 194 | 101223 | 101471 | 975 | MKSTIISILRTEALKYSVDPSNEY QELLIKRLLNSIADRLESNQSVPI NHSLFAMKVIRFLRPDIKIADMV KVIKSSGAVKC | 82 | No significant similarity found. | | | | No putative conserved domains have been detected |||
| 195 | 101465 | 101674 | 976 | MLKKSYVPNKELFDDAIYREYRI IQRFFDIQAAEEFKDRFKQISDKI FTTNTATAEELLEVAEIIKRHN | 69 | Conserved hypothetical protein [Enterobacteria phage AR1] | BAI83010.1 | 7e-16 (45/65) | | No putative conserved domains have been detected |||

Fig. 12RR

| orf | Start positi on | Stop positi on | SEQ ID NO.: | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| 196 | 10168 5 | 10386 2 | 977 | MKIKCDDEVIIGSSDAEDSTFTIK ASGKAFDILSNKLYKYKVRAVV RELSTNCDDAHKLNGNENRPF YIKAPTRLDPRFVIRDYGPGLNH NDMMTMYKTFFESTKNNSNDFI GALGLGSKSPLSYTSTFNVVSY HNGKATGYTVMKNRGEPTIRP MFVDDMKEDEETGLEITVPVKV EDIDTWHYEIAYILRTFGAVPPK VDSLRREIEYFPVDKTDWFSVN SSYESYGLYAVYGKIVYPISGV DVKADWLLNRYGKVYVHFPLG ELDITPSREELSLDEETIANIQKR VNALEEEVITADIKAFEAYESDR EFLREFNKLSSKERSILQSRGITI GNRDIKQVVAKYNLDKIRSYYV DNEVSVYVSCDEPARRKVSSS SWHRHNQVNISDICGVDRTKAF VLIDDKAGKRIATVRALCKSGLV PIWAHITVIKDNEDELHVIDELKK IMDTDEVVVFRVSELEAQRKAL PDYDTGPKEKRPKSPNVSLHWI DKDGYWEEDRQTLLSSEITELE GYAIGRNRDEIHTFPDNVWWW NMSITDMRSLAEACGIKKFYAIR PSAMKAAAKADGLLSFDRFIIDQ YIKCIDKVDYDQYMPSNATGNR ICGNIAHYDKLNFLSSKFTASGM KNPFLTKLNKIAKVCRTSKIKDE NDENNDLALCNKIYNKLSSDAE TIFYKKIEQFKDDYPVIASVLDT WRTDSKLVDDIVKIMELLDGAS TQNSENKGE | 725 | rIIA protector from prophage-induced early lysis [Enterobacteria phage IME08] | YP_00373415 1.1 | 5e-99 (250/754) | rIIA protector from prophage-induced early lysis | HSP90 family protein | PRK140 83 | 1.11e -03 |

Fig. 12SS

| orf | Start position | Stop position | SEQ ID NO: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| 197 | 103863 | 104774 | 978 | MAVTCLSEIQKDAIVKNFKNGLY TKKELAENYGVSRDTIRRVFKE REARAAAAVPAKVEAPVEREF KWAASSKFISITEGRTTYNADS QHPGFKSALQKLVDGDIAGAID HINLEQGIKKFVQGNVRIEDGTL FYKDIELKSGLTERIVRAMEDGE DFKRYLPFLENLMLNPSRRAVY RLFDFLNANDIDITDDGHFIGWK VVRSNYFDCASNTFDNSPGKT VTMPRNQVDEDDQRTCSTGLH VCSKSYIGHFGSGSDRIVSVKV HPRDVVSIPVDYNDAKMRTCG YVVLEDVTDRWGSELR | 303 | rIIB protector from prophage-induced early lysis [Enterobacteria phage JS98] | YP_001595395.1 | 3e-93 (169/318) | rIIB protector from prophage-induced early lysis | No putative conserved domains have been detected | | |
| 198 | 104817 | 105113 | 979 | MINPFNVSHSKVVNLRGTHHAA TVFCHHVVKHEGDVHYAWILHC DELVELGDDFVVEPDTCNHDD RVYFGELHIRGIYGIDEQSPAEI EPTPDIYPRFE | 98 | RB69ORF272c hypothetical protein [Enterobacteria phage RB69] | NP_861962.1 | 1e-20 (52/96) | | No putative conserved domains have been detected | | |
| 199 | 105046 | 105633 | 980 | MALMNKALQRLNQLRTFTLDLN KLRGEAKVKIIDTARYSLDIDPS QDRIDVLKRCRIAIPAEYVVADF LDGYVNDQVVDHNNNDPYEW AWDVLAHPPHYQGVRVEVKTHF VHDRANHKPWINVTTGKDGPF PDGSGINLGPMFKHKVADCIIF VAEEVSQNVIRYTPMFAGGIEQ LMEVVKPSRVGAGGYIMHKF | 195 | Endonuclease IV [Enterobacteria phage RB14] | YP_002854607.1 | 2e-49 (104/183) | endonuclease IV | No putative conserved domains have been detected | | |
| 200 | 105698 | 105937 | 981 | MSYLELKSLRAKRGNASIKAEL LKEYRILESMNWHYAIIACDNG DSTYGGLYPNGAAAARDEHKD KVKALEEKIRNLCI | 79 | No significant similarity found. | | | | No putative conserved domains have been detected | | |
| 201 | 106126 | 106317 | 982 | MIRSSFDRRFNLMRTVVLSFIVA VALGIVAIFGFGIYFAIQAVDIIQT DGLKSLVETVWEGQK | 64 | No significant similarity found. | | | | No putative conserved domains have been detected | | |
| 202 | 106462 | 106917 | 983 | MRNIMTFADLDNAGAELIGSIRN GDWAAGAPSREITEREGFYFL MFNDGKAGYIGASARFFVAKQ RSKAGFESVLSHIRSGRSQLGR TLRSNCVTYGVFWIPANKMKPL TTGYGKGQLALAFTRQHSSAA QTYSELNRILNDNFIFTLQKY | 151 | Nuclear disruption protein [Enterobacteria phage AR1] | BAI83281.1 | 1e-42 (87/148) | nuclear disruption protein | Phage_T4_N dd | pfam06 591 | 7.83e -46 |

Fig. 12TT

| orf | Start position | Stop position | SEQ ID NO.: | Aminoacidic sequence | Size (aa) | Homologous/similar proteins ||||  Conserved Domains |||
|---|---|---|---|---|---|---|---|---|---|---|---|---|
| | | | | | | Name[organism] | Acc No | E value and identity | Predicted function | Name | Acc No | E value |
| 203 | 107087 | 107230 | 984 | MIKGIAGGIWAALCVSTLTTGETSVISQALAQGTLSILIIAAFSND | 47 | Hypothetical protein EpJS98_gp256 [Enterobacteria phage JS98] | YP_001595385.1 | 5e-05 (24/47) | | No putative conserved domains have been detected | | |
| 204 | 107223 | 107363 | 985 | MIKKILIGAALVAALLLILYYGMIYGMIYIVLFISDVIVQIGSLIW | 46 | Hypothetical protein RB32ORF257c [Enterobacteria phage RB32] | YP_803199.1 | 5e-04 (29/47) | | No putative conserved domains have been detected | | |
| 205 | 107369 | 108757 | 986 | MDIFDTLLKQAGSIDDLAKASNLRHRDLKSIIDNEAKEYAIYTVENRAIPNLIDGFKPVQRFVIARALDLARGNKEKFHKLASVAGGVADLGYHHGETSAQDAGALMANTWNNNYPLLDGQGNFGSRLVQSAAASRYIFCRISDNFRKIYKDTEIAPVHKDKEHVPPAYYLPVIPTVLLNGVRGIATGYSTSILPHSFESVLECTKAALRGEMMEPEVQFPKFNGKIVQTEDGSVELHGVYKETSRNSIYISEIPYKFERASYVEKVLDPLEDAGYITYDDDCSKTGFGFKVKFRKDYALSEDPEQRHAKIMKDFKLIEKMSQYIVVIDENGKLNDKFKTSGELIRHFVEVRKTFTAKRIEHKIAETKQAFNLAQAKAQFIKEVIAGNIVIQGKTRKQLTKEIEQNELFKDHSEKLVSMNIYHITDDEAKKLAQEAKRLAQEVKYWEKTTPEAEYLKDLEEL | 462 | gp52 topoisomerase II medium subunit [Enterobacteria phage IME08] | YP_003734396.1 | 2e-175 (304/462) | topoisomerase II medium subunit | DNA topisomerase II medium subunit | PHA02592 | 0.0 |
| 206 | 108985 | 109248 | 987 | MITSLKSDIKNILYISTQADGTRLSHYVKGNIVVLDEFEVNREYPMRQVIQASNYEDGEEYQVVLCVYDDFWVLKLENGDKFLIFNV | 87 | No significant similarity found. | | | | | | |
| 207 | 109373 | 110017 | 988 | MSKVTYIIKASEDALNEKTAAILVQVAKKDFITSSELREILEETMNASSVNSNIGVLIKKGLIEKSGDGLIITGEAQDIISKAAVIYAEENKPELLKKRNTRKARPLTEDMNEHKDLMMKLLGEMEDILPLKELTVYRSNYIAVLEKRTFGIRSLEVNNKGTFRIFGYKISEEHQKHFTDLGMS | 214 | Activator middle promoter [Enterobacteria phage RB32] | YP_803196.1 | 3e-76 (145/214) | activator middle promoter | MotA_activ | pfam09114 | 3,76e-32 |

Fig. 12UU

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | CRVAATGNTYLDIARTAENIETII RSIKEL | | | | | | | | |
| 208 | 110017 | 110187 | 989 | MELWEIIYEDDVNIRGSIFIKALD KYHAIELFEQLQQQTYINESRYL IKLAMFLVE | 56 | No significant similarity found. | | | | | | |
| 209 | 110187 | 110528 | 990 | MNKFKVLNELQRCVEKVNLNA NIPTDCWDVWFRGHFIGYIDKK FTKCYAIYNADGKHIMDVDNYQ KALAKFVPLAEAVNSMEWLEKI QGEPVIRQIGIREKKSLWQKIKG FFK | 113 | Arn.4 conserved hypothetical protein [Enterobacteria phage JS98] | YP_00159538 0.1 | 3e-13 (43/117) | | No putative conserved domains have been detected | | |
| 210 | 110525 | 110950 | 991 | MSKFSEQMNKFVDASRHGALI NEPEEVSIPEICFKVADWWDGR LLQRRIVCAANRFELKSGGTIVV PGTRHYSVDMANVLDMFRDKL VSDHVHGDNQGFVDQWGEYF TREEALIIATHAGQVNTVRPKSG PANELFSEDLY | 141 | Hypothetical protein EME08_gp240 [Enterobacteria phage IME08] | YP_00373439 1.1 | 1e-36 (73/113) | | No putative conserved domains have been detected | | |
| 211 | 110950 | 111252 | 992 | MISTLKNNITLLKIQRKSLQRSLE MMDDNWGTYTNEAGFKMADS KFMKTLMDKEYICPFSHPFNGG AKPFLAEMYKIMTEEMIKDIDYYI KELECKEDKV | 100 | Hypothetical protein RB32ORF250c [Enterobacteria phage RB32] | YP_803192.1 | 6e-15 (38/80) | | No putative conserved domains have been detected | | |
| 212 | 111249 | 111461 | 993 | VRAISAKADYFNSLNRSEKAQIK RFILELGYVHAGDLKAHIQECGI AKRFDITRNCLNEVIAHVQPSSE E | 70 | Arn.1 conserved hypothetical protein [Enterobacteria phage RB69] | NP_861950.1 | 3e-14 (37/67) | | No putative conserved domains have been detected | | |
| 213 | 111436 | 111561 | 994 | MYNPVAKNDFNKGGAHKDKKR AAKESKRKQKHKGKDNAHSE | 41 | Hypothetical protein RB43ORF288c [Enterobacteria phage RB43] | YP_239264.1 | 7e-05 (24/35) | | No putative conserved domains have been detected | | |
| 214 | 111701 | 111823 | 995 | MVHDWNNGTFTVAIIANVEPEE VLEQFQKCVDAYDIGDYL | 40 | No significant similarity found. | | | | | | |

Fig. 12VV

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 215 | 111820 | 112146 | 996 | MNTETLRREDEAKAYHKRVELL SAIKVEYTLQVRLKVLNSWAND LEVKHLEQAVMFTFTQEASKPF SLSADFHTYGIITIKAKDRGDIIS GVEYIESILGNRGEVVLA | 108 | No significant similarity found. | | | | No putative conserved domains have been detected || |
| 216 | 112143 | 112409 | 997 | MSHNLESVIESQRYLEALMNKI ALGSLIDLSFQEAMDVCHWMN RRVRPIGKEWYLTAKVKDGRY GLWMSSGAEYITTKEDLNSRW ELA | 88 | No significant similarity found. | | | | No putative conserved domains have been detected || |
| 217 | 112477 | 112749 | 998 | MTKFEIVQEIVTVASILTKFNAEH IMEKRDEFIAFLNEIGIKNEQGR QLNQSNFRKMVSELTDEEKRIL VEEYNEGFESIYRTMAMHSNK | 90 | AsiA anti-sigma 70 protein [Enterobacteria phage RB69] | NP_861947.1 | 2e-22 (53/85) | AsiA anti-sigma 70 | AsiA, Anti-sigma factor A transcriptional inhibitor | pfam09010 | 1,02e -19 |
| 218 | 113406 | 112750 | 999 | MASKQSIPFFDMFLGLLELLFKD GATGRVLFSRVFVVILLALLAFA GYKSDSLITAYVDSTYDKYDKL VQKDRDTRFDNTALEQLQIVHI SSGADFSAVFTFRPKNLNYFVD LIAYEGTLPSTVDSKNLGGYPID KTSAEYSTHLSGRYFWTDKEFV FLPTKRKPPEISYMFSCPCYFNL DNVYAGTVEMYWYNSKPALSN ERLTSICGQAVRALGRAK | 218 | t holin lysis mediator [Enterobacteria phage RB69] | NP_861946.1 | 4e-75 (132/217) | holin | Phage_holin_T | pfam11031 | 8,03e -75 |
| 219 | 113974 | 113435 | 1000 | MAVTGPWVGSSAKAETGEPW MAQAGAKLRLGTPFWMSNMIG RSVFNFSLTVQYRNWNNIYYR GSWQVGGWNWSPKPTTKNTV QGNFEGKEVTLFVSVSGQGGV NYWNGDPQGTTLGIRNGDAINL RVMMSDGTTFDFTPGKMDGDV RNYQIASNDEANKLKNWFSDR TDQYWQGLITRR | 179 | gp38 distal long tail fiber assembly catalyst [Enterobacteria phage RB16] | YP_00385856 0.1 | 8e-23 (73/183) | distal long tail fiber assembly catalyst | GP38 | pfam05268 | 8,30e -12 |

Fig. 12WW

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 220 | 118588 | 114011 | 1001 | MADQNLKQIQFKRTSTENKAPG ADIVARGEIVLNTHGRTLAIYTK DEADNVVQLAGKGVPFLDTAG NLNVDGITTLKDNVTISPNKAIN FEATDLSGAIVRHIVGKCATND GWYIGAGGTSNSGILEIGTIDDG AETIQFVQRGSGNVEARKLVLL DGSGNTTLPGDLRLSTNKTVKI NNGSTLVLEMGVGSNDAYIKN QRGVGVLQLTNDSNLTFRNSQ VYYAMNGRGPGKSGTLLTNVE NNRQAWQYVISAATAGTPRWV KVATIKHPGDASSQLDLMITGGI DSGHGRHYVDFITLSGRNLTS WSTSNLDNWVEWRRIGSPNKG NVPEYYVVKNDAATDSEASFDF YAKVPRYGNGLYVTVLNTAEYN GQDSGKVIIYETGQDTGATTPS GSILVSMKQVFDSISKPDFSDTT GTLPVNRGGTGATNVGDARNN LGLRTAAVRDVGESSGNVMEV GAFGIGGNGKSLVDITSDVDLM TRLKALGGTTFRANVASGYTGA PYYSHGAGFFSRTGDTMSALNI DYATGNVRVFAINDSGLASGRV NSNVLYGTANKPSKADVGLGN LTNDTQVKKAGDTMTGDLTVP NLHASGTGTASVYVNAGSGNA HVWFRTGGNERGVIWATPNTA DLGQINIRAKTTGDVSAGDFSF RSDGRLDVPVAVKVGGAAMLT KDGNITSGSMFGGNLNNYLTSI KNDITTGDSKQVSKTGDTMTG NLTINANLKVENPNGSMVDLGS ENSDKYSRLTLARKVGSGAAVA MLKITPEGYVQFGYQDAVATPA PSKYIRVKPDGLDVEGDLVFNQ TYRGTEDAINITDKTNDLNNMVI KGSDLGTRQLYKCVSSGGGSN ISNKPTSDGNFVLEVLSLRKISD SDWTCKQITFTTKNGNVEGTYV RYCQNGTWSAWKEVVAGVQPI NLGGTGATSVAAARNNLGVGE GQSVKFGWLVVNGVGTSDPTI | 1525 | L-shaped tail fiber protein [Klebsiella phage KP15] | YP_003580110.1 | 6e-137 (386/1138) | L-shaped tail fiber protein | No putative conserved domains have been detected | | |

Fig. 12XX

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 221 | 119260 | 118598 | 1002 | MADLKAGSTVGGNPIWHAGTFPLVPAGNSLTYRGKKVYTEIDKPQAADNDFVSKANGGSYSRTVTFETGLRVQTTGSGGMELVNGGVDGATLNGVNAKIKTWWGLGFESNSGSNGITIAFDLRSGNITKGGITSNNQVSVAAAAPTANSHLTRKDYVDELINTVSNVANAAVKKAGDTMTGVLRANAGVVIVNKATSGEYAPRLDQVISRGVTIDFGTY | 220 | Hinge connector of long tail fiber distal connector [Klebsiella phage KP15] | YP_003580109.1 | 1e-59 (120/223) | hinge connector of long tail fiber distal connector | Phage_T4_g p36, phage T4 tail fibre | pfam03903 | 9,26e-51 |

Fig. 12YY

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and Identity | | Name | Acc No | E value |
| 222 | 120454 | 119318 | 1003 | MADPILMAAFGEDFVETRILSEA NSVKYWLKAYATHSNAVPNKP ELNINGAFDMTSSLRRGINVVQ VNGDRFINFKTFDVTTDDNNAN NKAFVEYANGLTSGLYIMTHER FQSSPLIDRWFKNKWSASWPG SDFSKSFPNSAYVGVLGAAKG RILIESFYGNDGKVKEDSRAKV DTVYDNVGDVGYTGCPYRSIE DTNEYSDSTGYEYKRYPVQNE SISKIADYGLSPGDSVFLVCDM YASKSLLDAGSTTRASLRWFKG TSLLSSNVSLEVPKNGADRWLR FERFTAVPTDADGFTIVVSRYP KTSVVGDSKIKNLVFVQTSHGE QLNSVIQEFGVNGIRMNKGVEG GTTMIMELPNSKVDPSGVIPVQ SFRETSD | 378 | gp35 hinge connector of long tail fiber proximal connector [Klebsiella phage KP15] | YP_003580108.1 | 9e-110 (203/371) | hinge connector of long tail fiber proximal connector | No putative conserved domains have been detected | | |

Fig. 12ZZ

| orf | Start position | Stop position | SEQ ID NO.: | Aminoacidic sequence | Size (aa) | Homologous/similar proteins ||| Predicted function | Conserved Domains || E value |
|---|---|---|---|---|---|---|---|---|---|---|---|---|
| | | | | | | Name[organism] | Acc No | E value and identity | | Name | Acc No | |
| 223 | 124299 | 120454 | 1004 | MSDLLKQHFRATNGLDAGGNK VINVALADRNVKTDGVSVEYVI QENTIQKYDPTRGYLTDFAVTY GRRIWIANKDIPKPAGEFNQAN WTSLRVDPNWIYTVRKGEFEIQ SGGFINVDSNAAGNATLLLPLA PDEGDTIVVRDIGGRPGYNGILI KAQDTGASIVFGESRLREVRLT RPYSQIMLTFSNGAWRASLTDF GDTAKMVVPNGIVPTQVQSGD NVVRRYTSNSEIFITLPLFANSN DIINFTDLDGTSPINHMTVRTFD PTISIGTPGQTEIQVRTSGSGFL VYDAIDKIWRIFENDLRTRVRIIT SDVTLMPNEHISVFGADNSTVK TINITLPTDVAVGDTVKIAMNYM RKGQTVVIKASDGDTIASNLNLL QFPKRSEYPPDAAWVQSSSITF NGTTSYVPVLELAYIEDKASGK SYWIVTESDPTVERVDAKDNTT RARLGVIALATQAQANAESNPE KELAITPETLNGRRSTETQTGIA RIATSGEVNQATTASYLDNVIVT PKKLNERSATETRRGLAEIASN AKMDAGTDDFTIVTPKKLLYRT TSDSRLGVIQLVKTGGAPNTTA DRSSAGTGIFDHSDYKNAVTPK TLREYKATVNQSGIVWLASDSE VRNGTPASSNIPTVVTPESLHK KVATDGAIGLIQIATQTEVNAGG VTNKAVTPKTLNDRTATNDRTG IARFATPGAQGEFEAGTSSTVM VNPKLLFDKFANTSRIQVNTSS GLTITGNLWDHYTINIQEASTSQ RGTTTLATAAEVRTGTDAKKIVT AATLHAKTATEGAIGLAQYATQ AQVDAGTLSDRIVPPAYLKQTIQ VTESWQATDSVRGTVRLSTGD GTWKGNDTNGSTLPDNGYASK GVAVSPYELNLTLKHYLPRLGK AYDTGMLGGQTPDKYARRDIA QTISGAWTFSQDTVFNNNISVQ NILYANGGEVKISPTADTGNAH VRFQNRDGTERGIIYAETQTAS | 1281 | gp34 long tail fiber proximal subunit [Klebsiella phage KP15] | YP_003580107.1 | 0,0 8596/1309) | long tail fiber proximal subunit | Long tail fiber, proximal subunit | PHA02584 | 0,0 |

Fig. 12AAA

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | AGNLKVRVKNGTGTTAASQTY TFGGNGTLDVPNEVSTKTLRSS GNTIVGGTVMVKDTVLLTIETQN AIIGARSHSAFIDTRDADTQIFAR DNTNSYPILTTKNYARLADGRY VKKAGDTMTGNLNINSSAIVITG SESWYVPTNDTVLRQGSWTAE IKDATKLKGLRGYMVPIRTPIDP ANPSTLVVTGYEEKTAAGGVLT QVGVTTNNTYQLWTPYPPTE TADKRFAHTVWMRIYNPNLNKF DDWMRVFTSATPPTAADIGAPS SVSTQVKTLEVLEWIKLGPVKI WPDRPNQTLKFEWVGD | | | | | | | | |
| 224 | 12437 5 | 12530 1 | 1005 | MSDLNCLFAEEDQVKEGVILIDL SQIAMATILHTYKEGDKLTTPMV RHLILSTLKFNAFKWKKDGYTKI VICVDNAVNGYWRRDVAYYYK KNRAKAREESNWDWEGYFEG LRTVIDEFKQYMPYYVIDIDKAE ADDSIAVLTKKFSLEGHPVMIVS SDGDFTQLHKYPNVKQWSPM QKKLVKSKTGSPALDCMVKIIK GDKKDNVASIKVRSDFWYTHV DGERTPSTKMTFVEECLDAGE NIKDLLTEEQYKRFLENRVLIDF DYIREDIVANILDCYNNYQLPGR GKIYSYFVKSGLSKLMKEINNF | 308 | RNaseH ribonuclease [Enterobacteria phage T4] | NP_049859.1 | 2e-114 (202/306) | RNaseH ribonuclease | rnh, RnaseH | PHA025 67 | 4.40e -127 |

Fig. 12BBB

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and Identity | | Name | Acc No | E value |
| 225 | 125312 | 125584 | 1006 | MAKKEKEQVVFDEAVHGQALR DMIKEASGNKLKAESYLELNKDI KDRAKKELGVEGKLFNQLLALF HKGTRDRFETEKDEVVEAYDSI FA | 90 | DsbA dsDNA binding protein [Enterobacteria phage IME08] | YP_003734380.1 | 1e-21 (54/86) | dsDNA binding protein | Double-stranded DNA binding protein | PHA02599 | 1.94e-24 |
| 226 | 125565 | 125864 | 1007 | MTLFSLKDEGDTSPSESINQLL DKQANGFAIESMVTELGMGYLE ATTQWLEENSIPEGNFSRYIPP AIIEKIMSEALEENMLRPSFSQT HKTNSLDFLL | 99 | gp33 late promoter transcription accessory protein [Enterobacteria phage RB69] | NP_861938.1 | 5e-25 (54/84) | late promoter transcription accessory protein | No putative conserved domains have been detected |||
| 227 | 125861 | 126523 | 1008 | MIRLRMPQNNNRYYNGKSVYL LYLMLKQHFAGRYDVVKYNWV MRVSDKAYQKRRDKYFFEKLA EKYTLKELTLIFMSNLVANQDA WIGDISDADALIFYREYIGKLKQI KTTFSEDVKNIYYFAKKVNVDKL HDIFEYNEKVGTSYVFKLLQSN VISFETFIMLDSFLDIINTHDTAT DNLVWSNYSTKLKAYKKLLNVD GAEAKKLFISIIKSCKEISI | 220 | gp59 loader of gp41 DNA helicase [Enterobacteria phage JS98] | YP_0015953665.1 | 8e-95 (166/216) | loader of DNA helicase | T4-helicase_N | pfam08993 | 2.06e-36 |
| | | | | | | | | | | T4-helicase_C | pfam08994 | 2.67e-28 |
| 228 | 126591 | 127508 | 1009 | MFKRKNPAQLQQQLAGLKGGS SFSNEDKNEWKLKTDNAGNGQ AVIRFLPGKDENSLPFVKLINHG FKHAGKWYIENCTSTHGDFDS CPVCAHLSKNDSYNSNPAEYKL LKRKTSFWSNILVIKDPANPENE GKVFKFRFGQKIMDKINAMVEV DVDMGETPVDVTCVYEGANFV MKVKKVGGFQNYDECKFLGQS EIANINDEETQKFLTENMADLSE IVAPSQFKSFEVNEAKFKQIMG TAALGGAAAKAAAQADKIGDDL DSFDKDLSDFESKPTSSRSADD IMGDAGDSVGDDDLNDILNDL | 305 | gp32 single-stranded DNA binding protein [Enterobacteria phage JS98] | YP_00159536 4.1 | 9e-104 (202/284) | ssDNA binding protein | Single-stranded DNA binding protein | PHA02550 | 5.68e-109 |
| 229 | 127634 | 127891 | 1010 | MGKLNIDIVAEPYINKSGFCTDLI FEDGSRFYDTDHGIDFDLVIKE GPGGGWPNIDLRGSKEAVRAW LEANEWEDIDLMMEDWKE | 85 | No significant similarity found. | | | | No putative conserved domains have been detected |||

Fig. 12CCC

| orf | Start position | Stop position | SEQ ID NO.: | Aminoacidic sequence | Size (aa) | Homologous/similar proteins ||||| Conserved Domains |||
|---|---|---|---|---|---|---|---|---|---|---|---|---|---|
| | | | | | | Name[organism] | Acc No | E value and identity | | Predicted function | Name | Acc No | E value |
| 230 | 127933 | 128154 | 1011 | MAQVTVEIYDYEHFIETIEKYGLI EVSNKSAPWGGNEITVEGDTP TLWLWLEQEYFPGMDDECRED TLTTFSG | 73 | No significant similarity found. | | | | | No putative conserved domains have been detected | | |
| 231 | 128158 | 128523 | 1012 | MKLNTEYRIIPSLAAEWDLSSS GNRRMRLMIEEHGGSFFPTKM LDEDNSFITEVKFKDGTTADAE GFGDAYFEISDYEFKYFEPVYEI GSAIQPGPTRLDLIVTPENAEE MIDLIKKVFKK | 121 | Frd.2 conserved hypothetical protein [Enterobacteria phage RB69] | NP_861934.1 | 3e-08 (45/130) | | | Bacteriophage FRD2 protein | pfam03197 | 3.59e-11 |
| 232 | 128580 | 128858 | 1013 | MKLQRQSIKLGSEYRGKWNFCI CDKNPEELERVEEVLCQMEAP FTMGGETVYWNDYCDNCPCY EDGYGSGFWIPVEDVEEFKKAF KLAKAKK | 92 | Frd.1 conserved hypothetical protein [Enterobacteria phage RB16] | YP_00385846 3.1 | 4e-25 (53/89) | | | No putative conserved domains have been detected | | |
| 233 | 128937 | 129257 | 1014 | MSKFSVTGYPRVNIRCQFDEIP GVTHIELVFDPHSRCNQVSGKI DSAYGEFLINDQVVVSAISGEQ AGSLYILKREVFEEISEAIKEGFK TLQSMIKASEYKSCGF | 106 | Hypothetical protein RB51ORF237 [Enterobacteria phage RB51] | YP_00285419 0.1 | 6e-06 (39/114) | | | No putative conserved domains have been detected | | |
| 234 | 129340 | 129504 | 1015 | MENFAVDDYDDLIWWDGREW VTICAMSNIDSAIKRLQELQQK WEDGNVERVEFY | 54 | No significant similarity found. | | | | | No putative conserved domains have been detected | | |
| 235 | 129512 | 130111 | 1016 | MIQIVYAFAPTKTVDGKNENAF GLGDGLPWKHISQDMKNFANR TRDTILICCGAKTFMSFPEPLPGR KTIVVQDMSRALATAKNGFFAD AYVSELEFIGFLGGDIMAAHTSY NSTITFNRDLNYSIIGGAGIIQKA YPYADRVIQTIIRKSHRVNSDVT LPAEFVTAPTWPESGFITKENH WYHIDEVTNISEVVYERKL | 199 | Frd dihydrofolate reductase [Enterobacteria phage IME08] | YP_00373437 2.1 | 4e-44 (91/197) | dihydrofolate reductase | | DHFR_1, Dihydrofolate reductase | pfam00186 | 2.29e-14 |
| 236 | 130095 | 130412 | 1017 | MSANYDITQLSEDKVQKRWKR FPFKHGIHLLVFSYNGLSTYNG STTVYNRNGNIPIEIERDYKKMF IGMSHGNVTVNDDVVSIIGRFE KRGDQLFFTPLQEKFNA | 105 | RB32ORF229c hypothetical protein [Enterobacteria phage RB14] | YP_00285456 7.1 | 1e-06 (36/116) | | | No putative conserved domains have been detected | | |

Fig. 12DDD

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 237 | 130405 | 131265 | 1018 | MREYQELIKDIFENGYETDDRT GTGTIAKFGTQHRFDLQEGFPA VTTKRLAWKACIAELIWFMCGS TNVHELRLIQHDSLLEGKTVWD DNYENQAKDMGYSGGELGPVY GKQWRDFMGVDQLKLIIDRIKQ LPYDRRQIVTAWNPVDLDKMAL PPCHLLYQFNVRQGHLDLQWY QRSVDVFLGLPFNIASYAALVHII AKMTNLKPGHLVFTGGNTHYL NHIEQCKEILRREPKELCELEIA FPDTYETWQTSSQIRWLEQFA RPHHFELVGYKSHPTIKGKMAI | 286 | Thymidylate synthetase [Enterobacteria phage RB32] | YP_803170.1 | 3e-134 (217/286) | thymidylate synthetase | thyA, thymidylate synthase | PRK018 27 | 3.21e -96 |
| 238 | 131262 | 131468 | 1019 | MNIRFVRKGHQSKTVLGEMQD AFSSDLPEVNDTIVFDGTEQRV LSVIKSYEWSIGKTQLICWFEVD IT | 68 | No significant similarity found. | | | | No putative conserved domains have been detected | | |
| 239 | 131465 | 131770 | 1020 | MKICRVVNKYHSDFDVNIQRGT MWGNYVGKDCDNRPDAIAAFK DDFIAKIRNGEIKREHLETLRGM RLGCTCKPLPCHGDIIALVVNKL FKDTFELEDLCK | 101 | NrdA.1 conserved hypothetical protein [Enterobacteria phage T4] | NP_049846.1 | 2e-36 (71/99) | | No putative conserved domains have been detected | | |
| 240 | 131761 | 134007 | 1021 | MQVIKSSGVSQEFDMQKIIKVLE WACEGTKVDPYELYEIIKSHLR DGMSTADIQKTIVKVAANSISID EPDYQYVASNAAMFEIRKRVYG QFEPPAFIDHISRCVNANKYDK EILSKWSAEEITLLDSYIKHERD FTMTYAGTMQLIEKYLVKDRHT GELYETPQFAFMLIGMCLHQDD GENRLANVIRFYDAVSTKKISLP TPIMSGVRTPTRQFSSSCVVIEG GDSLNSINEAAASITKYISKRAGI GINAGMIRAEGSKIGFGEVKHT GVIPFWKHFQTAVKSCSQGGV RGGAATLYYPIWHLEVENLLVL KNNIKGVDENRIRHLDYGVQINN LMIERLIKNDYITLFSPDVCLGAL YTEYFRDAQAFRTLYEELEKNP DIRKKRIKARELFELFLTERAGT ARIYPYMVDNVGEYGPFIRDVA TVKQSNLCLEIALPTSDVGQED GEIALCTLAAFVLDNFNWQDQE | 748 | NrdA aerobic NDP reductase, large subunit [Enterobacteria phage JS10] | YP_00292257 1.1 | 0.0 (572/751) | aerobic NDP reductase large subunit | nrdA, ribonucleosid e-diphosphate reductase subunit alpha | PHA025 72 | 0.0 |

Fig. 12EEE

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | EVNEIAEVMVRALDNLLDYQDY PVDKALKAKDRRALGVGITNYA AWLASNFASYADANDITHEMM ERIQYALIKASVKLASEKGPCAL YKETRYGRGELPIDWYNKRIDQ LAAPNYYCDWELLREDLKRYGI RNSTLSALMPCESSSQVSNST NGIEPPRGPVSVKESKEGSFNQ VVPNVEHNASLYDYAWQLAKQ GNKPYLNQVLIMQKFVDQSISA NTYYDPANFPKGKVEMSVMMD DLLYFWYFGGKTLYYHNTRDG SGNDDMIQDSADCAACKL | | | | | | ATP_cone | pfam03 477 | 3.83e -12 |
| 241 | 13400 7 | 13464 8 | 1022 | MNYQNVYNSLISRARARESLLG YKETHHIIPRCIGGSDDKENLVE LTGREHFIAHWLLCKIYEAPGLK KAFGLMCLTGKNRSYKVSSQL YELGKRRLSEAATGRKASIETR EKISKSLKGREFTEEHLANMRK PKTEETKKNIAAAKVGVLNPMY GKISPTRDVPHTKETRDVISLRT KQGTEYPPCPHCGKKVNKGNA | 213 | Putative homing endonuclease [Enterobacteria phage LZ7] | ABA03236.1 | 4e-113 (193/213) | homing endonuclease | HNHc, HNH nucleases | cd00085 | 2.82e -04 |

Fig. 12FFF

| orf | Start position | Stop position | SEQ ID NO.: | Aminoacidic sequence | Size (aa) | Homologous/similar proteins ||| Predicted function | Conserved Domains ||
|---|---|---|---|---|---|---|---|---|---|---|---|
| | | | | | | Name[organism] | Acc No | E value and identity | | Name | Acc No | E value |
| | | | | LRWHYDKCKFKDPK | | | | | | | | |
| 242 | 134645 | 135787 | 1023 | MSTVFNKEPVDIMNEPMFLGS GLGIARYDVQRHKVFEELIEKSL SFFWRPEEVNVMMDRGQFEKL PEHQRNIFTDNLKYQSLLDSIQ GRAPAAVLSALISDPSLDTWNQ TWTFSETIHSRSYTHIMRNLYV DPAKIFDEIVLDEAIMKRAESIGV YYDDVIAKTRAWENAKNRCFN QDNIEIKEAKRDLMKSLYLCLHV INALEAIRFYVSFACTFNFHKNM EIMEGNAKIMKFIARDEQLHLKG TQYILRQLQTGTDGEEWVEIAK ECEQEAIEIFMEVNRQEKDWAI HLFRNGGLPGLNVKILHDFIDYL TVSRMRSCGLPCPITDAPTRHP IPWIREYLNSDAVQSAPQEVEIS SYLVAQIDNDVTDDVLIGFKRYL | 380 | NrdB aerobic NDP reductase, small subunit [Enterobacteria phage T4] | NP_049841.1 | 0.0 (306/388) | aerobic NDP reductase small subunit | nrdB, ribonucleotid e-diphosphate reductase subunit beta | PRK09101 | 3,79e-147 |
| 243 | 135815 | 136231 | 1024 | MNDIANEFSFIKYVQLELEPDFS IKPVLVANKLNVVYAIAVDDELV YIGKTKNLRKKRINYYRTAINRKD QTSDSAKSAKIFEALMAGKKVE FYARQCFNLLINNELGEMSIST MDLEEPMFIKKFNPPWNTQHK VKKC | 138 | DenA endonuclease II [Enterobacteria phage JS98] | YP_001593535.1 | 1e-58 (108/137) | endonucleas e II | denA, endonucleas e II | PHA02598 | 3,38e-49 |

Fig. 12GGG

| orf | Start position | Stop position | SEQ ID NO.: | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| 244 | 136225 | 137376 | 1025 | MLELYKNLMNLCESSEVAKFFY KDFTGPMDGKFRVFSYHYASY SEWLKPDALECRGIMFEMDGD TPIRIASRPMEKFFNLNENPLTM GIDISDVEYIMDKADGSLVSSYV DDGYLYLKSKTSLYSDQARQAS ALLNSEEYSSLHQVILEALDGY TVNMEFVSPNNRVVLAYQEPQ LFVLNVRNNTTGEYIKYDDLYA NAKIRPYLINAYGISDPTTWVEG VRELEGVEGYIAVLNTGQRFKV KTEWYSALHHTKDSITSNERLF ASVVSANSDDLRSLFAGDEYTI KKISAFEQAYLDYLGKSLELCQ SFYDEYRGRARKDYAIAAQKAT VNQRHLFGVIMNMYEGTVDVD KLLKDLERVFLKYWAGYVPKEY EKEIEISEE | 383 | RNA ligase A [Enterobacteria phage RB69] | NP_861926.1 | 8e-109 (188/376) | RNA ligase A | rnlA, RNA ligase A | PHA02589 | 6,98e -147 |
| 245 | 137439 | 137948 | 1026 | MDMQAITLDMVVNKYGTHSDGI FVWNGTKKVGFVTDLRTHMAR KEAARKKQKEYTNRVNEQRAE ALPEAVDEMIDFLDNHHLAKYGA EVFKNITQPNVHANGCKCYVIV DPIYGKHRLGIMHRELNYSEMA EYVEACFKCSPSESSDRHLIISG LSRDDIVEVILKLCSK | 169 | Inhibitor of host transcription [Enterobacteria phage T4T] | ADT39948.1 | 2e-46 (94/167) | inhibitor of host transcription | | No putative conserved domains have been detected ||
| 246 | 137936 | 138289 | 1027 | MLKINTTWLLIGVLALSAGGLKY LSWRVENLKADLKVVQDESDR QAKEIENIGVSIKNLQTTYKGYQ ENRAARDTSNAKMNKDSKRGN VVAAKPGLVEKQINASFNKFAE DIQEATR | 117 | PseT.3 conserved hypothetical predicted membrane protein [Enterobacteria phage RB69] | NP_861924.1 | 1e-12 (47/119) | | Hypothetical protein | PHA02141 | 3,41e -03 |
| 247 | 138286 | 138573 | 1028 | MKRSLLAMCIISLLAGCSSSAPD VPVLHPEWPDPIQKWEGHWEV KVIDGKAWVGMPFEESQEYRI WMNDILRYTKDANGMICYYRSE LKEPRCVK | 95 | PseT.2 conserved hypothetical protein [Enterobacteria phage JS10] | YP_002922565.1 | 4e-24 (53/95) | | OM_YfiO | TIGR03302 | 6,31e -03 |

Fig. 12HHH

| orf | Start position | Stop position | SEQ ID NO.: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| 248 | 138595 | 139080 | 1029 | MEPSHFYSYFVKDASHLLSIKN TQLRNMLAVGSCQLTPLAKKAT VIPENISNGYVYTVRVSVPGALK ERLFELNDQTRISFDVWFKLFM VEFMYPDFLKFVQRKEALKEAI SELEDASIEFGKALQFVESGGV EQDAVNGFLKKYGKRRSLAHR NLSKMVM | 161 | No significant similarity found. | | | | No putative conserved domains have been detected | | |
| 249 | 139080 | 139292 | 1030 | VNQEQYETLKGLIAENELACIVF GRAAENYDKNDILSMNKPLRAI KEKYRANWGEKSKALHDFIDTL KDV | 70 | PseT.1 conserved hypothetical protein [Enterobacteria phage T4] | NP_049835.1 | 2e-05 (26/71) | | No putative conserved domains have been detected | | |
| 250 | 139292 | 140185 | 1031 | MKKLVLTQGAPGSGKTTWANE YVAANPGWYVLSRDDLREGIF GLDKRNDYKYSKLREKSVSVC QFSMAKTLLEMETTKGVIIADTN LNPTTIKKWQELAYEIDGVKWEI KRFDVPWTELVKRNLYRGANA VPIEVLRSFEYSKMHPYDLYIPDE SLPKAVIFDLDGTLADNNHRSP YDLAKCCGKDHPKEMVIEFLKML RNKGYKILTVSGRESGTKEDPT VYQRITKKWLLDHVGETGEHFQ RKQGDSRKDDVVKEEIFWDRIA DRYNVKLAVDDRAQVVEMWR RIGVECWQVAHGDF | 297 | Polynucleotide 5'-kinase and 3'-phosphatase [Enterobacteria phage AR1] | BAI83237.1 | 4e-92 (175/301) | polynucleotide 5'-kinase and 3'-phosphatase | HAD_like, Haloacid dehalogenase-like hydrolases | cd01427 | 3,38e-08 |
| | | | | | | | | | | pseT,poly-nucleotide kinase | PHA02530 | 2,64e-105 |
| 251 | 140197 | 140481 | 1032 | MFPKYSEVVKVSFTQVVANHLT DEFTPAEVAKMHAEFLSAMNAL IPNGEVVKFSIDRLGGSSEIKISC GEGEHDWFIVGIIANFETQQVE TYVV | 94 | Cd.3 conserved hypothetical protein [Enterobacteria phage RB69] | NP_861916.1 | 2e-06 (34/90) | | No putative conserved domains have been detected | | |
| 252 | 140471 | 140707 | 1033 | MLSDAKFSHDEFISKVKIFAQEV ANRVPGSKVTLRRESSFNYVD AYIITVNNGKSNQHTQLALTGT | 78 | No significant similarity found. | | | | No putative conserved domains have been detected | | |

Fig. 12III

| orf | Start position | Stop position | SEQ ID NO.: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | GQVEMTNILGHI | | | | | | | | |
| 253 | 140707 | 141051 | 1034 | MTLREAVEALLIEHARGIKAEIS PNGIRLISAVIGSDQGWSIPRE EYDAILYSNVNVKEGQPMYGYV FSDSLERGNHPFPDGTGIRTSR VESFASPTDELKLVKTNNTTYL VI | 114 | No significant similarity found. | | | | No putative conserved domains have been detected | | |
| 254 | 141052 | 141621 | 1035 | MKASTVLQIAYLVSQESKCCSW KVGAVIEKNGRIISTGYNGSPSG GVNCCDHAAEQGWIGEIPYKST GLRQDGFQVKKVGLLKEHRAA HSAWSKVNEIHAELNAILFAAR NGSSIDGATMYVTLSPCPDCAK AIAQSGIKKLVYCETYDKNEPG WDDILRSAGIEVFNVPKRNLDK LNWYNIKEFCGIE | 189 | dCMP deaminase [Enterobacteria phage RB32] | YP_803153.1 | 7e-83 (155/193) | dCMP deaminase | cd, deoxycytidyl ate deaminase | PHA025 88 | 1,13e-81 |
| 255 | 141621 | 141821 | 1036 | MKLRIVEINKLNLSGDVVISYSV ERRYWFKWKPLATFKFEDQAV RLLKELSKRKSVIIKTIKETSK | 66 | gp5 [Enterobacteria phage N4] | YP_950483.1 | 3e-06 (29/63) | | No putative conserved domains have been detected | | |
| 256 | 141818 | 142126 | 1037 | MKLTTEQNIHIRETLKAVLSMGE SQIVFEKADGTIRTLRCTRDKDII PSDLVESTTKSARAESTTSLPV YDTEKEGWRSFAFDKLISVNG MKVEHLLQMIGK | 102 | gp31.1 hypothetical protein [Enterobacteria phage RB14] | YP_002854545.1 | 2e-29 (65/102) | | DUF2693 | pfam10 902 | 2,25e-22 |
| 257 | 142184 | 142507 | 1038 | MELPIKALGEYVILVSEPAQQG DEIVSPSGIILGKEEQGQLPDMC EIYSIGDDVPKGFVEVGDLTPLP VGNIRNVPHPLVAAGVKKPKEI RQKFVTCHYKSLACVYK | 107 | gp31 head assembly cochaperone with GroEL [Enterobacteria phage IME08] | YP_003734352.1 | 3e-40 (78/107) | head assembly cochaperone with GroEL | Cpn10 | pfam00 166 | 2,77e-03 |
| 258 | 142623 | 142871 | 1039 | MNKQLTKALELQRNAWNSGHE NYGASIDIYAEALEVLKGFKHLN PAQAEFRDTLEAMDELKYAKHL GSAARKAVRHFVVTLK | 82 | rIII lysis inhibition accessory protein rapidlysis phenotype [Enterobacteria phage IME08] | YP_003734351.1 | 6e-29 (63/82) | lysis inhibition accessory protein | No putative conserved domains have been detected | | |
| 259 | 143224 | 143415 | 1040 | MEDDKMAKQAKAKTAVKEVVG TSKRAGYKRGSNKRINQTVEKI MRRARAVLRDDASRFGKPKA | 63 | Uncharacterized 11.1 kDa protein in Gp30-rIII intergenic region | PI7310.1 | 1e-14 (41/44) | | No putative conserved domains have been detected | | |

Fig. 12JJJ

| orf | Start position | Stop position | SEQ ID NO.: | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| 260 | 143537 | 143896 | 1041 | MNFTNFNRKYVQNNAWDVSTT LLWEHNNGTVAQIDMYWEDNY VFFSFENGPTLDIQFNGSEIKVG FHDEVRKRDLSSHPSWNTNRQ LLVKIYLRHILGRKTTEEQREAI WDIVSNEIKF | 119 | gp30.7 conserved hypothetical protein [Enterobacteria phage T4] | NP_049821.1 | 3e-26 (58/118) | | Phage_T4_Gp30_7 | pfam06919 | 2,72e-27 |
| 261 | 143936 | 144418 | 1042 | MEKGKFYKLKKTPSLSPGALIK GVFEQIGNNPIKTRTFKYAENT GLVEFEIIKPDGEYKRVSIDEVR FSRMWCIITNQEFQHYFEETTH KEPEPKTDDGSNDWGWVTSN KGNDTYKGGLTKEEAVNLAKV QRLNATKDTKVVIMQPFAVPVV HVNIRPF | 160 | No significant similarity found. | | | | No putative conserved domains have been detected | | |
| 262 | 144431 | 144709 | 1043 | MIVSAFYDSRKKVETIISDTRD GTPANKNGVKAYIDKYCPPEFR MIDGVDSLSINIINAKIEFINETVP IGYSDGDGSNAKMPKEKFITKF | 92 | Hypothetical protein EME08_gp196 [Enterobacteria phage IME08] | YP_003734347.1 | 7e-05 (24/66) | | No putative conserved domains have been detected | | |
| 263 | 144720 | 144890 | 1044 | MIVSVPKSKDGIFSCGLKNHPM VDIMSANVKQHTVEYEIDAPDF FELPEWAVRLDA | 56 | No significant similarity found. | | | | No putative conserved domains have been detected | | |
| 264 | 144887 | 145087 | 1045 | MKYHIFNTVRLANGIPGVVCDT APAIKAYSEVPWYEVNWVDGN RSIHAESELYPITQLRAANDVY | 66 | No significant similarity found. | | | | No putative conserved domains have been detected | | |
| 265 | 145077 | 145286 | 1046 | MSINPHFGHMVARRITREMLKT AEYNIELIDIEPSDAPGLIWFNF TGAANSVAKFKQALRNFPECQ NQ | 69 | No significant similarity found. | | | | No putative conserved domains have been detected | | |
| 266 | 145271 | 146113 | 1047 | MSKPVIATDVDGIIVKWQSGLP YFAQKYNLPVEHILDMMTTEKFI KPAELFDCEEDLAVKLLLKYNN SDFIRYLAPYADALATVNKLKEK YDFVAITALGNSVDANLNRRFN LNALFPDAFTEIMVCDYDESKD ALLEKAKVKYGDRIVCYVDDLP KHIAAASKVFEDTETRVFYMPR GEREGSVTAPGIMVEDWHQIVT CLESLESVKKPQKSLSRLWEEA IKDQIRKEQHPFNWPPRQVPG DWWKQPIIPFSPSPHVPPGND WVNNGRITCDNHQINC | 280 | gp30.2 protein [Bacteriophage Ox2] | CAG29240.1 | 5e-62 (132/267) | | 30.2 hypothetical protein | PHA02597 | 8,07e-59 |

Fig. 12KKK

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 267 | 146155 | 146361 | 1048 | MFVVHTKVGKRWLSCDYGHVN QFYRWNPIWREAKACPIWNECI NNGFVYIDGLTYHRSVSELSKE LGE | 68 | gp30.1 conserved hypothetical protein [Enterobacteria phage T4] | NP_049814.1 | 2e-08 (34/75) | | DUF3045 | pfam11243 | 3,18e -12 |
| 268 | 146361 | 147833 | 1049 | MIFDIIKAIEDAKGSKAKTQILIDN KDNVDLKRAYLLAYSGRFKFFIK KVPEYTPVKYPNVPSKTFSDGL DYLQDILAARVLTGNMAIQGLV DLLSKMNEGDASVLVRVLLKDM RCGASGSIANKVWKKLIPEMPQ MLASAYSEKALSYIKFPAFAQLK ADGARCFAEIRGDDLDDVTLLT RSGNEYLGLDKLKRQLIEMTKE ARERHPNGVMIDGELVYHVEV KEEENDLFDMFKEPELPELSKA KEFQQTARTESNGLANKAIKGTI SAEEAEGMRFQVWDYVPLDVV YSEGKVPGFAYDVRFRALEMM SKGYDKIILIENHVVHNIHEARAI YKTYVDQGLEGIILKNIGAYWED KRSKNLVKFKEVITVDLKCVGS YEHRKQPGKMGGLMFVSECG RIRVNAGSGLKDKPEELHELDR THLWKIRDSLPGTIWELECNGW VTAEGRDDGTVGLFLPIIKQRR YDKEVANTFEAAFGVNFTEATG IK | 490 | gp30 DNA ligase [Enterobacteria phage T4] | NP_049813.1 | 1e-147 (287/503) | DNA ligase | DNA ligase | PHA02587 | 8,32e -169 |
| 269 | 147830 | 148009 | 1050 | MKVLYEVIAKTDDGRGGISVHT EVLDFDNIDVFKNFKENIEEYES VNGLQVWRTATIIN | 59 | No significant similarity found. | | | | No putative conserved domains have been detected || |

Fig. 12LLL

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 270 | 148062 | 150188 | 1051 | MELLNEVFDEENSKIYPVENVK PKLKVPQVFLIKVPGNNNLMIRL VHGSGQGDAVKNIKMGDKFIQ VYVFSVSEKGNIGALKGGLGQD PIGAINTIFETVNKVVKQIKADAV MFRFNPKKMQGQDKAIQRILAR LITTRTGGRFNLMKDMAYYKGK YAYSIMVHKGKKLEEIEGIPEISD ELYTKVESKVGEIYVSKETGES VTKAEALANSIGEKEDKKSELA VMSKMKVSRKDLIRAQYGKFVS YVDEDWPENKRERWYELTTNT PVLNAEGDTVDLQKDIKAGLEK SIPFYVDDIKHYRVRGGYGSNF GDAVERLFVGQMSRMHDDWK VFIPSGSDKMKIAEQRISDVADV IAQAKNPASMETMRKIVEVATR GFDMPPADDFGALRQYQNLVN YMISAYVSIVGDSISKAIEYNRE MQSRLSEEERDAIHHYCGSGY SFVNNYLIGMESLGDPIIDKKIRP LDSAFEKGLRLEPGTLLYRGQR GKYEDFKDNIESKMFYFQNVYS TSLSPIIFGAYSNAGDSLMPDAP SSDLENKETTANAVSSVIGTDN LERVDRGEEVAYGDEFKFGFVI HGADKVKVVIPGVLSSFSDEAE VILPRGLAMKVNKVWGTPFRN GVGVANNKTFMVEMTVVPPEQ IDESVHLYDGDILMEQGKVEPL EESKFKGFLNEIYFSPDRSTDK VSYTRTMELLAGAINLDGIPEKL A | 708 | Alt RNA polymerase ADP-ribosylase [Enterobacteria phage JS10] | YP_002922542.1 | 4e-115 (261/745) | RNA polymerase ADP-ribosylase | alt, ADP-ribosyl-transferase | PHA02566 | 1,89e-145 |
| 271 | 150252 | 150530 | 1052 | MKHVFRFNGIEWSADVKDAEK FNEEVLIMLEGFNEGTPTVLIQD IFRKPTEPSFVEAVLNGKAEGII PVKVWTTKEMKLLRTEPGFIG CIA | 92 | No significant similarity found. | | | | No putative conserved domains have been detected | | |

Fig. 12MMM

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 272 | 151478 | 150552 | 1053 | MFTLEEFKSQAADIDFQRTNMF SVVFATVPSSKTQALLNDFGGE LYNNMGLDGNWLGLTPGEFNQ GITTIVTQGTRQVVRKSGVNTF MIGAMTQRVVQSLLGEFTVGTY LLDFFNMAFPTAGLMVYSAKIP ENRLSYEMDKFHNAPNIKITGR DMEPLVLSFRMDPEASNYRAM QDWVNAVEDPVTGLRGLPQDV ECDIQVNLHARNGLPHTVCLFS GAMPVACGAPEFTYDGENTIAV FDVTFAYRSMQTGSVGKQAAM DWLEDKTIQKIETINPNQGLSTS ASRLSRLGGAGGGISNITTSTS RII | 308 | gp54 baseplate tail tube initiator [Enterobacteria phage JS98] | YP_001595320.1 | 1e-117 (190/303) | baseplate tail tube initiator | 54,baseplate subunit | PHA02605 | 4,28e-126 |
| 273 | 152530 | 151478 | 1054 | MIFEELADGLENIKKSGTRISQG KSKLTNAPTTKVAQFPAERSAG NDSAQDMRVHDLYRNGLLFTA YDFKGRTTPDLRSFRRDVMLS SVFDSPMSALANSSSSTTSTAP VANILLPRSKSDVDSVSHKFND VGDSLVTRGSGTATGVLSNVA STAVFGSIESLTQGLMADNGEQ IYNTARSMYAGPDNRTKVFTW DLTPRSADDLIQIIRIYEIFNYYSY GVTGNSSYAKEVKAAIDEWYK GTLKSAAPDGAKVENTVFEQIT SFLSNVIVVSNPTIWTVRNFGYS TSMDGREDIFGPCQIQSIRFDK TPNGHFNGLAIAPNLPSTFTLEI TMREILTLNRGNVYIGGIE | 350 | gp48 baseplate tail tube cap [Enterobacteria phage JS98] | YP_001595319.1 | 2e-126 (225/363) | baseplate tail tube cap | Baseplate subunit | PHA02613 | 2,88e-137 |

Fig. 12NNN

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 274 | 154273 | 152540 | 1055 | MTKKSEMNSMRRVIADSAPQ KKAESOADAQINTLEDIGRRLD DQQASTDLISDVIETKSNEIIKSV EDVSAGVELTAEASERTTDAVS KLNDTASLINDKLTKLADLLSKK HDVQQDVQKTGTGTSLETITEQ VPDAPVQQPLEELLERLIPPQD DRRPDADFFPNTEEQEERKEP NKETEDKNKKFLGLKFGELIKSV KSGFGKTISLTDKISSMLFSYTV SALAQMAKTAAMVLGVIMLIDLI KVHFNYWTKLFEKNFVEFNKQ AKEWGPLLTAISEMSNEIVKSFV KGDWGGLAKAIGSGLVDVIDKL GETIMLGMSKLLAGMLRALGFN DSADNIEGAALDRFQTVTGAEL DEEDAKMRAKYVDRQEREYDE QPEWKRKLSAKFQKFTGQIDD DEYNKLLSGEKKQSAYADLPED ERLKIITARNNAEAELKRTKAYV EKTDASDSTRLDSAKDAVQSTT TRYKELEKLSPEVAKDLKVELD QLQKLLDSKISEPAPTAEAIPAT EQPEVKQSASIKAAADSREAAR TRESNTQSQPIQVNTAVNKNST YVYRTPPQTSTAAPGMQGAMK TS | 577 | gp29 baseplate hub subunit, tail length determinator [Enterobacteria phage RB69] | NP_861896.1 | 2e-77 (225/613) | baseplate hub subunit, tail length determinator | BAR_Vps5p | cd07627 | 8.94e-03 |
| 275 | 154797 | 154270 | 1056 | MNLNVILPIKKIVINEKTISIPKLG LKHHNLMKDVKGPDENMNLLL DSICPGLTAAESDIVVLHLLAFN NRIKETVVKDDFTYDLNKVYICQ RLTQRLDGKEFKFRAPPRYSKL GSVDSILSEFLESVDGKPMDINF MKLPAFVTKWADDLVNTIAIDG PEGPIKGMLNVMEIFE | 175 | Base plate distal hub subunit [Enterobacteria phage RB32] | YP_803131.1 | 2e-48 (93/177) | base plate distal hub subunit | Phage_hub_GP28 | pfam11110 | 3.47e-53 |

Fig. 12000

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 276 | 155911 | 154769 | 1057 | MTAQRLGYPNISIKLYSGYDAW LANRFVELAATFITLTMRDSLRG TNEGLLQFYDSKNMHTRMNGD ELVQISVANSNTSRTQTRIYGIK HFTVGVDDKGDSIITLQLGTLHD IMNLKFSRAFFSSAYETIKEMIG AMYVDQPLIAPPINGINAYVPRV PWTSTLKDYLRYVRNVGISTDN DQFIFAWEDITGINMMDYESMIS QNPNVFMFGAPQTIGQFAAGL KYPLAWDFEWLVKSNRYNRNP MKNATFYAHSFVDKDVTRIING EGQNSVFINRSGGYSDMIFRNG YEEALRISTMAQYDGYAQTKCY GNFELTPGMKINFVDLKDQFRT DFYVDEVIHEISNNTSITNLYMF TNGSALEPVDLIKVKNELKRDS SY | 380 | gp27 baseplate hub subunit [Enterobacteria phage IME08] | YP_003734332.1 | 1e-145 (236/377) | baseplate hub subunit | baseplate hub subunit | PHA02612 | 1,76e-159 |
| 277 | 156666 | 155908 | 1058 | MANIVRCELPDGVQRFKPFTVE DYRDLLLVRNDMNTKSEEEQK QLIAELMDDYFHDHPAEYRPYIF LKVFLSSIGKTKIPVRMKCPKCG KYKQYLFNLNQPPLVNPKVEVA GLTLKFKFKPIEIIDDTGKMILDNII SVKDSSGEYAWNELSDSNKLT VIDAIDVETLEKILSQMKPFNFEL KTSCCDTTTILKYDNIVDIFKLLL HPDEIFTFYQINHRLVSQGKYDL NSIMKMLPIERGITLSLIEKDLKS | 252 | gp51 baseplate hub assembly catalyst [Enterobacteria phage IME08] | YP_002922535.1 | 3e-81 (145/251) | baseplate hub assembly catalyst | Baseplate hub assembly protein | PHA02611 | 7,69e-87 |
| 278 | 156718 | 157347 | 1059 | MNITYKFETRINGKNIQCRAFTL EEYANLIAAKKNGTIDECIKALLR ECTNATELNKQESELLIVILWAH SIGEVNHEVTWNCTCGRKIPVP LNYTHAQIDPPEDLWYDLKGFK IKFKYPSLFDDSDIPMMSKCIDY IVVGNEQIYFNDLNDAEIDDLYS AIITTEDVVNIKNMLLKPQVQLAV PITCECGISHIHVIKGLKEFFKIM S | 209 | gp26 baseplate hub subunit [Enterobacteria phage JS10] | YP_002922534.1 | 4e-54 (103/207) | baseplate hub subunit | T4_baseplate | pfam12322 | 5,28e-51 |

Fig. 12PPP

| orf | Start position | Stop position | SEQ ID NO.: | Aminoacidic sequence | Size (aa) | Homologous/similar proteins ||| | Predicted function | Conserved Domains |||
|---|---|---|---|---|---|---|---|---|---|---|---|---|
| | | | | | | Name[organism] | Acc No | E value and identity | | Name | Acc No | E value |
| 279 | 157344 | 157754 | 1060 | MSNIDKLYSDLDPEMRLAWDT DVSKTVGARSVKNSLLGITTRK GSRPFDPAFGCDITNELFENMT PLTGDTIKRNIVSAVRNYEPRIN RLSVDVLPLYDDNAIIVTVQFSIV DDPDTLERIRIQMRSNANSSSR V | 136 | gp25 baseplate wedge subunit [Enterobacteria phage JS98] | YP_00159531 3.1 | 2e-52 (98/128) | baseplate wedge subunit | Baseplate wedge subunit | PHA004 15 | 3,87e -46 |
| 280 | 157796 | 158212 | 1061 | MRLEELQDELDNDLIIDQTKLQY EAANNPVLYGKWVRKHSTCRK EMLRLDALKKQNLKARLDYYTG RGEVGGEVCMDVYEKSEMKTV LSADKEILGVDTKLQYWGILLEF CSDAMDAIKSRGFSIKHIIDLRQ FEAGA | 138 | UvsY recombination, repair and ssDNA binding protein [Enterobacteria phage T4] | NP_049799.2 | 6e-51 (99/137) | recombination, repair and ssDNA binding protein | UvsY | pfam11 056 | 4,75e -42 |
| 281 | 158243 | 158410 | 1062 | MSNTVCVVCKGPIDEALVVQTD KGPVHPGACYNYAIELPVTEDT EEQLQETQLLI | 55 | UvsY.-2 conserved hypothetical protein [Enterobacteria phage T4] | NP_049797.1 | 1e-16 (41/55) | | uvsY.-2, hypothetical protein | PHA026 10 | 3,92e -10 |
| 282 | 158712 | 158470 | 1063 | MIKFEDIYEATIREATIDNFMSKI NACQTLDGLKELEKYYDKRSKE TTLADSDDIIVRDALAGRRQALE ADSEDDEDEDF | 80 | UvsW RNA-DNA and DNA-DNA helicase, ATPase [Enterobacteria phage T4] | NP_049796.1 | 2e-15 (44/73) | RNA-DNA and DNA-DNA helicase, ATPase | uvsW.1 | PHA026 09 | 7,25e -18 |

Fig. 12QQQ

| orf | Start position | Stop position | SEQ ID NO.: | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 283 | 160211 | 158709 | 1064 | VHDIQVKFKDFSHVHIECDDSIF YELRDYFSFEADGYRFNPKYRY GHWDGRIRLLDYNRLLPFGLVG QIRKFADOFGYKVYFDPAIFEQ ETLSREDFDNWLSTKEIYSGLT KIEPHWYQKDAVYEGLVNRRRI LNLPTSAGKSLIQALLARYYVEN YEGKVLIIVPTTALVDQMIDDFC DYRLFPRNAMLGIRGGTARDS NALVYVSTWQTAVKQPKEWFS QFGMMMNDECHLATGKSISTII AGLTNCMFKYGLLSGSLKDGKA NIMQYVGMFGEIFRPVSTSKLM EDGQVTELKINTIFLRYPDAAAN ALKGKTYQEEIKFITNVKKRNR WIANLATKLAARDENAFVMFKH VAHGKELFEMIKAAGHEHVYYV SGEVNTETRNALKAMAENGKGI IIVASYGVFSTGISVKNLHHVILA HPVKSKIIVLQTIGRVLRKHKDK SLATVWDIIDDLGVKPKSANAK KKYTHLNYCLKHALERIQRYAD EKFNYVMKTVNL | 500 | UvsW RNA-DNA and DNA-DNA helicase, ATPase [Enterobacteria phage JS10] | YP_002922529.1 | 0.0 (392/497) | RNA-DNA and DNA-DNA helicase, ATPase | UvsW helicase | PHA02558 | 0.0 |
| 284 | 160269 | 161063 | 1065 | MLDKDYIKEIQALDKKEAKDKLD EYAQTFGIKLKKTRSFDNMVAD LEKELAKLANEPMPEDNDGLSI ADLIQADDEIEGKAVFKDEASD EAKLLFDAPVNVGIKIHDIDPGF YKETPKVNDPGFEVKTPSINDK GFYAEAPIGDSVIHIDDEGQVTN IPVSITDPEEFSKAMDKVVKIIKT DEIIELPENFSPNMQLLGKNPG YITLPWWIYQWIKDNPDWKSRP TSFEHPSAHQTLFSLIYYIKRNG SVMIRETRNSSFVTLK | 264 | Minor capsid protein inhibitor of 21 protease [Enterobacteria phage RB51] | YP_0028541 36.1 | 2e-64 (144/265) | minor capsid protein | No putative conserved domains have been detected |||

Fig. 12RRR

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 285 | 161073 | 162482 | 1066 | MAYSVSIAPLAASAVIGATTNFT ATTSGAAAEGTETFVWTVNGV KQSSVTAAMNYVTAGPAGSKT VKVVATVTPAEGEVETAEAETT LTVKNKTMPAITLTLSPTSVSKEI GQSQVVTADVTGAPSGASIAYV WKRGSSVISGQTGKTITLTEST ETSYTLNCEVTVSAPDYNNGTA TKGIAVAFTKKTMSGVSVTLSP TSVSKEIGQSQVVTANVVGAPE GASIAYVWKRGTVVIEGQTAKTI TITESAEANYTLNCEATVSAPDY NPVTVSKGASVTITKKTMSGVS VTLTPESITVEQGSDASFKADVI GSPEGASGTYSWTKDGSPVEG STSTLVIDTSDIGSQVIGVSVEV SAEDYNSVTVTTTGNVTITKRV APTPNGELPYIHPLPFRETAYIW CGWWVMDEIQRMTVEGKDWK LDDPDSDYYLHRYTLAKMLDDY PEVDVQESRNGYIVHRTALEAG IIYP | 469 | Hoc head outer capsid protein [Enterobacteria phage JS10] | YP_0029225 2.1 | 1e-164 (295/468) | outer capsid protein | No putative conserved domains have been detected | | |
| 286 | 162561 | 162788 | 1067 | MKAIQAHLMHESGKDFQEIARA LDITPAEAAKLWVSVEKAHERF KQKEKVVYRKRLTNVGIKSRHK KLVKHMRTL | 75 | DNA primase-helicase subunit [Klebsiella phage KPP95] | ABH10667.1 | 8e-35 | DNA primase-helicase subunit | DUF2774 | pfam11 242 | 6,15e -16 |
| 287 | 162785 | 163111 | 1068 | MMSKVDPIVVERFEEMLSKKFT PAANGVNVWLFASKFVSKMMA VQSSYYYKSGARKITDLINERY GKIDWMLMDKDIPLVLEVGSKS QFEIMLTKSGYIMYRFVPSGY | 108 | No significant similarity found. | | | | No putative conserved domains have been detected | | |
| 288 | 163226 | 163483 | 1069 | MNLADRMANTAINVATEELSAA KEEVLTQIEKTALAGKRELIMYP SSLVKKHITNVLNYLHDEGFVT NYTSAQRNGDTDFMKITF | 85 | No significant similarity found. | | | | No putative conserved domains have been detected | | |

Fig. 12SSS

| orf | Start position | Stop position | SEQ ID NO.: | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 289 | 163494 | 164501 | 1070 | MFAKYSSLENHYNNKFIEKIRG AGFDMHTVEWVAREKIHGTNF SVIITPTEIVPAKRTGPILEGESF FGHEIIMKKYKDSFVKMQNMLN TMDLVSVQIFGEFAGGGIQKGV DYGDKDFYVFDILSDSGNEKVY WDDYVVESFATGLGLKLAPLLG RGSFAELSQYVNDFKSIVNYYN ELVDTTDLEHANKHVFGPQASS ETGVAEGYVLKPVNPKFFNNGT RVAIKCKNSKFSEKAKSDKPIKA KVELTDTDKRVLEIFSEYVTWN RVSNVLSHIGTVTAKDFGRVMG LTMKDIINEAAREGHDMLFADN PSAVKKELTTLIQNTIRSKWHEV LE | 335 | RNA ligase [Enterobacteria phage RB14] | YP_002854510.1 | 1e-104 (195/336) | RNA ligase | RNA_lig_RN L2 | TIGR02 307 | 1,30e -77 |
| 290 | 164501 | 165049 | 1071 | MRLALIGSREAPRRVLSLMTIIG QRLSEEGHFSYSGGAPGSDEA WLAKYDRSNSCRIIPYSGFCGH VPDTGVVWSELSNEAKIKSIIK AREVTSYWDECSKIVQTLFARN SMQVLGLECTEPVDKVLYWAP EKRCGSVSGGTRVAVDIARRH GIECVNLYDKNVFKSLEEEYSP RFDIFSL | 182 | Hypothetical protein KP15p208 [Klebsiella phage KP15] | YP_003580084.1 | 5e-25 (64/116) | | No putative conserved domains have been detected | | |
| 291 | 166359 | 165079 | 1072 | MAKINELLRESTTTSSNLIGRPN LVALTRATTKLIYTDLVATQRTK QPVAALYGIKYLNPNGDLTFNT GATYAGQIGAPERESIEELTMA NKDSFNKDDMFKYQNVVFKVL KDSPFTDTAETDEFGIVSEAVA ANNIRMLSDAAVTEKFEGPDSD PITEASFKIDKWQTQVKSRKLKT DLTVELAQDLEANGFDAPELID DLLATEMAEDINKDILQSLITVSS RFKVAGVSDKGVLDLTKQDSA PEQGRTLYRFICEMNSAVQRNT SYSGTYAVASTRCAAVLAASG WLTQKNDGSIPENAYGMLNNG LPLYCDTNSPVDYVIVGVKAEF GGKETVGSLFYAPYTEGLDLDD PEHVGAFKVIVDPASLQPSVAL LVRYALSVNPYTVGLDEDEARV | 426 | gp24 precursor of head vertex subunit [Enterobacteria phage RB51] | YP_002854131.1 | 2e-163 (293/428) | precursor of head vertex subunit | Capsid vertex protein | PHA025 48 | 1,38e -178 |

Fig. 12TTT

| orf | Start position | Stop position | SEQ ID NO.: | Aminoacidic sequence | Size (aa) | Homologous/similar proteins ||| Predicted function | Conserved Domains |||
| --- | --- | --- | --- | --- | --- | --- | --- | --- | --- | --- | --- | --- |
| | | | | | | Name[organism] | Acc No | E value and identity | | Name | Acc No | E value |
| | | | | INAADMDKMAGRSKMSVLLGV KLPKLIAD | | | | | | | | |
| 292 | 16667 7 | 16644 1 | 1073 | MDAGIYYAPYVALTPLRGSDPK NFQPVMGFKTRYGIGINPFADS AAQQPKGRITSGMPSIVNSVGK NAYFRRVWVKGI | 78 | gp23 precursor of major head subunit [Enterobacteria phage RB51] | YP_00285413 0.1 | 6e-35 (70/78) | precursor of major head subunit | Major capsid protein | PHA025 41 | 7,51e -38 |

Fig. 12UUU

Fig. 13B

| orf | Putative function |
|---|---|
| 183 | tail lysin |
| 185 | glycerophosphoryl diester phosphodiesterase |
| 188 | baseplate protein |
| 197 | helicase |
| 198 | transcription regulator protein |
| 199 | helicase |
| 200 | exonuclease |
| 202 | exonuclease |
| 204 | DNA primase |
| 208 | ribonucleotide reductase protein |
| 209 | ribonucleotide reductase large subunit |
| 210 | ribonucleotide reductase minor subunit |
| 212 | thioredoxin-like protein |
| 214 | DNA binding / bending protein |
| 215 | DNA polymerase |
| 219 | DNA repair protein |
| 221 | sigma factor |

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 1b | 2 | 310 | 1075 | FVQIPIFSLIPILRYKLEEQ GIGLIETEESYTSKTSFIDN EKPIKHNVYKGKRVKRGL FKTEEGRILNADVNGAFQI MKKVFPDVEIPRDNGFVY NPFLINC | 102 | IS element Dka2 orfB [Hyperthermophilic Archaeal Virus 2] | YP_003773391.1 | 5e-18 (109/405) | Transposase | orfB_IS605, probable transposase | pfam01385 | 2,87e-36 |
| 2 | 475 | 1107 | 1076 | MAKKNVNDVLQQESVTV ADKYLQVKVNRDGYTRT HEGQYAYKVVSEGEELFL YPVQTDGKGTLNVMKKS PIAYTDGDNIHFVVNTVV DPYNHSFIRTEDIKGLDKG KQLIQAFLAFVEDRFKFG VYNVFVANSKEDVLSIVD PTDNDADEVKDSLEHAHE DVIADFPASPARKDVKGV DSGEGQGDTSEPSAPKNV QVTPKEDGADVSAE | 210 | hypothetical protein KgORF95 [Staphylococcus phage K] | YP_024523.1 | 6e-177 (209/210) | | PHA02283, hypothetical protein | PHA02283 | 4,55e-71 |
| 3 | 1121 | 1642 | 1077 | MVNLAKLNLYKGNELLN SVEKTEGKSTITIENLDAN TDYPKGTFKVSFSNDSGE SEKVDVPQFKTKAIKVISV TLDVDSLDLTVGDTHQLS TTITPSEASNKNVSFESDK SGVASVTSEGLIEAVSAGT ANVTVTTEDGSHTDIVAV TVKEPIPEAPADVTVEPGE NSADITA | 173 | putative major tail protein [Staphylococcus phage K] | YP_024524.1 | 1e-88 (168/169) | Major tail protein | Big_2, bacterial Ig-like domain (group 2) | pfam02368 | 2,14e-04 |
| 4 | 1657 | 1884 | 1078 | MEKTLKVYSNGEVVGSQ VANNDGATTVSITGLEAG KTYAKGAFKVAFANDSG ESEKVDVPEFTTKTPTEEP | 75 | ORF189 [Staphylococcus phage G1] | YP_240967.1 | 3e-33 (73/75) | | No putative conserved domains have been detected | | |

FIG. 14A

FIG. 14B

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | SGEA | | | | | | | | |
| 5 | 1979 | 2239 | 1079 | MDIPTILFRNPYDYTKVK KLMENKEQYIVVKFDSVS VHNLNVQGMMNVIQDYL HIYGYRVKEYGQENASK DDERDVKGYLYERVGE | 86 | ORF174 [Staphyloccocus phage G1] | YP_240968.1 | 5e-42(86/86) | | No putative conserved domains have been detected | | |
| 6 | 2243 | 2998 | 1080 | MGIIVNSNHIQSDTLYEYD SFFDIEKVDTFEEGLLSIQ DEPTVLAGFIYDDITFNKV INSNSDIDDYIKNNDIYYV SDIGLLPDTFITVDSDKKY YSLLQQVVELSKDPFPKW VEDDAKGLTKYYNFQDF EDVFDLNSFYKEVDMV REKCYNNGNVYLLYEVL PDYKLPLAYSLLSNKEHGI VIIGSQTRSNNDILTFYVK GMDAKAIASMFNVEHDY DSNIFHITFVNSHINILGNQI TKFIREKGSSYE | 251 | hypothetical protein KgORF97 [Staphylococcus phage K] | YP_024525.1 | 2e-140 (248/251) | | PHA02284, hypothetical protein | PHA02 284 | 5,61e-42 |
| 7 | 2991 | 4241 | 1081 | MSNYKTIEEVQAVIIGVLF KDEGKIVTSKFNKITKEFG LDRIGKDDLKEIVEDIRQD AYLNELKNKAIKGKVTLG DLKDVADNQVFEGNNYH EEVSTYVVAKEKELSHLR EQRKHNRHTAYPQIMFDE LKEHMVKELQGETLVEH HGSKANINDTELIVLLSDF HIGSIVSDMTNGKYDFEV LKARLNHFINTVKEIEDR EISNVTVYFVGDLVEHIN | 416 | hypothetical protein KgORF98 [Staphylococcus phage K] | YP_024526.1 | 0,0 (415/416) | | No putative conserved domains have been detected | | |

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | MRDVNQAFETEFTLAEQI SKGTRLLIDILNVLSNVVS GELRFGHGGNHDRMQGN KNQKIYNDNJAYVVLDSL LLFQEQGLLNGVDIIDNRE DIYTIRDTFGGKSIIINHGD GLKGKGNHINKFILDSHID LLITGHVHHFSVKQEDFN RMHIVASSPMGYNNYAK ELHLSKTKPSQQLLFVNK ENKDIDIKTVFLD | | | | | | | |
| 8 | 4255 | 4623 | 1082 | MDTIFIIGVAFITFATFNIV FRLFDLWTTEKKMVSQG QPPLSNFEYYHVIVPYLV GVIVITLSIIFRDSLYSAQS GFGIIITSFIYMLVYVIIGL VGSFILTIFQARKARQYQT QEDNNEVQ | 122 | hypothetical membrane protein MbpG [Staphylococcus phage A5W] | ACB89126.1 | 5e-62 (119/122) | Membrane protein MbpG | No putative conserved domains have been detected | | |
| 9 | 4610 | 4921 | 1083 | MKFNDIYEQLIKNDTVQN IHESQDDKGNIYTIQFDKG NDKYLFNVINDGFLKEMT NGMVDHPEGQPYSVSLIN KETPSMSVKQYLTDVEDI VPTIRKMEKDFL | 103 | hypothetical protein KgORF100 [Staphylococcus phage KJ] | YP_024528.1 | 5e-53 (103/103) | | No putative conserved domains have been detected | | |
| 10 | 4985 | 5521 | 1084 | MDFNFSAFDNSSLAMRIS EGVYYFNDTPYYFIEHVE EEMSEYVIVYDIHDREEK ENPQKKYRIEPYQRTIPGG TPLSNLIKSMMPQRKYPK KVTEDPIFVANVIPLGTDT VTGKTGKGFFERDKDRTI YSQKEPTKVVHGQYTGV | 178 | ORF075 [Staphylococcus phage G1] | YP_240973.1 | 1e-99 (178/178) | | No putative conserved domains have been detected | | |

FIG. 14C

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | FIGLTSVKWNRTYTPLES VVEYYKRVKGDRLNV | | | | | | | | |
| 11 | 5514 | 6281 | 1085 | MSNDVVKFYEKDIKDLIR TKKHMFKDDETSDINDIR IFNEKVICQGKCRTDCLVL DRNGTVMGIEIKTERDST QRLNNQLKYYSLVCKYV YVMCHDKHVPKVEQILK RYKHNHVGIMSYISFKGK PVVGKYKDATPSPHRSPY HTMNILWKTNLMTILRLI RDPHTYRTGYSYNASGRY SGGEGNFSQTTQSKRMKK PAIINQIIHYVGVDNTYKL FTRGVIYGYNNRWEVIEE DFFNTMKNGVRVINEQRQ TK | 255 | hypothetical protein KgORF101 [Staphylococcus phage K] | YP_024529.1 | 6E-149 (255/255) | | No putative conserved domains have been detected | | |
| 12 | 6259 | 6705 | 1086 | MSKDKPNRRKEIQHQPVN FAPMNTLTGANNSFFAKK PSEPKDATSVIEYRILFIKR FDNVTSTDVKLQKKYAL NLISEALDVKETYLSLKQ KGKKTESILHTDRVYYVH RGKKLIGKCSIREQRTFKG KHLIFIFKTRHRVKAERKD K | 148 | hypothetical protein KgORF102 [Staphylococcus phage K] | YP_024530.1 | 3e-80 (147/148) | | No putative conserved domains have been detected | | |
| 13 | 6705 | 7568 | 1087 | MLKGFSEHVDKPTTTKTL YKTLTSGKVELLGVSYDS DYFPSGVTVQSYIEDIGNE DEGLQFVNKINVVESMKQ AVVGMNNQLGSSGLGYV RTEQLKKELEETGLMTDL | 287 | ORF036 [Staphylococcus phage G1] | YP_240976.1 | 1e-159 (283/287) | | sepiapter_re d. sepiapterin reductase | TIGR01 500 | 8,02e-03 |

FIG. 14D

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | LARGTNLTSTKKVDIVSTF IEPEVTYQDITIAKDIKLRL YKLEEESPLNGYTHIVYLL TTEKLYDGQTLFGMLSKK DKLSKGDTDKLLAFFRNN SLISKSVFCVKLLSKDYYF NLYNTHETGIFFLEDTDVI TIACGQSYVKVNTKDIKS SYVKIEDKTHKLTELVINL KGDDTLTLF | | | | | | | | |
| 14 | 7940 | 8671 | 1088 | MARKKNLRNKNSDIKVV PDKEKESILSKLYHNKLLR SKVDNALDEDMSYDDIIE LCKEYDLELSKSAITRYKS KRKEAIENGWDLEELIDK RKKTSVKDIKEKETPILEE EQLSPFEQSKHHTQTIYDD IQVLDMIISKGAKGLEFVE TLDPALMIRAMETKDKIT GNQLKGMSFIGLRELQLK QTAQDTAMSEVLLEFIPEE KHEEVLQRLEELQNEFYK NLDLDEESRKLKEALDRV GYTI | 243 | hypothetical protein KgORF103 [Staphylococcus phage K] | YP_024531.1 | 6e-135 (242/243) | | No putative conserved domains have been detected | | |
| 15 | 8689 | 9147 | 1089 | MADEISLNPIQDAKPIDDI VEIMTYLKDGRVLRVKQ DNQGDILVRMSPGKHKFT EVSRDLDKESFYYKRHW VLYNVSVNSLITFDVYLD EEYSETTKVKYPKDTIVE YTREDQEKDVAMIKEILT DNNGNYFYALTGETMLF | 152 | ORF094 [Staphylococcus phage G1] | YP_240978.1 | 7e-81 (148/152) | | No putative conserved domains have been detected | | |

FIG. 14E

Table 11 - Features of phage F125/10 gene products and assignment of putative functions.

| orf | Start position | Stop Position | SEQ ID NO. | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| | | | | DENKLNKVKD | | | | | | | | |
| 16 | 9212 | 9655 | 1090 | MFISLNQEEKELLTKEESK YTPLETSRFENTPKEEFIV TSYNEGKPLDYIAKEAKV SMGLIYTVLNYYKVGKR NKKSPVEERIAHILKDKNL VKEIIKDYQYMNLQDIYS KYNLHKNGLYYILDLYH VERKSELKDKALEEDNIV VE | 147 | hypothetical protein KgORF105 [Staphylococcus phage K] | YP_024533.1 | 3e-77 (147/147) | | No putative conserved domains have been detected | | |
| 17 | 9672 | 10376 | 1091 | MRNKKSFQEQLNDMRNK EKWVSEEFTEEVAPSEFP EVEEEKLYTLNELKENLL DAQGLKDVVADFPASKD LYEPNKLYICTIPKGYQST EVQPGQYIGISTGLLSESE DFSHLRGQMPRNLYETSH VLKPLVRINNTSIEYQQHE LLEDIKEDKNVYDVELED LRLATGEEISYLEIVDSKF FESRINEVLDFYHELTDSD DLLEYYNKLRELVGNDR MIYCPLLNKCVKIID | 234 | hypothetical protein KgORF106 [Staphylococcus phage K] | YP_024534.1 | 2e-113 (215/234) | | PHA02290, hypothetical protein | PHA02 290 | 2,24e-29 |
| 18 | 10522 | 10836 | 1092 | MYHDKAKNEVSTELSNT GKIKEEKNVEFVGDYTLK KVEDNKAYFMETLPTYLP GRTGDNSIDMRYYKTSRF KEGVNFKLIRVYTEDGED NPIHKYRFEAVPTKK | 104 | hypothetical protein KgORF107 [Staphylococcus phage K] | YP_024535.1 | 2e-54 (104/104) | | PHA02291, hypothetical protein | PHA02 291 | 2,86e-15 |
| 19 | 10983 | 11225 | 1093 | MEMADLERFDAFVRLISD DELSEERILELSVDLLNPIL | 80 | gp ORF144 [Staphylococcus phage | ACB89137.1 | 6e-37 | | No putative conserved domains | | |

FIG. 14F

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| | | | | EGGTAYRAKKRIKSKFGK LEAKNFKRNYKFLLKSIA QIDQRR | | A5W] | | (79/80) | | have been detected | | |
| 20 | 11230 | 11787 | 1094 | MTEREKLIKEIEEANRDIQ LQLKEVDNYKDSIRSKGT RNYISTKVLDSITVGFIVSF LILIMRVLEYFVTGNAVY SPLAPAVIIMFVLALGTW KVSKMNKIVSYRGTIKMY WELSNAEOKQAKVFKYP NDEVDIVSKHNLRQITFSE INILHLKYMRYNKAVEQH TKLSKELFKKDKETVDKN K | 185 | hypothetical protein KgORF108 [Staphylococcus phage K] | YP_024536.1 | 1e-71 (133/135) | | No putative conserved domains have been detected | | |
| 21 | 11823 | 11999 | 1095 | MVIPSIKAQNKFKNELEY YKQGHISESKMLELAFDY IQELEQNNEYVTNLLEEE RYGE | 58 | ORF240 [Staphylococcus phage G1] | YP_240984.1 | 1e-24 (58/58) | | No putative conserved domains have been detected | | |
| 22 | 11989 | 12240 | 1096 | MVSKFIGVYLFNLLVVAL VYTVGFLFFYGVASLVIIL THATIDPFVLATFLGIGFL VIRTAHRIMARVINDAVA QAIKDKENE | 83 | No significant similarity found. | | | | No putative conserved domains have been detected | | |
| 23 | 12233 | 12466 | 1097 | MNKGEFIMDKTLPKFSVY EVIVKTVIMTPTEGSSDLE SFYFSTRELAERFVEENTV ETKNGKRVSFAVKERKV NQPG | 77 | No significant similarity found. | | | | No putative conserved domains have been detected | | |
| 24 | 12548 | 13192 | 1098 | MKVSEEVKQSYLENKAN TKMDKISWSELKASPLGIT | 214 | hypothetical membrane protein MbpJ | ACB89141.1 | 4e-88 | Membrane | No putative conserved domains | | |

FIG. 14G

Table 11 - Features of phage F125/10 gene products and assignment of putative functions.

| orf | Start position | Stop Position | SEQ ID NO. | Aminoacidic sequence | Size (aa) | Name[organism] | Acc No | E value and identity | Predicted function | Conserved Domains Name | Acc No | E value |
|---|---|---|---|---|---|---|---|---|---|---|---|---|
| | | | | LGDIIFYSVVIIDNIIAIILTL TLIGTITDSIESTLAQIIVGV FIIITIYGILSALIPILIHKAV SPGWSYTEWNESYYIRLP GEENYKYYSKWYLDLLG VKEFYYKRDSGEEVKEK NISWAFQAEVKRPEDVNH WKNQLLTNRPLTILEYKK LKKLDKESEIRKQEDLEE YKQYNSN | | [Staphylococcus phage A5W] | | (162/173) | protein MbpJ | have been detected | | |
| 25 | 13207 | 13455 | 1099 | MISSFDSILLVIYIIIAFAVA MAIIYLVFKGMTILLDKL MMLLLSKTTLDVEACSMI MAVISTIVFGHIVLLIWLAV NNILL | 82 | No significant similarity found. | | | | No putative conserved domains have been detected | | |
| 26 | 13467 | 13643 | 1100 | MDFNDFINSESDRVGNPK QKKKVENKLPSSIPIEDRE KKLKEIRKKSLYIDLRRKR ND | 58 | ORF241 [Staphylococcus phage G1] | YP_240986.1 | 5e-22 (55/58) | | No putative conserved domains have been detected | | |
| 27 | 13636 | 13932 | 1101 | MTKETNVLYKDKYRDYT IVVRLAGNIIVTEVDKKH KTAFTPIIFDNGVEGVELV MRIGSVELSMTDLREFTK EVSTAQKALEYFNKKLYI KGLTDEAF | 98 | ORF152 [Staphylococcus phage G1] | YP_240987.1 | 1e-48 (97/98) | | No putative conserved domains have been detected | | |
| 28 | 13980 | 14162 | 1102 | MLLGILWFIWGFVSYFVL MFGIEFCKDRWMPGVIGA GALLLFLFWIMKSIHNAM TVVYLY | 60 | hypothetical membrane protein MbpK [Staphylococcus phage A5W] | ACB89144.1 | 3e-24 (59/60) | Membrane protein MbpK | No putative conserved domains have been detected | | |

FIG. 14H

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 29 | 14175 | 14543 | 1103 | MDILIHYKETNKRVLKET IQTIQNHLNDEHGLVKMT ATKLSRENIEKRFNNYNIV IAEDDPDNSYHYSEAVEE ADFIIDIPISYLDIHAGVEW DVDNPVDMLDRNPDFIEA VNKLNEDLML | 122 | ORF119 [Staphylococcus phage G1] | YP_240989.1 | 1e-62 (119/122) | | No putative conserved domains have been detected | | |
| 30 | 14556 | 14903 | 1104 | MLNEKLKNLEDTKVYMI NSIASLLSASTGKSSKVFF DEGTIKIVSGETKAVEVID NLVHPHSGRLPIKTTERIA LGRLTDSLQFVISEIEVVK DQIIDEENEAYIDFVMED WDWD | 115 | ORF124 [Staphylococcus phage G1] | YP_240990.1 | 5e-59 (114/115) | | No putative conserved domains have been detected | | |
| 31 | 14909 | 15181 | 1105 | MDLLTIASVAFIAVVIIDLI NDDMSYMLTGTAILINIW AGFYGWFFLLQAGMLLF LLLARKVKDDKESILYSS ASLICALGMIINLLSFS | 90 | hypothetical membrane protein MbpI [Staphylococcus phage A5W] | ACB89147.1 | 8e-42 (90/90) | Membrane protein MbpI | No putative conserved domains have been detected | | |
| 32 | 15251 | 15556 | 1106 | MSKETIRRQFSNAIEIMAT TKEWWNFPKSFNTSKEFK IKTFKNDTLVFEVREGSR NLGSFVIFTNIDFDYDKLE GTSTQYMINYFAKKLTKD MFNYHKLQL | 101 | ORF140 [Staphylococcus phage G1] | YP_240992.1 | 8e-51 (98/101) | | No putative conserved domains have been detected | | |
| 33 | 15571 | 15921 | 1107 | MREELKPFNRKQVNVKG YLDDVKYSKRRRHKGNQ HGCVKITVTDVKINGIPID HVNIEVGISFYEKLKELQG KRIQFVGTVYKYVKHAR GRKGRIKGFYKEDYSVTL | 116 | ORF122 [Staphylococcus phage G1] | YP_240993.1 | 2e-59 (116/116) | | No putative conserved domains have been detected | | |

FIG. 14I

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| | | | | DKKLQKEEK | | | | | | | | |
| 34 | 15921 | 16523 | 1108 | MIKRRKHLDHSLQPEKG WRTVPFNGYYEAHPTGLI RNKVTKKLIKGTQTRKNH PKWTAHEIVYLINPKKTS YSRGVVIAHTFPEMISQSR GDLKNGHVCFKDGDRSN CHVDNMFIGKGNVNKNI YKLNDSYLTRKDIEEDVN NLVNERLFSQLELLIKKNE PERITPSNHFIKRDNNVFSI TDLSKNSLVEFELEIKNIK | 200 | ORF065 [Staphylococcus phage G1] | YP_240994.1 | 2e-113 (200/200) | | No putative conserved domains have been detected | | |
| 35 | 16537 | 16716 | 1109 | MNEWYALCYYDKVGKK KIPRQIKAHRDVSVLEDL KDRLEEQNPKEEYKIKTT KEFDKER | 59 | ORF237 [Staphylococcus phage G1] | YP_240995.1 | 2e-25 (57/59) | | No putative conserved domains have been detected | | |
| 36a | 16943 | 17218 | 1110 | MKILEDKVLERIDSLGNKA GNLSNQAMESLVKYQITY GHIDIVVSILVIALTIFLGKV YLKEYKKVKMDLKESLL YDDYDILSLRNSCRYTN | 91 | hypothetical membrane protein MbpM [Staphylococcus phage A5W] | ACB89152.1 | 1e-35 (81/87) | Membrane protein MbpM | No putative conserved domains have been detected | | |
| 36b | 17223 | 17291 | 1111 | MRLINPEVYAVKDLIEQV KGGN | 22 | | | 2e-12 (22/22) | | No putative conserved domains have been detected | | |
| 37 | 17293 | 17586 | 1112 | MKQRDFEFEEDFVLTYEC EDCKHFEDWGHDEEPEEC SECGSSDLINNTSHEDTEC DMCRGYIDMWQDGYRY MGDNKEYIEKEESGLICE DCYEKLDI | 97 | gp ORF160 [Staphylococcus phage A5W] | ACB89153.1 | 2e-48 (97/97) | | No putative conserved domains have been detected | | |

FIG. 14J

Table 11 - Features of phage F125/10 gene products and assignment of putative functions.

| orf | Start position | Stop position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 38 | 17603 | 17890 | 1113 | MNKAVEQASNALGQGFS AMVWHQVLAGLGFILLG LVLSLLVWVLVKKFHVPF NHPTAFVVYSIMLVSIVAS FIWGGLHVINPEYYAILEL KGFIK | 95 | hypothetical membrane protein MbpL [Staphylococcus phage A5W] | ACB89154.1 | 2e-45 (94/95) | Membrane protein MbpL | No putative conserved domains have been detected | | |
| 39 | 17901 | 18017 | 1114 | MTKFELFQKVKELEAEN KELKKQIERFEDEGGKTK DEQ | 38 | ORF362 [Staphylococcus phage G1] | YP_241000.1 | 1e-10 (38/38) | | No putative conserved domains have been detected | | |
| 40 | 18007 | 18273 | 1115 | MNSRQKKILTLTVSNFLIL ALDTVALIRYKKGKIKQE NYNTGQITRMIATTANSL GILYLEEQERKEVKDIKV GTFEIGALKRFTNNK | 88 | ORF170 [Staphylococcus phage G1] | YP_241001.1 | 3e-31 (68/86) | | No putative conserved domains have been detected | | |
| 41 | 18351 | 18656 | 1116 | MKGIIIFYKEETKEDLGYF LGFINFKLFGLSYTTEGTL VDNDVVVLKDNQINEDN LEQFSMSNNNLVIGILGHS SLSVRIYEKGIRQEFDRVE EYLEELRQ | 101 | No significant similarity found. | | | | No putative conserved domains have been detected | | |
| 42 | 18656 | 19057 | 1117 | MIFILIFGLLFILSLLGIFIYF IVLRKKQLIEERESFGIY NRTKEKLGDVTRLGYEED VYKLIHNQSNKTTIEDKKS KVVDTIKKMYELELTSVD VSKVEGLSPLDTEPMTNM KLLSYKLDREGLYSLSKFI | 133 | No significant similarity found. | | | | No putative conserved domains have been detected | | |
| 43 | 19068 | 19304 | 1118 | MEFIDKNNVIKAYDIPNV YLKGYVLQACDKNGDTT AYDGYDQIHYKEGRVLTF | 78 | No significant similarity found. | | | | No putative conserved domains have been detected | | |

FIG. 14K

Table 11 - Features of phage F125/10 gene products and assignment of putative functions.

| orf | Start position | Stop Position | SEQ ID NO. | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | PFDKPLRKINVLSGYYKLF KKEDII | | | | | | | | |
| 44 | 19301 | 19828 | 1119 | MIYFVSDLHFGHDNIREFE APTRSHWNSVEEMNEGLI ELWNNTITNNDIVYNIGD FFFNMKPSKVEDILNRLN YKEMILIAGNHDHKKLIK LYERNGITVKYADMIKKD GKRFYLSHYPTLIGRKNM FNIHGHIHSQLMGTEYHIN VGYDVEGKIAYSFDDIISR AGEYNGEIQR | 175 | phage protein [Staphylococcus aureus subsp. aureus TW20] | CBI49957.1 | 2e-66 (124/165) | | MPP_AQ15 75, Aquifex aeolicus AQ1575 and related proteins, metallophos phatase domain | cd07390 | 2,83e-37 |
| 45 | 19809 | 20129 | 1120 | MEKFKGKDLYKTRIRKQT IKNLVIKTEKLHNKHGKY RPIGHVYYYPKTKEFTLS KPEQKIFIEYMKELGFNV KHRRRKKTLJIYKNAFTE YISMYHEAIEQIEGGT | 106 | No significant similarity found. | | | | No putative conserved domains have been detected | | |
| 46 | 20129 | 20359 | 1121 | MEYLFLFIGIGMIIWGFIAP YLAFVVYYKHVRENHNG FSDEESLEEATVLGMGFM FIAFIPIGILVVIEEIKILFF | 76 | No significant similarity found. | | | | No putative conserved domains have been detected | | |
| 47 | 20412 | 20618 | 1122 | MKHFLILGIVILVIALGIVI LVIALGIVLPAWILQLVLS AFGVKVSIWVCIGIFILISA IGSMFSRN | 68 | ORF236 [Staphylococcus phage G1] | YP_241002.1 | 5e-20 (59/68) | | No putative conserved domains have been detected | | |
| 48 | 20633 | 20896 | 1123 | MAKYESNINGENYIATPS QALREALAKLITEEKSFAE YQTKGGEQYESQLQLRHF DAMISQYEEAIRVLEDKY | 87 | ORF171 [Staphylococcus phage G1] | YP_241003.1 | 1e-41 (85/87) | | No putative conserved domains have been detected | | |

FIG. 14L

Table 11 - Features of phage F125/10 gene products and assignment of putative functions.

| orf | Start position | Stop Position | SEQ ID NO. | Aminoacidic sequence | Size (aa) | Name[organism] | Acc No | E value and identity | Predicted function | Name | Acc No | E value |
|---|---|---|---|---|---|---|---|---|---|---|---|---|
| | | | | RPQIFIPKDNKEEN | | | | | | | | |
| 49 | 20899 | 21216 | 1124 | MKAESIARFFNDKVLQIE GYKVRFPQASSSYILDIDT VDESVLFLDAQVSTLSGK HLLDTAITIERPETLSAKE LYTEISNKLQAIVGDQTKT TIELSRYFKEEK | 105 | ORF137 [Staphylococcus phage G1] | YP_241004.1 | 2e-51 (102/105) | | No putative conserved domains have been detected | | |
| 50 | 21217 | 21897 | 1125 | VSNKTITNHLLNLKGINIE TYSIIARIKKQTSWGDKG DSFEISISYKADKDPRTVR YITTEITIDYSSNNPKEILL QLKDKIFSIVEEQVETDND FIESIKEINSTKALEKLKPY INNEYYSMFKSSIEKEIPV ALSSEVLNRCTGKTSTLA YLALEKDLPLVVSNEPMR KMLKNKFPHLRVSSAEDY SNYDIKGEIVLIDEVDIDQ LYSADKVSVDALLVGIIK N | 226 | ORF055 [Staphylococcus phage G1] | YP_241006.1 | 5e-116 (210/226) | | No putative conserved domains have been detected | | |
| 51 | 21975 | 22133 | 1126 | MIPIIVILIGLILFLSSGYKL VLGKYYDDVDLKILFTIF GVGIALLGGFIL | 52 | hypothetical membrane protein MbpN [Staphylococcus phage A5W] | ACB89160.1 | 3e-17 (51/52) | Membrane protein MbpN | No putative conserved domains have been detected | | |
| 52 | 22149 | 22373 | 1127 | MNYEEVLRTIKENKPCKV RFTGNILAIVNEEFNADTD KGVLQLDVSNINKEGYIR LQQYCLERDDYTVVGAIL F | 74 | No significant similarity found. | | | | No putative conserved domains have been detected | | |

FIG. 14M

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 53 | 22386 | 22586 | 1128 | MNYRDFITDCISGGYNVH ISVTEKRVHIISEMTSASYP KKEINLDELQAYVYYMN NFGSQITTEGL | 66 | ORF211 [Staphylococcus phage G1] | YP_241008.1 | 2e-31 (66/66) | | No putative conserved domains have been detected | | |
| 54 | 22587 | 22877 | 1129 | MELVINIVAVLVGMYAIY FYVTKFSTGLSGLIVLGM AIGLYFYLDYLNVRENVI RLVSVMFGAFLFSIEMIYN KIMFEIKKSNVQKTVRVY DKEQ | 96 | ORF155 [Staphylococcus phage G1] | YP_241009.1 | 7e-46 (96/96) | | No putative conserved domains have been detected | | |
| 55 | 22971 | 23279 | 1130 | MYPEIDVEKLAYKLKSTR EYLESIKIKEVEIYEIYHLK TGKLVFKGEYIEVKELLR KMYKENLTLVDVDTMLSI GKGFIDVIKNISAENVFQI TYKKELSTK | 102 | hypothetical protein KgORF109 [Staphylococcus phage K] | YP_024537.1 | 2e-47 (99/102) | | No putative conserved domains have been detected | | |
| 56 | 23276 | 24184 | 1131 | MIKIFSEVDKEYKPITEKF PNGEINFKYDDLKYLVEE NLRFDVFFKWENDADLM HLYMFTKYLEQLGIKDKA EFLEIAYLPYSRMDRVEE GHNNMFSLKYITEFINNL NYKSVWVVEPHSPVTEEL LTNSVAIDVTLKLLNQYIE MSEEPVTIVLPDKGAYDR YLFDVERILMESNIESYSI VYGEKKRDFETGKIKGIKI IKDKNTLYDNCIILDDLTS YGGTFVGCKKALDKLKV SSVSLILTHAERAFAEGAL LSSGFKDIIVTDSMFPKNN WEKAIAKHRARINGTELQ | 302 | putative ribose-phosphate pyrophosphokinase [Staphylococcus phage K] | YP_024538.1 | 2e-172 (299/302) | Ribose-phosphate pyrophosphopho-kinase | RibP_PPkin, ribose-phosphate pyrophosph o-kinase | TIGR01 251 | 8.54e-17 |

FIG. 14N

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| | | | | IKDIERYL | | | | | | | | |
| 57 | 24202 | 25671 | 1132 | MLNPTLMCDFYKLSHRE QYPEGTEIVYSTLVPRSNK YYEHSDNIVVFGIQSLVK KYFIDMFNKEFFNRPKEE VINEYKRTVKFTLGQENP DAKHLEQLHDLGYLPIDV RALKFGTVVHPNTPVMTI ENTHSDFFWLTNYLETIIS TQTWQAMTSATLAYDMR KMLDKYAMETVGNIEAV DFQGHDFSMRGMSSLETA QLSSAGHAISFKGSDTVPV VDFLESYYNADVEKEMV VASIPATEHSVMCANGNY ETMDEYETYKRMLTEIYP TGIFSIVSDTWDFWGNMT KTLPRLKDIIMERDGKVVI RPDSGDPVKIICGDPDADT EYERKGAVEVLWDTFGG TETEKGYKVLDEHVGLIY GDSINYERAQQICEGLKE KGFASINVVLGVGSFSYQ FNTRDTHGFAIKATYAKI KNEEKLIYKNPKTDSGKR SHKGRVAVYKDGSWEDN LTLHQWLNKQNVNQLER VFEDGKLYRDQSLSEIREII KNN | 489 | nicotinamide phosphoribosyl transferase [Staphylococcus phage K] | YP_024539.1 | 0.0 (488/489) | Nicotinamide phosphoribosyl transferase | PBEF_like, pre-B-cell colony-enhancing factor (PBEF)-like | cd01569 | 2,88e-163 |
| 58 | 25750 | 25995 | 1133 | MIYKISKHNYYSRFEYSSY LPDEGFAYIDYVDVILIGV DNPRKRKVITLKADEFNP SDFKVGHKYNIIKILWFEK | 81 | ORF178 [Staphylococcus phage G1 | YP_241013.1 | 5e-35 (70/81) | | No putative conserved domains have been detected | | |

FIG. 14O

Table 11 - Features of phage F125/10 gene products and assignment of putative functions.

| orf | Start position | Stop Position | SEQ ID NO. | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| | | | | WEWLQP | | | | | | | | |
| 59 | 26012 | 26404 | 1134 | MIIDKLNGVKLEIGGHVV SFSVSKFKTINGERQLLDY HHIKRRKQKYFRTTEEFY NEYKEIKPDKNEIDEMFES LGYVDTKLEDVVRNQEK VTEILGVSEQYLNQLSYK AIEEYVDKIVTLEIKELKG EK | 130 | ORF113 [Staphylococcus phage G1] | YP_241014.1 | 3e-63 (121/130) | | No putative conserved domains have been detected | | |
| 60 | 26406 | 26603 | 1135 | MSNSWEKEGVNYWENED CPREYLEKAFIELVEYVEG VTVPSRDVQQLREDKLRE DIGFYEYVADK | 65 | ORF194 [Staphylococcus phage G1] | YP_241015.1 | 8e-26 (58/63) | | No putative conserved domains have been detected | | |
| 61 | 26668 | 26964 | 1136 | MMNGKQIYVFLSDQYSK DILSLQLGLIKEWSRRELT YSDDVGSDADVVICTDIV RDDFVKKLSKNNSNALFV FISSFYWIGYKGGEFFVAV QDYVKGM | 98 | No significant similarity found. | | | | No putative conserved domains have been detected | | |
| 62 | 26968 | 27279 | 1137 | MKKLLILFTLASTLLLAGC TPDNHEGKVLGTGEYREP TTYIKSGSVTVPVIGEMK YYVDLETDKGEDRVYLN REVYHKFDKGDDFSNVG KKVYKNDELIYKGD | 103 | hypothetical protein KgORF113 [Staphylococcus phage K] | YP_024541.1 | 2e-51 (102/103) | | No putative conserved domains have been detected | | |
| 63 | 27285 | 27584 | 1138 | MKQFIHDKKDSYNSTNRN FDIQYYKGIPLQQIDRGYG QARARRFTINNTNQNIWIP MTYLKPNGTLKNNIDIDW ILVKEKCSLKKAGLVIKIK | 99 | hypothetical protein KgORF114 [Staphylococcus phage K] | YP_024542.1 | 2e-50 (98/99) | | No putative conserved domains have been detected | | |

FIG. 14P

Table 11 - Features of phage FI25/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | ITGDVL | | | | | | | | |
| 64 | 27584 | 27823 | 1139 | MYILERTIRGFAGQTEDIL PYYFKSKKEIVNFLKLME FLKEETNYWVKKNGNYTI IIRAKRILYIEEHIQKLKEW ENDL | 79 | No significant similarity found. | | | | No putative conserved domains have been detected | | |
| 65 | 27813 | 27968 | 1140 | MTYDVYVLYKRGEPIAQ GSMEHCLDVYYWERVHG YSNKGYELLPMGYEQEE | 51 | No significant similarity found. | | | | No putative conserved domains have been detected | | |
| 66 | 27972 | 28166 | 1141 | MINIEHDYTIRTVDNRKY TYYSKHESPVTLYKNIIGK DCIEVTKYGKDKKVIIAT KYIVSIERW | 64 | gp ORF179 [Staphylococcus phage A5W] | ACB89172.1 | 5e-23 (55/64) | | No putative conserved domains have been detected | | |
| 67 | 28184 | 28537 | 1142 | MNARKARKNTKNYKDSN VVTKEQHLTYIYNKLNYL IANNSSQGKTYVVMNLRT DYPDEFSLSKLKYLKEIKQ HYKDLVFNVKTQVRKAQ WSEKSIIRYYFNLGYIDSV LVPIIHISW | 117 | hypothetical protein KgORF115 [Staphylococcus phage K] | YP_024543.1 | 3e-58 (110/117) | | No putative conserved domains have been detected | | |
| 68a | 28556 | 28744 | 1143 | MFFKKKLSNVEKQIRQN RNKEDKERKEHQDKLDT DMYKTYELDKIVEEHLRK LNTISLEEL | 62 | hypothetical protein KgORF116 [Staphylococcus phage K] | YP_024544.1 | 8e-24 (58/62) | | No putative conserved domains have been detected | | |
| 68b | 28754 | 28942 | 1144 | VCLGTRLVYYSIGKDW NKQVYSLNELEYMKKKF KKLGFETQITNEDIGFQPY IYLRLLWDA | 62 | | | 7e-29 (61/62) | | | | |

FIG. 14Q

Table 11 - Features of phage F125/10 gene products and assignment of putative functions.

| orf | Start position | Stop Position | SEQ ID NO. | Aminoacidic sequence | Size (aa) | Name[organism] | Acc No | E value and identity | Predicted function | Name | Acc No | E value |
|---|---|---|---|---|---|---|---|---|---|---|---|---|
| | | | | | | Homologous/similar proteins ||| | Conserved Domains |||
| 69 | 29627 | 29788 | 1145 | MNLTFEDKLEDLLKKVRS GEIEPIEYSQVNDEHPNGK TTCGVTFKFDIDTPTK | 53 | No significant similarity found. | | | | No putative conserved domains have been detected | | |
| 70 | 29883 | 30188 | 1146 | MIILFTQDYDKTLMKVIL GDINTMRPNWKYSVNHP EKEEDVHIQAYEGEDIFD DIEELSDSTQDIVGVTED DCISESPYDFNGGLRLVTK HIKEHEKFL | 101 | No significant similarity found. | | | | No putative conserved domains have been detected | | |
| 71 | 30200 | 30499 | 1147 | MIDIYLGEGYNKEYLSKA LRLINDHAPRELSYDFNN VEADVNIHTMLYVKPEDR YVYKDISYDFPGDLIICIVE DDAIVYHQGKQVSGISILR IIEELI | 99 | gp ORF182 [Staphylococcus phage A5W] | ACB89175.1 | 5e-47 (91/98) | | No putative conserved domains have been detected | | |
| 72 | 30596 | 30889 | 1148 | MIEYLSENYDKDLLKAE LKWIKETASRELTYDVNR NPNLDVHVSPFRYTKDEV KEISLHPQFEDDVCVFIAE TWIHEYHRGKSIGVDSME EYVKEM | 97 | gp ORF185 [Staphylococcus phage A5W] | ACB89178.1 | 5e-39 (80/97) | | No putative conserved domains have been detected | | |
| 73 | 30892 | 31149 | 1149 | MFKVYTVYHKGSMKTI KDKLDRSSLIYFLYDTWY KDISNVFPNHYNKEFGSN SDDIDKLIEAVNEEGILL INRGNYVTREW | 85 | ORF175 [Staphylococcus phage G1] | YP_241027.1 | 6e-41 (83/85) | | No putative conserved domains have been detected | | |
| 74 | 31267 | 31506 | 1150 | MVTLTYTIIHKESDRVIAS GLDELEVINLVQRMVNTN LVTDISLDDYIRRPSGDID VLNLLVDIRRQGVFDFNH | 79 | gp ORF187 [Staphylococcus phage A5W] | ACB89180.1 | 4e-32 (69/79) | | No putative conserved domains have been detected | | |

FIG. 14R

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | TWHVG | | | | | | | | |
| 75 | 31517 | 31864 | 1151 | MIVIYTDVSKDYLKDEFL PWLNERDRYLEDYKDELP EDIDSSYIVSVVYCKDME GLLERKDIVIGNSYNEPVA LLGVPEFFGNYSNYFYYR GESISKHDLGEIVRLKAW QRMGGD | 115 | hypothetical protein KgORF118 [Staphylococcus phage K | YP_024546.1 | 1e-57 (112/115) | | No putative conserved domains have been detected | | |
| 76 | 32761 | 32069 | 1152 | MKHNINNIEMFSKYYIKE NKVYSKKTNKELKKDKN NFYRMTDDINKARKVKID TLLQYNLKDYNSINNLPN EKWKRIENNINNIFNYSVS NYGRIKRHGNYYMIEKLV KPHNHKQGYKIVKINYKH HSIHRLVYEYFGNDFNQD YHIHHIDGNKQNNHINNL QCISPTEHNNLHHKDETIN NFKRGKSLTDNERKNIYK LYTEKGFTQEELSNMYNV SRITINRNIKRFK | 230 | ORF085 [Staphylococcus phage G1] | YP_241035.1 | 3e-37 (83/165) | | HNHc, HNH nucleases | Smart00 507 | 5.48e-03 |
| | | | | | | | | | | Sigma 70_r4 | pfam04 545 | 6.44e-03 |
| 77 | 32902 | 33210 | 1153 | MEIKEIADTIMYLFNMDG YRCAEPPLYESTLNHTRT HTALIVSIKGNYDTVQMF RKTPIMSMRGQSQPASML VNVIDDVIIIVYENVVYGV QNKEIKFIEEI | 102 | ORF145 [Staphylococcus phage G1] | YP_241031.1 | 9e-49 (94/102) | | No putative conserved domains have been detected | | |

FIG. 14S

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 78 | 33417 | 33704 | 1154 | MTNKNYLYEETHTVQGQDITAFRIPNDTNGNPRYVVHFMDLNIKLADYDNINKLYGFNKYRAKWFGGGVVFQSYNIEDTLNFALDKVKEIEAVKN | 95 | ORF159 [Staphylococcus phage G1] | YP_241032.1 | 2e-39 (78/88) | | No putative conserved domains have been detected | | |
| 79 | 33754 | 34026 | 1155 | MILEIETKPVKTLKAIKDDTKNIKNSIAEHLGLNREQFKLSNGLITLKGYSEEFKCWYNLTSTIGNFPKYLKSELYNEYKLYCNVELKTK | 90 | No significant similarity found. | | | | No putative conserved domains have been detected | | |
| 80 | 34550 | 34708 | 1156 | MLKFKWKNKTIKSTQKTDNILLIGGLVATITPKLVNWFLLLQDNINIFLR | 52 | No significant similarity found. | | | | No putative conserved domains have been detected | | |
| 81 | 34875 | 35255 | 1157 | MFKLQNKVEIIVPKEDNNGVEIADKRIKEYVNSITMEAGGCTITEIKGQWYSEDEKRIMEDNNLNLEWYYIPDRAKFMTVELKGIVRRLIEVYGQEAISIKVNGTLYIVDQSDIEELHTTLLNIMK | 126 | No significant similarity found. | | | | No putative conserved domains have been detected | | |
| 82 | 35747 | 35968 | 1158 | MNRLEIVKDTAMEYILMMDNSVMDGVMTQEEYNEAVSFEKVYDYTLSEANKECKFLGGKVLTFLVHEAIEEYA | 73 | No significant similarity found. | | | | No putative conserved domains have been detected | | |
| 83 | 36049 | 36186 | 1159 | MRYEIVTLVNQELFMYATFNKQEAEAKYSEWCELYGQENVSMEKN | 45 | No significant similarity found. | | | | No putative conserved domains have been detected | | |

FIG. 14T

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 84 | 36215 | 36493 | 1160 | MIILNYTKEKEMIQMKLL NQENQIVISIATLESVKQA LIWEYIDHIDYNIWNNEL DDTEAVVKISGILQSIKFA DTMEDLQEYIGDIGWKLI | 92 | gp ORF194 [Staphylococcus phage A5W] | ACB89187.1 | 3e-24 (56/78) | | No putative conserved domains have been detected | | |
| 85 | 36584 | 36823 | 1161 | MKKNVKASTIEWLELTQ GHGFFDGFFDEEDMDFRK LDDEDIKWYFENWYFTEE KQEQIIDEIGQEEFEEAYS DDIKEYNN | 79 | No significant similarity found. | | | | No putative conserved domains have been detected | | |
| 86 | 36898 | 37158 | 1162 | MTKFKLIDKNSFYVNDNY NNETYLTSQIVLSGEAGR LLDDMIEDCEDEHDKDN YKKLDTNNIDDIDYILECA NVYIYPYNKTEFKY | 86 | No significant similarity found. | | | | No putative conserved domains have been detected | | |
| 87 | 37176 | 37349 | 1163 | MNTRRANKALNEAVRLL DKQIEDTQKTMQELNKQL EQQIKAKQELMTLVDVM TGDDE | 57 | gp ORF002 [Staphylococcus phage A5W] | ACB88993.1 | 2e-19 (50/57) | | No putative conserved domains have been detected | | |
| 88 | 37349 | 37618 | 1164 | MNIKEAHKVVRSAKSKLL QEQEHITNHIIEDYIIEELH RRTQGSGTIQMNNNTASY SNGSYGSLEELREAYDLS SLSTGEIKELLETFV | 89 | ORF166 [Staphylococcus phage G1] | YP_241041.1 | 2e-33 (71/89) | | No putative conserved domains have been detected | | |
| 89 | 37720 | 37971 | 1165 | MKEQIKQFEKELEMAVN NLFVLHDCGVSQAKIEEQ NQKVVYLKAIVENMKAY EEIRVEPKSEEQFFKELEE ELEEEEKILKGI | 83 | No significant similarity found. | | | | No putative conserved domains have been detected | | |

FIG. 14U

Table 11 - Features of phage F125/10 gene products and assignment of putative functions.

| orf | Start position | Stop Position | SEQ ID NO. | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| 90 | 38522 | 38259 | 1166 | MKLYQVEHDNCEPYEDN YSYREDKVYTNKENLIKR IKAEGYEEKISGYLQDGY TYYYKDNIEDVPLFREDM ITIHELEVINNTSEEE | 87 | gp ORF004 [Staphylococcus phage A5W] | ACB88995.1 | 5e-19 (52/83) | | PRK14902, 16S rRNA methyltransf erase B | PRK14 902 | 6,40e-03 |
| 91 | 38955 | 38524 | 1167 | MENYKNFIIEEMNKAHIL VTKAEQIKGDRKLAETEL EEVYRKAEAFDEIVNELL YQLQNLESWDTLDQKDC QTLKQILEENKEEKQME RFKVKRIITTEEVRYIDAE TEEDAWYSVEYEDEGTD TAHFSAEYGEWSYEREDN | 143 | ORF103 [Staphylococcus phage G1] | YP_241047.1 | 1e-67 (129/142) | | No putative conserved domains have been detected | | |
| 92 | 39149 | 38958 | 1168 | MIEISISWTYLITFLLLWSA GTLYINYLVYRIRLTNKER KEMSKEHHRNREEIKQRI ENRRDK | 63 | ORF224 [Staphylococcus phage G1] | YP_241048.1 | 1e-26 (61/63) | | No putative conserved domains have been detected | | |
| 93 | 39394 | 39146 | 1169 | MRYDINEKCYDEKDFVL QIIYENYSDETIDREVETIY NKAEAWDKLCEMLKDK DMSDGHFEEEMFKLFSRT GKSFTIDKEESQ | 82 | No significant similarity found. | | | | No putative conserved domains have been detected | | |
| 94 | 39876 | 39394 | 1170 | MNKTFFKFLGKNTLEYSK QGLGFLVALPIMLIIFSVFL AFIIGIPAVIIYALHALNID NDFIIQLVPVMWFIILYGI VRTDEHKKPFVKLKLKD YLLSILYLTTITAISVLESY LLFQLLPFTGDVRAVITLL SFIVFVAVNRGICKIAIKSY | 160 | ORF087 [Staphylococcus phage G1] | YP_241049.1 | 5e-81 (153/159) | | No putative conserved domains have been detected | | |

FIG. 14V

Table 11 - Features of phage F125/10 gene products and assignment of putative functions.

| orf | Start position | Stop Position | SEQ ID NO. | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| | | | | KEYKEEL | | | | | | | | |
| 95 | 40300 | 39869 | 1171 | MNIKYIDLVLENCDVVRL ESKDVSRFHISGITEGIDY YGTYKETSNISRTRHCTYF GILIDKPMEIPQVGFAYPD NTNAYEMTAYSDITAIDII YENDANEYIYVDFNEYND NYNINQKNDYYNNMLEIT ITESNSREEEDE | 143 | hypothetical protein KgORF2 [Staphylococcus phage K] | YP_024433.1 | 7e-74 (139/143) | | No putative conserved domains have been detected | | |
| 96 | 40856 | 40314 | 1172 | MDKINLNKKHDGSTVVNI SNNIMLKIQCTDLRKECD DSEAPTTYTHFKAYIVYNI FIVVNDRKQKKKVKYDY YNDHVGRGNVKDLLKVK DVIFQLSTQLNTNEIIKISG ADERRYKIYKYFIEKDIRF EDNMYYSKSNIWIINNFSL LQKFQWNTVVTKDGDYN KKELKKVDKEWKELLI | 180 | ORF073 [Staphylococcus phage G1] | YP_241051.1 | 8e-96 (177/180) | | No putative conserved domains have been detected | | |
| 97 | 41356 | 40868 | 1173 | MRETSEYIMFWGKEDIYS NFYPIKFKHQGRTFNNSE QAFMWRKARYFNDFQIA GEILNAKNPNHAKSLGRK VRNFNEEQWNKVRYDIM VEVVKDKFMTTHLKQRIL DTDVRKDFVEASPYDKIW GVGLKANDPKILEQSNW KGQNLLGKVMEDVRVHC IYNK | 162 | hypothetical protein KgORF4 [Staphylococcus phage K] | YP_024435.1 | 2e-90 (160/162) | | Ribofla_fusion, conserved hypothetical protein, ribA/ribD-fused | TIGR02 464 | 2.28e-60 |
| 98 | 41767 | 41369 | 1174 | MKKKYFKGLKLNDFEKE VFGLKKNKKYKKMKKKL | 132 | hypothetical protein KgORF5 | YP_024436.1 | 8e-69 | | No putative conserved domains | | |

FIG. 14W

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | GRNEPKYWNYDMSFFIQL YADLNAFVESSNHVDME YHTFVDVDGKERTQIDMI KHILSLIKYYHKEMDDFD MDKYDELEQVQSKILDNF KIVLPSLWN | | [Staphylococcus phage K] | | (130/132) | | have been detected | | |
| 99 | 42471 | 41764 | 1175 | MAIYVVPDIHGEYQKLLTI MDKINNERKPEETIVFLG DYVDRGKRSKDVVNYIF DLMSNDDNVVTLLGNHD DEFYNIMENVDRLSIYDIE WLSRYCIETLNSYGVSTV TLKYSSVEENLRNNYDFI KSELKKLKESDDYRKFKI LMVNCRKYYKEDKYIFSH SGGVSWKPVEEQTIDQLI WSRDFQPRKDGFTYVCG HTPTDSGEVEINGDILMC DVGAVFRNIDFPFIKLEVK K | 235 | putative protein phosphatase [Staphylococcus phage K] | YP_024437.1 | 5e-134 (234/235) | Phosphatase | MPP_PPP_ family, phospho protein phosphatases of the metallo- phosphatase superfamily, metallo- phosphatase domain | cd0014 4 | 6,21e-23 |
| 100 | 44413 | 42563 | 1176 | MTKKLKLYDYENNLLKS SENIEDSIGQIVIENLNPDT TYEAGHFKICWDINGEESI KVDIPKFVTLTSSQDKLII VTYNEVEPMNIKAENIIGL QDVIDTQFNDHIKEEFMA EINKLIADNKPTQQPSTTTI SPLKDKKVIFIGDSITEVN ARTTKNYHQFIADRTGLI NVNKGTSGTGYQDRKNV AYTITDKPDLICVMLGTN DYGLVGGKTKPLGTAKE HSYTTVAGSIYYTYQLS KVFPTVPIVVLTPTPRIESN | 616 | lipase/acylhydrolase domain protein [Staphylococcus epidermidis RP62A phage SP-beta] | AAW54968.1 | 2e-149 (277/503) | Hydrolase | SGNH_ hydrolase_ like 2, SGNH_ hydrolase subfamily | cd0183 4 | 2,31e-08 |

FIG. 14X

Table 11 - Features of phage F125/10 gene products and assignment of putative functions.

| orf | Start position | Stop Position | SEQ ID NO. | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | PFKEVENGQGYTLGQLVD VIKEIAKQFSFPVLDLYRE SNIRVWDNNVNKTFFAW KEGMEDGLHPNAKGHEFI SYTIQSFLESKGTVGAIAS PPSIDTSVKDLGNGVYSK LIRPTGMRWKKDTSFVM NMSTDDIDLTANKILNVS YNGKSLNPEGYTSNSPY WYTLPAYEDGNKYNRISE VQNFLNAFITIDDNAQGL EFMRDYIKVIYVDKTKTN IVGEYTQVGYKDTTASTP PTGDTSGTITPVSNGDGTY TATFTPTAIYWKEDQSFMI NIDKTKLDLTGKSVTKLE YNGKTLVNNTSLASNSPY WLTVPTATEGTTNNRTPE VKDFVSVLTLESTGTDGR KKYKNVEIKLTYK | | | | | | | | |
| 101 | 45043 | 44972 | 1177 | GGACUCUUAGCUUAAAG GUAAAGCCAACCGCUCA UAACGGUUGACUGUA GGUUCGAGUCCUGCAGA GUCCA | | | | | tRNA4-Met | | | |
| 102 | 45871 | 45323 | 1178 | MEKIYILEEIEEMDYDL WEEDTVYTTSYEVLGYT DSLEDAEYIRDNYGTSNPI FINEYPYLTKEKLIEEQRY FRYNSYLELKRVNGYFEIS EINELHVTEDFSINKDDKN FDSPFSINMFSHNRNSIGIE FIMFSEYNDKEDIIEKEKN SFLMKLKYLLKHSREADI | 182 | hypothetical protein KgORF8 [Staphylococcus phage K] | YP_024439.1 | 4e-88 (162/169) | | PHA02241, hypothetical protein | PHA02 241 | 1.20e-23 |

FIG. 14Y

Table 11 - Features of phage F125/10 gene products and assignment of putative functions.

| orf | Start position | Stop Position | SEQ ID NO. | Aminoacidic sequence | Size (aa) | Name[organism] | Acc No | E value and identity | Predicted function | Name | Acc No | E value |
|---|---|---|---|---|---|---|---|---|---|---|---|---|
| | | | | RSTSKIIDSIDKLT | | | | | | | | |
| 103 | 46093 | 45875 | 1179 | MKNIINFLVDYNINFSYSE DSLNVMNNSYLVDKHGT QDYEIVGNYEHTGVFSY QTEEEVIAKLKNLIGIWE | 72 | ORF201 [Staphylococcus phage G1] | YP_241058.1 | 4e-33 (71/72) | | No putative conserved domains have been detected | | |
| 104 | 46288 | 46094 | 1180 | MRDKRIHSELLYDIIGKHI QEEENITPYIEAIYVDMM NIIVVEYTFYNENGTRML GQYPIGEVM | 64 | ORF218 [Staphylococcus phage G1] | YP_241059.1 | 8e-29 (64/64) | | No putative conserved domains have been detected | | |
| 105 | 47015 | 46278 | 1181 | MNLEKSFLLSTIEFGSTYQ GTSDEHSDKDYMSLVVQ PLSDTIFRNNEKASKIITEV SRYYAVERHSLVLKSGFD NVLNLCAQLEQAKNTRF NKTVLDLFYDDFIFLTYV RANFKPIAYSVIGNINNIL KKGELTGKDLVKFYTFYN HLEYNDLLDDLDNLNV SYKDFAKVKYMPKEVLD NKRSNVSIEKKKDLVNKV EPLIQEVKDKLKYNESNIK HYKDAMELVEKSLKDKT VAFLTEVYNER | 245 | hypothetical protein KgORF9 [Staphylococcus phage K] | YP_024440.1 | 2e-135 (243/245) | | No putative conserved domains have been detected | | |
| 106 | 47182 | 47078 | 1182 | MKYILGLITLGIILFKVYE HFKYKQDEVDTEEDI | 34 | ORF437 [Staphylococcus phage G1] | YP_241061.1 | 4e-10 (34/34) | | No putative conserved domains have been detected | | |
| 107 | 47442 | 47194 | 1183 | MSNMDFYQFLNHENVRV NSITPSQKNFIRENLELTN LEDTDIDFISSKKAKEEIEK IIRIKNEEEYDMAMDALA | 82 | gp ORF020 [Staphylococcus phage A5W] | ACB89011.1 | 6e-40 (80/82) | | No putative conserved domains have been detected | | |

FIG. 14Z

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | GWVTKHGY | | | | | | | | |
| 108 | 47824 | 47435 | 1184 | MFKKAPQYIMEKVEKEN NILGEDLSLDIYYKGVKLT VKRHPETGHLNGYITLPS DINEKEYDSLERRAHRGIT YDDYDYEGKRVLGFDCA HAWDMTPYAIIGSLDDQY RDLEYVLSILKDMAEYVK KDE | 129 | hypothetical protein KgORF10 [Staphylococcus phage K] | YP_024441.1 | 2e-69 (129/129) | | No putative conserved domains have been detected | | |
| 109 | 48096 | 47923 | 1185 | MEKVNHEFLAELAKSNSP VLNSKPLQDGDYNIEFDY DGFHFEFSQKNGYWQWK YNAK | 57 | ORF245 [Staphylococcus phage G1] | YP_241064.1 | 7e-25 (55/57) | | No putative conserved domains have been detected | | |
| 110 | 48619 | 48137 | 1186 | MANEKEIIRMVNYLIDNM SMWHINYARAVLIPSEVE KIIKEHEKFDDLLKKRGE WLVKGSDTDNIDDLETYN QIMNNQKDEMMIQEIDIY TQGKTITIDNEHYSSDDLN EVLNKLEQSEDIKIKSNYK SLYVGYTNVVGYEVTYA SSYEETFKNDLEKDL | 160 | hypothetical protein KgORF11 [Staphylococcus phage K] | YP_024442.1 | 2e-85 (159/160) | | PHA02243, hypothetical protein | PHA02 243 | 2,31e-36 |
| 111 | 49211 | 48669 | 1187 | MDRIIGKHNLTQDLRLGD KVEVYDAHKFKENEDGTI ELGDKITEGIVVDYKGDF TGNTSGLVTLDSSEKELII GEYNFKLIEEGNLQAVYD SVSKNKVESLSEDYDMYR KLLGVKSGELAGIEDELE YLVRQYNSKVDNYNGLL TLSKEKARELSLLTGNKK | 180 | hypothetical protein KgORF12 [Staphylococcus phage K] | YP_024443.1 | 1e-94 (177/180) | | No putative conserved domains have been detected | | |

FIG. 14AA

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name [organism] | Acc No | E value and identity | Predicted function | Name | Acc No | E value |
| | | | | TIPHMKNRRLELGKEADF | | | | | | | | |
| 112 | 49744 | 49211 | 1188 | MVYDSIISRTMAVSILNK WIAELITDVDLDKCKFTE EEYGKVVTNSINKIQDVLI EKNYEVTDGELYDIVCTE LINPIKNNTEEEKHNEKND LLEHLEDLAFRHDIDLGY VSDGSYNLTVTHWLMQD EFTDVNIKVNNDEDFYTV TIPESKYFWLPITKENLEM FLTQDPINKGEVK | 177 | hypothetical protein KgORF13 [Staphylococcus phage K] | YP_024444.1 | 4e-97 (177/177) | | No putative conserved domains have been detected | | |
| 113 | 49911 | 49747 | 1189 | MKNPIKLLSIAVVTILTFSL TYVILKKETNNKRNGVAP FDFSLEDHIHLNKEIK | 54 | hypothetical membrane protein MbpP [Staphylococcus phage A5W] | ACB89017.1 | 2e-22 (54/54) | Membrane protein MbpP | No putative conserved domains have been detected | | |
| 114 | 50192 | 49914 | 1190 | MANNIWAVVLSIIILLJILLI LWFLFRKKVNGGNSKNV EIQKAEENNDNKEQEVEE AQYRELNEEEKEKNENSS KDYKYDKEKVKNKLKEL E | 92 | hypothetical membrane protein MbpR [Staphylococcus phage A5W] | ACB89018.1 | 2e-41 (92/92) | Membrane protein MbpR | No putative conserved domains have been detected | | |
| 115 | 51037 | 50192 | 1191 | MGRRLIDNSELNVIKYDG LPDFFSALKKNRVSGRDN SSDTGSYDFTGTHSFQEA YNLMVKGDRESYDMVV KLKKMTDALFRMDKSVK RKPVVAPEGYQPHVPNAI KGLPNSMMSQQRVKAEK KVIDVFYNSSISWREDPEN LAYRGAIMLSAIQTLETK GYSINLYLGKLSNSGYED | 281 | hypothetical protein KgORF14 [Staphylococcus phage K] | YP_024445.1 | 8e-161 (280/281) | | No putative conserved domains have been detected | | |

FIG. 14BB

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| | | | | KLTGFVVNIKHSYQRLNV FKSSFYLVNPSFLRRISFR VLEVEPDMVDLTNHGYG SVVSKSSYGNKLTEHILD NAVIFDSSVGIDINNDSSE NLRAVKKLFGGRL | | | | | | | | |
| 116 | 52167 | 51049 | 1192 | MAKQDTIERLERLVEQQ METTADLAKKLGEKNSN PYEQAIVDAIVEKAGTESR EIIITDVKKQIEEYVEEQLS NLPVKIELQQEGKTIKDIS GITHYRYQDILKLVNQNIP VFLKGGAGSGKNHVLEQ VAEALDLDFYFSNAITQEF KLTGFIDANGKFHETQFY KAFTKGGLFFLDEMDASI PEVLLILNSAIANKYFDFPI GRVTAHEDFRVVSAGNT MGTGADHIYVGRQQLDG ATLDRFAQVEFDYDTKVE HQLSSNEDLVNFVQQLRH ENDEKGLPYVFSMRAIIN GSKLDGVMEDEFVVESIIF KSVPKDEINQFISSLPEGN RYTEATRKLLGMQQEPK QEPRKSDSTSKDSMDFDTI MDKLGLE | 372 | putative ATPase [Staphylococcus phage K] | YP_024446.1 | 9e-110 (194/194) | ATPase | PHA02244, ATPase-like protein | PHA02244 | 1,23e-175 |
| 117 | 52645 | 52319 | 1193 | VSKRTDNFIYFCKYYFSE YLPSLGVEVLNHNETSHG TMEGVKKYYIANILYEGQ ELTVTIDLEEFNNATSMH NMLEIMNNHTYNCMFMY DMDTHETKDIDDFFKLM | 108 | ORF134 [Staphylococcus phage G1] | YP_241072.1 | 6e-56 (106/108) | | No putative conserved domains have been detected | | |

FIG. 14CC

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | YF | | | | | | | | |
| 118 | 53054 | 52638 | 1194 | MNAKEFMKTQAQVEDYL DKLKVTIEDALSVSKEWS NDSNDLGYALSSLGESIGL LENYYNIQVDAHLPEHYK GSKDVISFLEEHFSYDGFV DSMIFNIVKYTTRLGRKD AVDKEVQKIKTYYVRLER NIKYGDSTRV | 138 | hypothetical protein KgORF16 [Staphylococcus phage K] | YP_024447.1 | 7e-74 (137/138) | | No putative conserved domains have been detected | | |
| 119 | 53488 | 53186 | 1195 | MEKVELIKQWAKDRNLQ TGKPEGQMLKLLEEAGEL ASGIAKSNDHVTRDSVGD IFVVLTVLCLQLDIDIEECI DMAYDEIKDRKGKLNGV FVKEEDLKK | 100 | hypothetical protein KgORF17 [Staphylococcus phage K] | YP_024448.1 | 9e-50 (100/100) | Pyrophospho -hydrolase | MazG | pfam03 819 | 7,10e-03 |
| 120 | 53676 | 53488 | 1196 | MEKFQEDYVNIDIRVKAY VRVGYRYEEDITNNLHEL VEDNLNVTSDSDSLIIKDT EIKGDIE | 62 | ORF228 [Staphylococcus phage G1] | YP_241075.1 | 5e-26 (61/62) | | No putative conserved domains have been detected | | |
| 121 | 53881 | 53720 | 1197 | MVKPVITLEPEDVKVLLD YLSFLEDDMRNYEGMRE LYEFLHKKYQLAKGNYS D | 53 | ORF259 [Staphylococcus phage G1] | YP_241076.1 | 4e-22 (53/53) | | No putative conserved domains have been detected | | |
| 122 | 55932 | 53881 | 1198 | MAITYKQKGLTEQEIINLP KVNKGCIYIGEEDVFLKK KKNNIINLGSKELFRDIHN IFSFDTATEIHLFLALCGN KEVTNFTGNPYETIEKLVE GVIEENKGRSYKEYIASSR EERKEFPLYGSKRITQIKS | 683 | hypothetical protein KgORF18 [Staphylococcus phage K] | YP_024449.1 | 0,0 (591/683) | | No putative conserved domains have been detected | | |

FIG. 14DD

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Name | Acc No | E value |
| | | | | KGYVEEKIKELENETRLR WYESRQLDEYKEVVDSL NNDIMDILYQGKYGLIKS SITSRLNEDTEKGSSKYYK EISDSLYSSTWYMHPSTE NSSSFGLKVRHIRDKYNM GNRWVLENKSSFDVKTG EVKVFLTDSLVNKEITLNL YKDDISKSEYKNELNLAV LLNVILKNYSTPNLSKNVI IKIIEETLRNDGFGLSSWC LDEVDVYGRVNYGGNKY KPLKGENSTSNYLTILTDI VKNIDKINNLEEFELFERN SLLFHIPKNPKWKIHEAFN LTKQTYKKLLTLNNFEQS NYLRFSDTLYNYYNHLH NEVNLHQLFDDTFLMVQ DVRNVTDALKVKPIVNEI LSISFANYKKMTHYLDVD AQDRQRITGYALDSYYLD YLHDLSILIREGYRTLESV NLTPFSLKLEHDIVTDEKQ SIQQQLDDAELKSKYENK LEKIIDKTYKLKDGRKVK FLPADTVSKLKNEGKMLS HCVGGYANRIIKNSCLILL ARLEEDLDNSWFTVEIRIT DNGYVLGQQQSIDAYKLP NELKEALEKDIKKINKEEF KEVA | | | | | | | |
| 123 | 56273 | 56010 | 1199 | MSIEKKEEVVAHNEVVFK SLTQGLYVKEVDIYSDVIS YTKDIDEALAMPNTNFK NSRKYEKLIRNLDLKPLN | 87 | gp ORF038 [Staphylococcus phage A5W] | ACB89029.1 | 5e-39 (79/87) | No putative conserved domains have been detected | | |

FIG. 14EE

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | KIQKVIYETHLEEL | | | | | | | | |
| 124 | 56465 | 56292 | 1200 | LNDLIKEGNKYYHKVRA GETLWTISKNYGVDIKKL QELNNIKSVTLTSLEYVLV CVE | 57 | gp ORF039 [Staphylococcus phage A5W] | ACB89030.1 | 1e-21 (52/57) | Peptidoglycan binding protein | LysM | pfam01476 | 8.09e-07 |
| 125 | 57050 | 56472 | 1201 | MDNLSHYLSILYAILVTV GYIPGLIALVKSDSVKGVS SYFWYLIVATVGISFYNLL ITDATMFQVVSVGVNLTL GIVCLLVASYRKKDYFSIP FIIVFSVLLFLLSDFTALTQ TIATTIILAYVTQTTFYK TKSAEGTNRFLFLIIGLGL ASLILSMVLSHTYVHIIAT EFVNFVLILICYLQANYYS RR | 192 | gp ORF040 [Staphylococcus phage A5W] | ACB89031.1 | 5e-92 (177/192) | | PHA02246, hypothetical protein | PHA02246 | 2.51e-33 |
| 126 | 57636 | 57043 | 1202 | MVNYTKDKVCYMGGIIL LNQAMVEYRTKQHEQVE GIVGVTPYSPHQDKSIND KANAEQTGLAERILNNDF KAMQESDIFVFDILNEGL GTIAELGILLGMKHQAQK IIDKYEDIDFRDLEPLTQY DILEAYNIVNKPVLIYCSD IRQGHGKGYDDPDRAEFS TNQFIYGCVLSLTNGEGFI SWEEVLKRLEKLGGQDG | 197 | hypothetical protein KgORF20 [Staphylococcus phage K] | YP_024451.1 | 8e-79 (153/210) | | No putative conserved domains have been detected | | |
| 127 | 58522 | 57629 | 1203 | MKSYTKVKNKGLSLDKF KDRGFVVQEKLDGSNASF TTENGELVCFSRRKKLNE NETLNGFYNWVHENMTD | 297 | putative DNA ligase [Staphylococcus phage K] | YP_024452.1 | 8e-134 (237/298) | DNA ligase | RNA_lig_RNL2, RNA ligase, Rnl2 | TIGR02307 | 1.21e-07 |

FIG. 14FF

Table 11 - Features of phage F125/10 gene products and assignment of putative functions.

| orf | Start position | Stop Position | SEQ ID NO. | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | KLDLSILEGIIIFGEWLVKH KVNYKEECYNNFYVFDV YDKDSETYLPYSEVISLSE TLGLKTVKTLMIIEPSFYL NKLNPQEIQDLVGKSDMT VKPNTGEGIVIKYLDGKS EHDDYFKLVSKEFKEFSR KKMKSEVRSNDSVADYAI TKSRMEKMIFRAIEENRLS KDDLELENFGLIMKQVGQ NFVDDIMEEEKENMMKII EKQIKKKMPHILRGILEEK GDTIDG | | | | | family | | |
| 128 | 58750 | 58526 | 1204 | MNYLAKVFINNNWLVKLI TIVLTLLLGGLVYVISAV ALFLSTVLNLPGLVVLAF LASVSLILFSIVHNSKEDN | 74 | No significant similarity found. | | | | No putative conserved domains have been detected | | |
| 129 | 59558 | 58818 | 1205 | MAIQLKELDFKLKDYPNV RYNMGEHLVFNEFLEKAT TEQLDFCEDFFNDNVEIL WNESQAGTGKTMCSVAC AYADYLNKDRKLVFIISP VSEDLGSRPGNQTEKEMA YFMGLHDALIELNMNPEQ QITEMLMMEDNVKEDKL GDCWVSQISHLFLRGGNL RDSTIIINEAQNFKRSELK KVLTRVHTKNSTVIVEGN FKQIDLKNESKSGFGDYM EYFKKYDGAVFHNFTVNF RSKLAQYADNFKW | 246 | putative PhoH-related protein [Staphylococcus phage K] | YP_024453.1 | 4e-142 (242/246) | ATPase | PhoH-like protein | pfam02562 | 3.99e-21 |

FIG. 14GG

Table 11 - Features of phage F125/10 gene products and assignment of putative functions

| orf | Start position | Stop Position | SEQ ID NO. | Aminoacidic sequence | Size (aa) | Name[organism] | Acc No | E value and identity | Predicted function | Name | Acc No | E value |
|---|---|---|---|---|---|---|---|---|---|---|---|---|
| 130 | 60224 | 59610 | 1206 | MKKINSVIKGEGKKVQTT DVRKISYYVKDYNPCMT VDDANDYNSTSQYLVSD NGKFIAKYNKDMNAVGF YEESGDTVKHLTHTTPER LEGTVFTIEEETKIDLINDT LPQGDILIKFSDGSIYLPDN ESVLDSVNYLADNDWDS VDDIIYTGLSKGNSENCIV DFNYNNYDIGYDDVEDEE VCDNYPECECSNYCSSTG EYIGN | 204 | hypothetical protein KgORF23 [Staphylococcus phage K] | YP_024454.1 | 3e-111 (200/204) | | PHA02248, hypothetical protein | PHA02 248 | 2,68e-96 |
| 131 | 60665 | 60240 | 1207 | MQDSVNIYTDGSSSYNKG KVGSGAVLVSKEGNIIAEI SKSVDKPGLIKYNNVAGE ILACCYGIEEAIKLGYNQA IVYIDYIGLIHWYEGTWSA RNILSKTYINMIREYQKVI DINFVKVKSHSNDKWND YADNLAKKSIDI | 141 | putative ribonuclease [Staphylococcus phage K] | YP_024455.1 | 1e-73 (140/141) | Ribonuclease | RNase_HI_bacteria_HB D | cd0927 7 | 8,50e-30 |
| 132 | 60846 | 60655 | 1208 | MKKGVFTVIADGFKFNVI AKDKKEVQEHCFKCFDF NYISVSFCREVYSDCEFPQ FMEDYKYAG | 63 | ORF222 [Staphylococcus phage G1] | YP_241086.1 | 2e-28 (63/63) | | No putative conserved domains have been detected | | |
| 133 | 61510 | 60869 | 1209 | MENNNLVNFLMTTDDID DTHEMVDSFELQDINKVL GEDTFLTIMEITDSLPDNQ YKIVLSSLDKLLNTDRK ELVEYDEEFPTIRKHNVSE LKRDTVNSVIDSYMNTNV EILYTEYPTISNYSVVVDS VKVLNTLYLIESKNGKIEA | 213 | hypothetical protein KgORF25 [Staphylococcus phage K] | YP_024456.1 | 7e-113 (213/213) | | No putative conserved domains have been detected | | |

FIG. 14HH

Table 11 - Features of phage F125/10 gene products and assignment of putative functions.

| orf | Start position | Stop Position | SEQ ID NO. | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | TLSEDGEDLHEYISEEGYS VTDILNKFDDVEDLFDED DSLINFFSDIDEGKNKTIKS FIELVINLK | | | | | | | | |
| 134 | 61730 | 61500 | 1210 | MDEKKESKPLNLQKIRVE KGHTLRSLASEIGVHYSLI SYWEYGKKKPRSANLMR LEKALNTPGKELFKELEE DDGE | 76 | ORF187 [Staphylococcus phage G1] | YP_241088.1 | 6e-36 (76/76) | DNA binding protein | HTH_XRE, Helix-turn-helix XRE-family like proteins | cd00093 | 9.43e-07 |
| 135 | 61960 | 61733 | 1211 | MNKFKRWFRINVLKKETL LFKVYWRYESPSLKKPHV FHIELYAKSKAEARDKSH EYILKNAKASEDFKFLKV EEK | 75 | ORF190 [Staphylococcus phage G1] | YP_241089.1 | 2e-33 (73/75) | | No putative conserved domains have been detected | | |
| 136 | 62778 | 62071 | 1212 | MKKTIFATLALGTAITFGG MATNEASADEIDYNKLAE QAKSNSVEVNTKPIQEGN YDFSFSDGEFTYHFYNYN GNFGYEYHSGSTQVDNT VSRLAGEEQTPEQKVDQQ QAQFDTQNKAVEQPKQE TTTQEAPKSVEAPKVETK TTATKSTGGSVAEQIRQA GGDEAMIEIAMRESTLNP NAVNPTSGAQGLFQGLG KSWSGGSIAEQTKGAKQY MIDRYGSTSGALNFHNAN GNY | 235 | hypothetical protein KgORF26 [Staphylococcus phage K] | YP_024457.1 | 3e-110 (201/235) | | No putative conserved domains have been detected | | |
| 137 | 63768 | 62974 | 1213 | MRKSVVISGVIGFLAIIGFI ILLMCITKIPQGHVGVVYS VNGVKEDTKSPGWHLTA | 264 | hypothetical membrane protein MbpS [Staphylococcus phage | ACB89042.1 | 1e-137 (237/261) | Membrane protein | Band_7_Hfl C domain of flotillin | cd03405 | 3.25e-11 |

FIG. 14II

Table 11 - Features of phage F125/10 gene products and assignment of putative functions.

| orf | Start position | Stop Position | SEQ ID NO. | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
|  |  |  |  | PFDKVNKYPTKTQTHKY KDLNVATSDGKNLQMDI DVSYKVDATKAVDLFNR FGSADIEELEKGYLRSRV QDNVRQSVSKYSVIDAFG VKTGQIKKDTLDSLNDNL EKQGFVIEDIALSSPKADK NTQKAIDERVKANQELER TKVDKQIAEENAKKKEVE AKGEKKANDIRSESLTDE VLQQQLIEKWDGKQPIQI GGDGTIVDVTGK |  | A5W] |  |  | MbpS | (reggie) like proteins |  |  |
| 138 | 64077 | 63769 | 1214 | MALFLTYFAIFIVFLVLVG FGMSYVFDFLSMREKKSN IRKQYRELVRQGTLEEYG LEQYVKYKKQFLNDRRQ SLVTKADKQEIDKEEKAL NSLIKEIEKGEM | 102 | hypothetical protein KgORF29 [Staphylococcus phage K] | YP_024460.1 | 3e-47 (94/102) |  | No putative conserved domains have been detected |  |  |
| 139 | 64810 | 64190 | 1215 | MENIIGKKIEKLFVEEYVG SDKIKGKLYLCLCDCGMD RVLSKSQLYYYKSCGCM KSRNGSKKHPEYTVWRK MKERCYNKNQDSYPYYG GRGIEVCDRWKNSFESFL YDMGKKRPSDKYQLDRKD NDGNYSPENCRWTTRSEN IVNRPSKLEGLKNIQERTN GKYRVSITRNNIRYQSYQ VDSIKEAINLRDRMLKEY EETKSITIFK | 206 | hypothetical protein KgORF27 [Staphylococcus phage K] | YP_024458.1 | 3e-34 (88/211) |  | No putative conserved domains have been detected |  |  |
| 140 | 66363 | 64873 | 1216 | MAKTQAEINKRLDAYAK GTVDSPYRVKKATSYDPS | 496 | putative lysin [Staphylococcus phage | YP_024461.1 | 0,0 | Endolysin | PGRP, Peptidoglyc | cd0658 | 3,07e- |

FIG. 14JJ

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | FGVMEAGAIDADGYYHA QCQDLITDYVLWLTDNK VRTWGNAKDQIKQSYGT GFKIHENKPSTVPKKGWI AVFTSGSYEQWGHIGIVY DGGNTSTFTILEQNWNGY ANKKPTKRVDNYYGLTH FIEIPVKAGTTVKKETAKK SASKTPAPKKKATLKVSK NHINYTMDKRGKKPEGM VIHNDAGRSSGQQYENSL ANAGYARYANGIAHYYG SEGYVWEAIDAKNQIAW HTGDGTGANSGNFRFAGI EVCQSMSASDAQFLKNEQ AVFQFTAFKFKEWGLTPN RKTVRLHMEFVPTACPHR SMVLHTGFNPVTQGRPSQ AIMNKLKDYFIKQIKNYM DKGTSSSTVVKDGKTSSA STPATRPVTGSWKKNQY GTWYKPENATFVNGNQPI VTRIGSPFLNAPVGGNLPA GATIVYDEVCIQAGHIWIG YNAYNGNRVYCPVRTCQ GVPPSHVPGVAWGVFKG | | K] | | (492/495) | | an recognition proteins (PGRPs) | 3 | 10 |
| | | | | | | | | | | CHAP domain | pfam05 257 | 1.42e-15 |
| | | | | | | | | | | Bacterial SH3 domain | pfam08 460 | 6.49e-14 |
| 141 | 66866 | 66363 | 1217 | MANETKQPKVVGGINLST RTKSKTFWVAIISAVALFA NQITGAFGLDYSAQIEQG VNIVGSILTLLAGLGIIVD NNTKGLKDSDIVQTDYLK PRDSKDPNEFVQWQANA NNASTFEIDSYENNAEPDT DDSDEVPAIEDEIDGGSAP SQDEEDTEEHGKVFAEEE | 167 | putative holin [Staphylococcus phage K] | YP_024463.1 | 6e-90 (165/167) | Holin | Phage_holin_1 | pfam04 531 | 1.53e-25 |

FIG. 14KK

Table 11 - Features of phage F125/10 gene products and assignment of putative functions.

| orf | Start position | Stop Position | SEQ ID NO. | Aminoacidic sequence | Size (aa) | Name[organism] | Acc No | E value and identity | Predicted function | Name | Acc No | E value |
|---|---|---|---|---|---|---|---|---|---|---|---|---|
| | | | | VK | | | | | | | | |
| 142 | 67136 | 66951 | 1218 | MASAKQLYYTESLVGKAI INNKVSNKEEVWDKLELL PETKLEDLDNKQMSEVIK KLNQINE | 61 | ORF233 [Staphylococcus phage G1] | YP_241098.1 | 1e-25 (61/61) | | No putative conserved domains have been detected | | |
| 143 | 67369 | 67298 | 1219 | ACACCCUUAGUAUAAUU AGUAGUACAAGGUCUC CAAAACCUUAGUCUUU GUGCAAAUCAAAGAGG GUGUG | | | | | tRNA3-Trp | | | |
| 144 | 67448 | 67376 | 1220 | GGUUUCUUAGCUCAGAU GGUAGAGCACUAGAUU GAAGCUCUAGGUGUCAU UGGUUCAAAUCCAAUAG AAACCA | | | | | tRNA2-Phe | | | |
| 145 | 67528 | 67455 | 1221 | GGCUCAUUGGUGUAACU GGUUAACACACUGCCCU GACACGGCAGAGAGUAC GAGUUCGAGUCUCGUAU GGGUCG | | | | | tRNA1-Asp | | | |
| 146 | 68901 | 68683 | 1222 | MKRQKMFYSSLLICKECGN VFKVPRKRANKREEGHIK DIYCIKCCKTTKHIEDNRS EAERRWDAIQEELTKDN | 72 | ORF200 [Staphylococcus phage G1] | YP_241099.1 | 1e-34 (72/72) | | No putative conserved domains have been detected | | |
| 147 | 69593 | 69384 | 1223 | MSKHIEITMSSGAKYFLVS TDEKSYNRQDIDYMLRG MDETSIKVYTESAITSPQV YINPNRIESFKIVF | 69 | ORF207 [Staphylococcus phage G1] | YP_241100.1 | 1e-32 (69/69) | | No putative conserved domains have been detected | | |

FIG. 14LL

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 148 | 69939 | 69606 | 1224 | LDKEINNLVSQVETIKSKI QEGNYIDRGTFKDLEVEV AELRKMIVSIDKDVAVNS EKQSAIYVQLERLDEKISE LAESTKTKDTKKKDTTEK VLLVLGAILSFVFNKFA | 110 | ORF209 [Staphylococcus phage G1] | YP_241101.1 | 5e-53 (108/110) | | PHA02414, hypothetical protein | PHA02 414 | 8.04e-30 |
| 149 | 70277 | 69951 | 1225 | LTKYKDILKLEFKDSLAH FKRDRRFFHMYRIDRLLIN GSIIYFDYYYLPSDDPNIVI KELDLQDFGKLRFEIDTK TSYGKVVTDNYMEIINDF LENYDIHSESETVRP | 108 | hypothetical membrane protein MbpC [Staphylococcus phage A5W] | ACB89047.1 | 6e-51 (100/108) | Membrane protein MbpC | No putative conserved domains have been detected | | |
| 150 | 70717 | 71103 | 1226 | LNNNIAIFIKTLVIIIFLL FLSVVNSLSLIYSIRPSVV MAYFTFGGIVSDVALTMT DKFLLKKEDPLPEYVLKK VEINDKEISIIKKIESNYDI TSEEIKVRAKAQQRLEED SKEEDNDENEERN | 128 | hypothetical membrane protein MbpD [Staphylococcus phage A5W] | ACB89048.1 | 7e-42 (112/128) | Membrane protein MbpD | No putative conserved domains have been detected | | |
| 151 | 71081 | 71359 | 1227 | MKTKKEIKEQRKELKDG ATTVSLVKKGDKRIASPS RICSLCGQQLSGMSYTKG KALSKVNHFHLQYSKYIY FDICADINNCYKNLRKRG EMD | 92 | ORF161 [Staphylococcus phage G1] | YP_241104.1 | 3e-46 (90/92) | | No putative conserved domains have been detected | | |
| 152 | 71356 | 71766 | 1228 | LSAENIRDIINKKKLEEED TRKYIADGFMNGIGKLMY EFNKKVDNKEIEVKDPND LYKLFVIFSQMQNMVNET SEGGAIPQLSRPQQELFEEI TTEDSNGESTVDLQKISE | 136 | ORF133 [Staphylococcus phage G1] | YP_241105.1 | 2e-69 (132/136) | | No putative conserved domains have been detected | | |

FIG. 14MM

Table 11 - Features of phage F125/10 gene products and assignment of putative functions.

| orf | Start position | Stop Position | SEQ ID NO. | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| | | | | MSAEDITEMISEKEKVMNEENSKTF | | | | | | | | |
| 153a | 71782 | 72021 | 1229 | MDGKELIKIAQETFQTEKITREQIDHIINMLNPSTYMLKYHTLRGHPITFSIPNRDRSKAQAHRPWQVRKHTMRTINLF | 79 | hypothetical protein KgORF35 [Staphylococcus phage K] | YP_024465.1 | 5e-34 (68/69) | Terminase large subunit | No putative conserved domains have been detected | | |
| 153b | 72255 | 72398 | 1230 | MIVNDTHPNKAVIKSRQLGLSEMGVMEMVHFADMHSYANAKCLYTFN | 47 | | | 2e-19(45/45) | | No putative conserved domains have been detected | | |
| 154* | 72647 | 73558 | 1231 | MGKKLTNTEFLNRVFQLVSDEYSFLEEYKGRHTKLRCKHNLCSYEWDVEPGAFLGNKNKAGSRCPSCYGNVTKTTDKFKKEIYNLTKDEYRLLSEYNAKTKVKIKHSKCGNTFSMTPNTFINGSRCPECNPQKPYNTDSAKDRINKETNGTFELVSEYKGCYELMKLKHHECGNIVEINMQSIDSNRLNCPYCYNRSRGELLVSSFLLSKNIPFEVQKRFDGFKKYPYDFYIADYNTVIEYHGEQHYKPIKFYGGEDRLVRQKNIDLKKKNFVEGKGINYLEIPYTLNNQNKVNEFLINYFK | 303 | ORF031 [Staphylococcus phage Twort] | YP_238727.1 | 5e-49 (119/307) | | No putative conserved domains have been detected | | |
| 153c | 73663 | 75123 | 1232 | MKKFVQSRLNPVLEKEYFRDIVDWDKDSLGFKKIRNSSLFFRTSSKASTVEGVDIDYLSLDEYDRVNLLAESS | 486 | hypothetical protein KgORF35 [Staphylococcus phage K] | YP_024465.1 | 0,0 (486/486) | Terminase large subunit | Terminase_GpA | pfam05876 | 5,63e-17 |

FIG. 14NN

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| | | | | ALESMSSSPFKIVRRWSTP SVPGMGIHKLYQQSDQW YYGHRCQHCDYLNEMSY NDYNPDNLEESGNMLCV NPEGVDEQAKTVQNGSY QFVCQKCGKPLDRWYNG EWHCKYPERTKGNKGVR GYLITQMNAVWISADELK EKEMNTESKQAFYNYILG YPFEDVKLRVNEEDVYG NKSPIAETQLMKRDRYSH IAIGIDWGNTHWITVHGM LPNGKVDLIRLFSVKKMT RPDLVEADLEKIIWEISKY DPDIIIADNGDSGNNVLKL INHFGKDKVFGCTYKSSP KSTGQLRPEFNENNNRVT VDKLMQNKRYVQALKTK DISVYSTVDDDLKITFLKH WQNVVIMDEEDEKTGEM YQVIKRKGDDHYAQASV YAYIGLTRIKELLKEGNGT SFGSTFVSTDYNQEGNKQ FYFDE | | K] | | | | | |
| 155 | 75116 | 75937 | 1233 | MNRGEIDLTDKLFYGTIS NEEINKSVLNLLLGEELSL DYVSKNSDTLDVKYEHV YKSLGFDNFFDCFLYANR EPEIVHKGGDKNLGGLNK VKRTVIRNGKEMEMTVY EDGNKENDSKEKQEGKE EVSRSAVGARAISNGEEG KVNPKKVANSLSSLSKKG VDVSHINTNLSLYKEFVD DNGDTLGITSFKRTENDII | 273 | hypothetical protein KgORF36 [Staphylococcus phage K] | YP_024466.1 | 2e-150 (270/273) | | No putative conserved domains have been detected | | |

FIG. 1400

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | LESYASSPDSDGVGARAI MELRLSIKENKNAVVYD IELPEAVEYLKTLGFKPNK DGYILRKKDVKQFLGDYS DFI | | | | | | | | |
| 156 | 75915 | 76097 | 1234 | VIIVILFSTIVIYSIVFILYIV LKTIYIKSNMSRIDNTIEL LKILQEDIEGKIKKEGRNK | 60 | ORF235 [Staphylococcus phage G1] | YP_240894.1 | 4e-23 (56/60) | | No putative conserved domains have been detected | | |
| 157 | 76094 | 76573 | 1235 | MTLEENKLTLEESITPLSK EEKEDSIKEFSSLLCEMVN RLYKSYNVFRQDPMDET QRLDGSLMVFQSRLNDPL TGDLHDKMYKLAFSKRID IFEANKQFRKDVEAGKAI ELGDVAIIDTALSNILSGN EFQGSISFMLRKDFEEKER IRKEEEKLNNL | 159 | hypothetical protein KgORF37 [Staphylococcus phage K] | YP_024467.1 | 6e-86 (159/159) | | No putative conserved domains have been detected | | |
| 158 | 76615 | 77826 | 1236 | LKKKPQGNEVIITITVMIA VFVVIMTIFFNKYQDAKE DKDRYQRLVEIYKKADD NDGETKKKYKVKRLNKAE EELKKVKKETNYKDYNK KSSKERQKEDKETREKIY DVTGDDDLILVKNNIDFS DKVDKPEILISEDGIGTITV PVDSGYEKQTVGSIITSVL GSPFLSPGSNSIDGLSVIND NVYPNTVDSIVEDTKPSIN LPMDNPIITNPVEPTIIPSDT IPPIDNPSVPVFPENPVDN NQGNTDNPNPPPGYTDE DGGRGSGGGNSEPSTE | 403 | hypothetical membrane protein MbpF [Staphylococcus phage A5W] | ACB89054.1 | 2e-163 (375/403) | Membrane protein MbpF | No putative conserved domains have been detected | | |

FIG. 14PP

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | EPSDNGNTGGGDWEEKP DPGEEPSDNGNTGGNGGE VTPEPDPTPSEPEQPNENS DEGNEEKPSEPSDNPDEN GGWETEPTEPESPSEPDD KVDEEDKNEDTTDDKQP TEQPDDNNIDNEDKTEEE | | | | | | | | |
| 159 | 77969 | 78253 | 1237 | MIFVHSKFSSKNVFVLYVI YAIIGIGTYIVLTMFQTTS VLIKNDVIDSIENTEHYIGF NDPIIFTISFIGAILGGIWY KMMKIIKKSNFKDKK | 94 | hypothetical membrane protein MbpE [Staphylococcus phage A5W] | ACB89055.1 | 2e-45 (94/94) | Membrane protein MbpE | PHA02256, hypothetical protein | PHA02 256 | 8.96e-22 |
| 160 | 78262 | 78642 | 1238 | VNRLIFSKDKKWDEAKDF IKGQGMQDNWIEIVDYYR QIGGKHVAVFIALNKVKY MILEATKDNKVILVDKDN NILLEDYDIVMESKKMFY YIEEPFEVKINIPQHIRDVT YNNTVVLTTVRGSRGD | 126 | hypothetical protein KgORF40 [Staphylococcus phage K] | YP_024470.1 | 2e-64 (122/123) | | No putative conserved domains have been detected | | |
| 161 | 78646 | 80346 | 1239 | LADLFKQFRLGKDYGNNS TIAQVPIDEGLQANIKKIE QDNKEYQDLTKSLYGQQ QAYAEPFIEMMDTNPEFR DKRSYMKNEHNLIIDVLK KFGNNPILNAIILTRSNQV AMYCQPARYSEKGLGFE VRLRDLDAEPGRKEKEE MKRIEDFIVNTGKDKDVD RDSFQTFCKKIVRDTYIYD QVNFEKVFNKNNKTRLE KFIAVDPSTIFYATDKKGK IIKGGKRFVQVVDKRVVA | 566 | putative portal protein [Staphylococcus phage K] | YP_024471.1 | 0.0 (555/566) | Portal protein | Phage_porta l | pfam04 860 | 1,00e-13 |

FIG. 14QQ

Table 11 - Features of phage F125/10 gene products and assignment of putative functions.

| orf | Start position | Stop Position | SEQ ID NO. | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | SFTSRELAMGIRNPRTELS SSGYGLSEVEIAMKEFIAY NNTESFNDRFFSHGGTTR GILQIRSDQQQSQHALENF KREWKSSLSGINGSWQIP VVMADDIKFVNMTPTAN DMQFEKWLNYLINIISAL YGIDPAEIGFPNRGGATGS KGGSTLNEADPGKKQQQ SQNKGLQPLLRFIEDLVN RHIISEYGDKYTFQFVGG DTKSATDKLNILKLETQIF KTVNEAREEQGKKPIEGG DIILDASFLQGTAQLQQD KQYNDGKQKERLQMMM SLLEGDNDDSEEGQSADS SNDDKSNPEVGTDSQIKG DSNVYRTETSNKGQGKK GEKSSDFKH | | | | | | | | |
| 162 | 80364 | 81518 | 1240 | MSVIYKDNNWIDLTNVPY LQKGDSGYRKDIPRKNW KKCLNTEVSFSYKGKKGL FYVTYRKEDKGKVKVEY DKYVKIIDPHDLKTLNINK IVNPPNKAKYREQEVING DTVRNIRKVKNTGIVYTM LCSEYEEEYDIRESDLLRG RGSPYKSGRKVCYNNSLY SVENLREYICDLEYAKTV TKFSHKDIKCKCPICSEEK VMKVNKLVNNGFSCHRC SSTITYPERLMIGLLELNN LNYEYQKVFKDLPNRKFD FYLPKLNMVIETTIGLQHY RELNGYMNHEKTKESDL | 384 | conserved phage protein [Staphylococcus phage CNPH82] | YP_950629.1 | 6e-53 (133/332) | | No putative conserved domains have been detected | | |

FIG. 14RR

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | EKYNYCKNNNIDYIEIDCS YSDLSFILSNVENSKLNSIL KNKNYDNLSNYIIRSKND DVKYNTYLDYCKGLSKKE LKDKYNKTSYYINRSIEIF KH | | | | | | | | |
| 163 | 81712 | 82485 | 1241 | LEEIKFNAFVPMDLKKSV STASDTNEYSIVSGWASTP SMDLQNDIVNPKGIDIEYF KSQGYINYEHQSDKVVGI PTENCYVDIEKGLFIEAKL WKNDENVVKMLDLAEKL EKSGSGRRLGFSIEGAVK KRNINDNRVIDEVMITGV ALVKNPANPEATWESFM KSFLTGHGTSPDTQVDAG ALRKEEIASSITNLAYVTK IKDLKEFNDVWNGVVED LSKSNSMGYEESVLTLQL AKGLSRKDAELAVMDIN KQKLE | 257 | hypothetical protein KgORF42 [Staphylococcus phage K] | YP_024472.1 | 1e-146 (256/257) | Prohead protease | Peptidase_ U35 | pfam04586 | 8.72e-05 |
| 164 | 82504 | 83460 | 1242 | MSKEMQNILEEYDKLNA QEAVSKSVEDDEKNTVES TEEQVAETTEEPAKEPEK VSEEDAKEAQEQGEKVES EEVAEDNEDEEVEKSAKE SKDPVDQKDTKTENKDN EKRKNKKDKKEDSDSDD EDKDTDDDKDKKEDKKE KTSKSISDEDITTVFKSILT SFENLNKEKENFATKEDL SEVSKSINELSAKISEIQAE DVSKSVDTDEEAVEKSVT STNGEQEKVEGYVSKSVD | 318 | ORF029 [Staphylococcus phage G1] | YP_240902.1 | 9e-170 (317/318) | | No putative conserved domains have been detected | | |

FIG. 14SS

Table 11 - Features of phage F125/10 gene products and assignment of putative functions.

| orf | Start position | Stop position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| | | | | TEEQAETGEAKSEEAEEV QEDNTFKGLSQEERTKFM DSYKAQAKDPRASKHDL QSAYQSYLNINTDPTNAS EKDIKTVKDFAQI | | | | | | | | |
| 165 | 83576 | 84967 | 1243 | MTIEKNLSDVQQKYADQF QEDVVKSFQTGYGITPDT QIDAGALRREILDDQITML TWTNEDLIFYRDISRRPAQ STVVKYDQYLRHGNVGH SRFVKEIGVAPVSDPNIRQ KTVSMKYVSDTKNMSIAS GLVNNIADPSQILTEDAIA VVAKTIEWASFYGDASLT SEVEGEGLEFDGLAKLID KNNVINAKGNQLTEKHL NEAAVRIGKGFGTATDAY MPIGVHADFVNSILGRQM QLMQDNSGNVNTGYSVN GFYSSRGFIKLHGSTVME NELILDESLQPLPNAPQPA KVTATVETKQKGAFENEE DRAGLSYKVVVNSDDAQ SAPSEEVTATVSNVDDGV KLSISVNAMYQQQPQFVS IYRQGKETGMYFLIKRVP VKDAQEDGITVFVDKNET LPETADVFVGEMSPQVVH LFELLPMMKLPLAQINASI TFAVLWYGALALRAPKK WARIKNVRYIAV | 463 | putative capsid protein [Staphylococcus phage K] | YP_024474.1 | 0,0 (462/463) | Capsid protein | No putative conserved domains have been detected | | |
| 166 | 85059 | 85355 | 1244 | MLYYKLLDKKMATVY GTVEIDKDGVVKGLTKEQ EKEFANVPGFEFEEEKT | 98 | ORF151 [Staphylococcus phage] | YP_240904.1 | 9e-46 | | No putative conserved domains | | |

FIG. 14TT

Table 11 - Features of phage F125/10 gene products and assignment of putative functions.

| orf | Start position | Stop Position | SEQ ID NO. | Aminoacidic sequence | Size (aa) | Name[organism] | Acc No | E value and identity | Predicted function | Name | Acc No | E value |
|---|---|---|---|---|---|---|---|---|---|---|---|---|
| | | | | TRKQSASTSKEEEPKEEEK KASTRKTTSTTRKSTARK TTAKKDENK | | G1] | | (97/98) | | have been detected | | |
| 167 | 85368 | 86276 | 1245 | MVNSMFGGDLDPYEKSL NYEYPYHPSGNPKHIDVS EIDNLTLADYGWSPDAVK AYMFGIIVQNPDTGQPMG DEFYNHILERAVGKAERA LDISILPDTQHEMRDYHET EFNSYMFVHAYRKPILQV ENLQLQFNGRPIYKYPAN WWKVEHLAGHVQLFPTA LMQTGQSMSYDAVFNGY PQLAGVYPPSGATFAPQM IRLEYVSGMLPRKKAGRN KPWEMPPELEQLVIKYAL KEIYQVWGNLIIGAGIAN KTLEVDGITETIGTTQSAM YGGASAQILQINEDIKELL DGLRAYFGYNMIGL | 302 | hypothetical protein KgORF45 [Staphylococcus phage Kj] | YP_024475.1 | 3e-117 (301/302) | | No putative conserved domains have been detected | | |
| 168 | 86290 | 87168 | 1246 | MEKPYMIGANSNPNVINK STTYTTTQADEQDKPKY TTRLEFDTIDMIRFINDRGI KVLWEEAYFCPCLNPDTG HPRVDCPRCHGKGIAYLP PKETIMAIQSQEKGTNQL DIGILDTGTAIGTTQLEKRI SYRDRFTVPEVLMPQQMI YFVNKDRIKKGIPLYYJDV KEVTYIATQDGTVYEEDY EIKNNRLYLNEKYENHTV TLKILMTLRYVVSDILKES RYQYTKFNQPKSKFENLP QKLLLKREDVIVLQDPYK | 292 | capsid protein [Staphylococcus phage 812] | ABL87113.1 | 1e-170 (291/292) | Capsid protein | No putative conserved domains have been detected | | |

FIG. 14UU

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | VNDGIEEDLEIQVDDPKA SASNPNLGGFFGGAFK | | | | | | | | |
| 169 | 87168 | 87788 | 1247 | MPVHGKRPNLFKNKNYK QVGKRTIDGMRSEVLDKL QATAQQVENTSIKRMPTY LQITEKKLEKEGVVDLKK AFAHSSKKKTSKDGGWY LTVPIRIKTSRMNNSTYQD MRTLKVDKGTGSVSKITD YLEGRRKNVSHPSMKPEP MTHNMTKVKRGKQSSYF IFRTVSSKSPASSWILNRD KVNEDNFSKTTLKTVKQL MNWKMKNLN | 206 | hypothetical protein KgORF47 [Staphylococcus phage K] | YP_024477.1 | 1e-116 (206/206) | | No putative conserved domains have been detected | | |
| 170 | 87807 | 88643 | 1248 | MAITSVDSYLLSEIKPRLN TVLENCYIIDEVLKDFDY QTRESFKEAFCGKNAQIIE VTVGFNFPKFKNNYEAHY LIQLGQGQETKNSLGSIQS SYFEATGDTLVESSTAIRE DDKLVFTVSKPIGELIKVE DIEFAKYDNLQVEGNKVS FKYQTNEDYENYNANIIF TEKKNDSKGLVKGFTVEE QVTVVGLSFNVDVARCL DAVLKMILISMRDSIEFQQ TFQLQNLSFGDIAPIIEDG DSMIFGRPTIIKYTSSLDLD YTITQDINKLTFKERKDW K | 278 | hypothetical protein KgORF48 [Staphylococcus phage K] | YP_024478.1 | 4e-160 (278/278) | | Crotono-betainyl-CoA:carnitine CoA-transferase | PRK03 525 | 8,14e-03 |
| 171 | 88645 | 88860 | 1249 | MARKKTPENNTPKFNGY VHDTFLDTAKTLFNMKD | 71 | ORF202 [Staphylococcus phage] | YP_240909.1 | 2e-34 | | No putative conserved domains | | |

FIG. 14VV

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | SQVAGFKAYMEGSHYLFS EQEFLPSLEKYLGRKLDI | | G] | | (70/71) | | have been detected | | |
| 172 | 88887 | 90650 | 1250 | MAVEPFPRRPITRPHASIE VDTSGIGGSAGSSEKVFCL IGQAEGGEPNTVYELRNY AQAKRLFRSGELLDAIEL AWGSNPNYTAGKILAMRI EDAKPASAEIGGLKVTSKI YGNVANNIQVGLEKNTLS DSLRLRVIFQDDRFNEVY DNIGNIFTIKYKGEEANAT FSVEHDEETQKASRLVLK VGDQEVKSYDLTGGAYD YTNAIITDINQLPDFEAKL SPFGDKNLESSKLDKIENA NIKDKAVYVKAVFGDLE KQTAYNGIVSFEQLNAEG EVPSNVEVEAGEESATVT ATSPIKTIEPELTKLTGGT NGEPPATWADKLDKFAH EGGYTVPLSSKQSVHAE VASFVKERSDAGEPMRAI VGGGFNESKEQLFGRQAS LSNPRVSLVANSGTFVMD DGRKNHVPAYMVAVALG GLASGLEIGESITFKPLRVS SLDQIYESIDLDELNENGII SIEFVRNRTNTFFRIVDDV TTFNDKSDPVKAEMAVG EANDFLVSELKVQLEDQF IGTRTINTSASIIKDFIQSYL GRKKRDNEIQDFPAEDVQ VIVEGNEARISMTVYPIRS FKKISVSLVYKQQTLQA | 587 | major tail sheath protein [Staphylococcus phage 812] | ABL87117.1 | 0.0 (584/587) | Major tail sheath protein | Phage_sheath_1 | pfam04984 | 2.11e-07 |

FIG. 14WW

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| 173 | 90723 | 91127 | 1251 | MASEAKQTVHTGNTVLL MIKGKPVGRAQSASGQRE YGTTGVYEIGSIMPQEHV YLRYEGTITVERLRMKKE NFADLGYASLGEEILKKDI IDILVVDNLTKQVIISYHG CSANNYNETWQTNEIVTE EIEFSYL | 134 | capsid protein [Staphylococcus phage 812] | ABL87118.1 | 3e-73 (134/134) | Capsid protein | No putative conserved domains have been detected | | |
| 174 | 91547 | 92476 | 1252 | MGKNQYTFNIKENKNKW YEWCKLQNVKPLVEYEN AQQIFYEFLEGKFKGLIG KTYWASINRGSNMRMSC LTSESKDKYLKNLGKRKG IEVVEDYKGGRKLKHKFI VLEGKYQGCEGYITLNDL ENLGRVDNRSLSEKGRKQ YFDKQARLRDCIILEYPKD YRIKTKDKIVVKDKEGHV HNIIVQDFFEKSSLLELSC ASEGEKIVKEILTKNSIKFE KEKSFRNKEGKVQRFDFY INENNKEYAIEYNGAQHY IDSTGYLKDTLETTQKRD KLKKEYSKDKGINLLIIPY TITDKKEMEKIILNFLNK | 309 | ORF018 [Staphylococcus phage Twort] | YP_238556.1 | 2e-19 (79/239) | | No putative conserved domains have been detected | | |
| 175 | 92534 | 92692 | 1253 | MNNRQAKIKGYNQFHYY DFPTTKGFKFKDIMKRKSR TELKKDLQKERKYYLDK | 52 | ORF245 [Staphylococcus phage Twort] | YP_238558.1 | 5e-11 (36/52) | | No putative conserved domains have been detected | | |
| 176 | 92682 | 92822 | 1254 | LTNKRKTIGKMSNTRAT WNINPVTKVKKDKTKYS RKNKHKGLDNYN | 46 | ORF293 [Staphylococcus phage G1] | YP_240912.1 | 1e-10 (44/46) | | No putative conserved domains have been detected | | |

FIG. 14XX

Table 11 - Features of phage F125/10 gene products and assignment of putative functions.

| orf | Start position | Stop Position | SEQ ID NO. | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| 177 | 92864 | 93322 | 1255 | MSTFWSERRTTNKDRQV KKHYTQMSMYERKKCVE LLQETITENRIINFTRHSAK KVKGKPTTNIPKLIGFIFK NKFAYENIIEYNNTDYNG NIERRIVVKHPKVITVEGK PSYQFLTISLEDARVITVW YNSVDDTHRTLDLNYYS KDLTIQ | 152 | hypothetical protein KgORF51 [Staphylococcus phage K] | YP_024481.1 | 2e-84 (152/152) | | PHA02264, hypothetical protein | PHA02 264 | 1.25e-30 |
| 178 | 93335 | 93526 | 1256 | MGITIVNSYFILSNIFLIILTI LNGKGTVTRESLTMSKIL VVITSIQFLACLIINGIYWS LKF | 63 | ORF215 [Staphylococcus phage G1] | YP_240914.1 | 3e-25 (62/63) | | No putative conserved domains have been detected | | |
| 179 | 93599 | 93910 | 1257 | MSQDKLRAIYTEMKVEL HKFPKEVDITSKSTAIAIN QILDKFKTLTEQAGKITRK YLEGQEILTIDYEYYDSLQ EYYIYLLRNSEKIEQSLQEI TKRTGEYVK | 103 | hypothetical protein KgORF52 [Staphylococcus phage K] | YP_024482.1 | 3e-51 (103/103) | | PHA02265, hypothetical protein | PHA02 265 | 2.50e-17 |
| 180 | 94042 | 94500 | 1258 | MAEEIKKEQDVQETTKEE KKDVSKMTPEEIDKLKYQ DKQEKEQVINKVIKGVND TWEKEYNFEELDLRFKVK IKLPNAREQGNIFALRSAY LGGMDMYQTDQVIRAYQ MLATLQEVGIEVPKEFQD PDDIYNLYPLTVMYEDWL GFLNSFRY | 152 | hypothetical protein KgORF53 [Staphylococcus phage K] | YP_024483.1 | 2e-82 (152/152) | | No putative conserved domains have been detected | | |
| 181 | 94544 | 95080 | 1259 | MESIVKQPLSRNLWAIMK EFNVLPTEQRFKDLDDYQ IEFIIGNMNRDVYEHNKQ | 178 | gp ORF080 [Staphylococcus phage] | ACB89073.1 | 1e-98 (178/178) | | No putative conserved domains have been detected | | |

FIG. 14YY

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | LKQAQKGGKFDSQFEDD DSSWWNESHEDFDPVPDF LDADDLAQQVEAKLSDR DKEERAKRNDAELNDETE GLTTQHLAMMEYIRQKQ QELDDEVGNGKTSEEDAT ISQDSVNKALEDLDIDW YM | | A5W] | | | | | | |
| 182 | 95136 | 99191 | 1260 | MAMNDDYRLVLSGDSSD LENSLKAIELYMDSLESK NIDAPLDNFLKKLKVIAK EVKNVQNAMDKQDGKS VISSKDMDESIKSTQSATK NINELKKALDDLQKENIS KGIAPDPEVEKAYAKMG KVVDETQEKLEKMSSQKI GSDASIQNRIKEMKTLNQ VTEEYNKISKDSSATKDY TKRLRANRNMTRGYMER SEGTGRLTYDQGARVRSE LGKISSYESQRKQNQRNL GQAREQYSNYRNQQQDL TKRRASGQINKAQYEQEL ASIKQEMKAREELISNYE KLGAELDKTVQYYKGSV QKDFQSRDVDQQRGTFG RMVQERLPSIGSHAMMG TTAMATGLYMKGASLSE TNRPMVTSLGQNSDNMDI DSVRNAYGDLSIDNKLGY NSTDMLKMATSYEASVG HKSDEDTMAGTKQLAIG GRSLGIRDQEAYQESMGQ IMHTGGVNSDNMKEMQD AFLGGIKQSGMVGRQDE | 1351 | ORF001 [Staphylococcus phage G1] | YP_240918.1 | 0,0 (1348/1351) | | COG4372, un-characterized protein conserved in bacteria with the myosin-like domain | COG43 72 | 9,12e-03 |

FIG. 14ZZ

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 183 | 99270 | 101696 | 1261 | MRRIRRPKVRIEIVTDDNT FTLRFEDTRDYNGDEFGA KLLGFQTKNSMEDDSSVF QLKALGSIAEQSGEGRTL TKDQMSNLTAMQSTFAES GSKGLQGEQGANAINSID QGLKNGMNSSYARIAMG WGTQYQGLEGGYDLQKR MDEGISNPENLTDMADM ATQMGGSEKEQKYLFNR SMKEIGANLTMEQSDEIF KDAQSGKLSKEELAKKA KKMEKEGKKEGEDNATD YKESKSGKNDQNKSKTD DKAEDTYDMAQPLRDAH SALAGLPAPIYLAIGAIGA FTASLIASASQFGAGHLIG KGAKGLRNKFGRNKGGS SGGNPMAGGMPSGGGSP KGGGSPKGGGTRSTGGKI LDSAKGLGGFLVGGAGW KGMFGGESKGKGFKQTS KEAWSGTRKVFNRDNGR KAMDKSKDIAKGTGSGL KDIYNDSIFGKERRQNLG EKAKGFGGKAKGLYGKF ADKFGDGGKNGILSQSPK AGGSGIGKLGKLAGGLGK GAGVLGVATSALSLIPAL ASGDSKAIGGGIGSMGGG MAGASAGASIGALFGGV GAIPGALIGGAIGSFGGGA VGEKVGDMAKKANTKEG WNLGWTNGDKDGKNKF QDSLLGKPI | 808 | hypothetical protein KgORF56 [Staphylococcus phage] | YP_024486.1 | 0,0 (806/808) | Tail lysin | CHAP domain | pfam05 257 | 1,02e-14 |

FIG. 14AAA

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | QINMAGDTYWDKLVMA NDIIRIFITPNDDPNDKEGR QERLIQVGMVSQVSKVGS YGNDQTQFRITGQSFVKP FMKFGLGVIQEVQAVLPE VGWLIDGDGDNEVKFTG SSAHEVMTGIIRRFIPYMK YNYTEKTYNTIDNYLDYD DLSSWDEFEKLTEVSAFT NFDGSLKQLMDMVTARP FNELFFKNSEKTPGKAQL VLRKTPFNPTEWRALDMI KVPTEDFIEEDVGKSDVE TYSIFTATPAGMLKELNG DVFSKPQFHPELTDRYGY TKFEVENIYLSTKSGSATE DSDSSGDDNGTERGTYSK IMKDLSNYGRDNISKGID KYTSKLSSKYKNLKKAQ AKKIIEKFVKEGKVTEKE YEKITGNKVDDELTSDNR PKLTKDKLKSILKEKFKT QDDFNNSKKKKKAKTDA LKELTTKYRFGNKTHATT LLDEYIKYKGEPPNDEAF DKYLKAIEGVSNVATDTG SDASDSPLVMFSRMLFNW YHGNPNFYAGDIIVLGDP KYDLGKRLFIEDKQRGDT WEFYIESVEHKFDYKQGY YTTVGVTRGLKDAILEDG KGSPHRFAGLWNQSSDF MGGLMGEDTSKELKEKG VAEKQSSGGKDGGSDSG GAQDGGSLDSLKKYNGK LPKHDPSFVQPGNRHYKY | K] | | | | | | |

FIG. 14BBB

Table 11 - Features of phage F125/10 gene products and assignment of putative functions.

| orf | Start position | Stop Position | SEQ ID NO. | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| | | | | QCTWYAYNRRGQLGIPVP LWGDAADWIGGAKGAG YGVGRTPKQGACVIWQR GVQGGSPQYGHVAFVEK VLDGGKKJFISEHNYATPN GYGTRTIDMSSAIGKNAQ FIYDKK | | | | | | | | |
| 184 | 101710 | 102597 | 1262 | MATDKEAKDVIDKFIDNV FNFDVLTKERIKEKDEEIK KITTDDMYEKVVYIRPYV GVIQSLNPQHVQYESFSN NGYDIEAELSFRKVSYLV DKGSIPTDSLSTLTVIILVE RNQELLIDYFDEIQDVLY GEYMEEYVFDEDVPLST ILALDLNDNLKSLSNIKY MFKGAPKENPFGTDKDV YIDTYNLLYWLYLGEDEE LAYPMNINYFFTEGRFFTI FGKGHKYKVDVSKFIVGD ILFFGRSDTNIGIYVGDGE FISMMGKFPKDETPIGKY KLDDYWNEFNGRVMRFD EEVYI | 295 | hypothetical protein KgORF57 [Staphylococcus phage K] | YP_024487.1 | 4e-167 (295/295) | | No putative conserved domains have been detected | | |
| 185 | 102597 | 105143 | 1263 | MVVRFQSSMGRSLKRVD SDDLNVKGLVLATVSKIN YKYQSVEVKVNNLTLGS RIGDDGSLAVPYPKSFIGR TPEGSVFGTKPLITEGSVV LIGFLNDDINSPIILSVYGD NEQNKMINTNPLDGGKFD TESVYKYSSSLYEILPSLN YKYDDGEGTSIRTYNGKS FFSMTSGEEEKPQATDFY | 848 | putative glycerophosphoryl diester phosphodiesterase [Staphylococcus phage K] | YP_024488.1 | 0.0 (845/848) | Glycero-phosphoryl diester phospho-diesterase | GDPD_SaGlpQ_like, glycero-phospho-diester phospho-diesterase domain | cd08601 | 1.43e-60 |

FIG. 14CCC

Table 11 - Features of phage F125/10 gene products and assignment of putative functions

| orf | Start position | Stop Position | SEQ ID NO. | Aminoacidic sequence | Size (aa) | Homologous/similar proteins ||| Predicted function | Conserved Domains ||
|---|---|---|---|---|---|---|---|---|---|---|---|
| | | | | | | Name[organism] | Acc No | E value and identity | | Name | Acc No | E value |
| | | | | TGTEYQDLFTSYYGNKTL IEPRIQKAPNMLFKHQGV FYDDGTPDNHТTLFISER GDIRASVLNTETQKRTTQ EMSSDGSYRVIKQDDDL MLDEAQVWIEYGISEDNK FYIKNDKHKFEFTDFGIYI DDKPMLENLDESIAEAMK NLNEIQKELDDINYLLEG VGKDNLEELIESTKESIEA SKKATSDVNRLTTQIAEV SGRTEGIITQFOKFRDETF KDFYEDASTVINEVNQNF PTMKTDVKTLKTKVDNL EKTEIPNIKTRLTELENNN NNADKIISDRGEHIGAMIQ LEENVTVPMRKYMPIPWS KVTYNNAEFWDSNNPTR LVVPKGITKVRVAGNVL WDSNATGQRMLRILKNG TYSIGLPYTRDVAISTAPQ NGTSGVIPVKEGDYEFE AFQDSEGDRQFRADPYT WFSIEAIELETETMEKDFM LIGHRGATGYTDEHTIKG YQMALDKGADYIELDLQ LTKDNKLLCMHDSTIDRT TTGTGKVGDMTLSYIQTN FTSLNGEPIPSLDDVLNHF GTKVKYYIETKRPFDANM DKELLTQLKAKGLIGISE RFQVIIQSFARESLINIHNQ FSNIPLAYLTSTFSESEMD DCLSYGSYAIAPKYTTTK ELVDLAHSKGLKVHAWT VNTKEEMQSLIQMGVDG | | | | | | | |

FIG. 14DDD

Table 11 - Features of phage F125/10 gene products and assignment of putative functions.

| orf | Start position | Stop Position | SEQ ID NO. | Aminoacidic sequence | Size (aa) | Homologous/similar proteins | | | | Conserved Domains | | |
|---|---|---|---|---|---|---|---|---|---|---|---|---|
| | | | | | | Name[organism] | Acc No | E value and identity | Predicted function | Name | Acc No | E value |
| | | | | FFTNYLDEYKKI | | | | | | | | |
| 186 | 105250 | 106041 | 1264 | MPQSDGISNLHRIALRFPK EGGGYDMYRFKVNPENY TIDSPQRTTAIKTKSDIVIE DYGKDIEVINFTGTTGFRP VREADGLKTGKQKMEEL QSRVSEYAMQGGSGNVS GSYLQFFNFTDDSYYKVH LAPQGLKITRSKDEPLLFR YEITLVVIGSLTEADRSAV TTEEFGNVKPNASQRVDE GIKELDKNARKTRDRNNQ EISRRENTIPKSTGDNTNE GNRLKQSFPSSSIYNPRQS TNGLKGNIDNMALIIGYG DGGVSS | 263 | hypothetical protein KgORF59 [Staphylococcus phage K] | YP_024489.1 | 7e-151 (263/263) | | No putative conserved domains have been detected | | |
| 187 | 106041 | 106565 | 1265 | MNNFIPQPQGLLRFLNAL DTDLTSSHMNLLDEEVSF VSKFYTPQLQLSELAKKV LTNIKTDDIPVLEREFNDN TIIHKANDTLLKVQAPRM YMILQSIVLEAYAIVNCFV ENPSSLKYLTEEDVSITRE NLNYVADYLGNYDDYNS VVLDLRDLDLCFSAIELQL PLIKKEANV | 174 | ORF078 [Staphylococcus phage G1] | YP_240925.1 | 3e-95 (174/174) | | No putative conserved domains have been detected | | |
| 188 | 106565 | 107269 | 1266 | MRFKKHVVQHEETMQAI AQRYYGDVSYWIDLVEH NNLKYPYLVETDEEKMK DPERLASTGDTLIPIESDL TDVSAKEINSRDKDVLVE LALGRDLNITADEKYFNE | 234 | putative bacteriophage baseplate protein [Staphylococcus phage K] | YP_024491.1 | 2e-134 (234/234) | Baseplate protein | COG3628, phage baseplate assembly protein W | COG36 28 | 1.50e-03 |

FIG. 14EEE

Table 11 - Features of phage fI25/10 gene products and assignment of putative functions.

| orf | Start position | Stop Position | SEQ ID NO. | Aminoacidic sequence | Size (aa) | Homologous/similar proteins Name\|organism\| | Acc No | E value and identity | Predicted function | Conserved Domains Name | Acc No | E value |
|---|---|---|---|---|---|---|---|---|---|---|---|---|
|  |  |  |  | HGTSDNILAFSTNGNGDL DTVKGIDNMKQQLQARL LTPRGSLMLHPNYGSDLH NLFGLNIPEQATLIEMEVL RTLTSDNRVKSANLIDWK IQGNVYSGQFSVEIKSVEE SINFVLGQDEEGIFALFE |  |  |  |  |  |  |  |  |
| 189 | 107284 | 108330 | 1267 | MKTRKLTNILSKLIDKTM AGTSKITDFTPGSASRSLL EAVSLEIEQFYILTKENID WGIQEGIIEAFDFQKRQSK RAYGDVTIQFYQPLDMR MYIPAGTTFTSTRQEYPQ QFETLVDYYAEPDSTEIV VEVYCKETGVAGNVPEG TINTIASGSSLIRSVNNEYS FNTGTKEESQEDFKRRFH SFVESRGRATNKSVRYGA LQIPDVEGVYVYEETGHIT VFAHDRNGNLSDTLKEDII DALQDYRPSGIMLDVTGV EKEEVNVSATVTISNKSRI GDTLQKHIESVIRSYLNNL KTSDDLIITDLIQAIMNIDD VLIYDVSFDNLDENIIVPP QGIIRAGEIKVELK | 348 | hypothetical protein KgORF62 [Staphylococcus phage K] | YP_024492.1 | 0,0 (348/348) |  | XrdT, un-characterized homolog of phage Mu protein gp47 | COG3299 | 2,38e-05 |
| 190 | 108351 | 111410 | 1268 | VANFLKNLHPLLRRDRNK KDNQDPNFALIDALNEEM NQVEKDAIESKLQSSLKTS TSEYLDKFGDWFGVYRK TDENDIDVYRARIIKYLLL KRGTNNAIIDAIKDYLGR DDIDVSVYEPFTNIFYTNK SHLNGEDHLMGYYYRFA | 1019 | hypothetical protein KgORF63 [Staphylococcus phage K] | YP_024493.1 | 0,0 (1006/1019) |  | No putative conserved domains have been detected | | |

FIG. 14FFF

Table 11 - Features of phage F125/10 gene products and assignment of putative functions.

| orf | Start position | Stop Position | SEQ ID NO. | Aminoacidic sequence | Size (aa) | Homologous/similar proteins ||| | Conserved Domains |||
|---|---|---|---|---|---|---|---|---|---|---|---|
| | | | | | | Name[organism] | Acc No | E value and identity | Predicted function | Name | Acc No | E value |
| | | | | VINVSIGDYFPVEIIDVINE FKPAGVTLYVTYDGASTI RGGAIIKWLDGLPKIETYQ EFDRFTGYDDTFYGHINM NQSKDTDNSSSDIFKTNHS LINSLDVLTGSSSVGRQYI NYGVVTSYVYNPGMTSS VNQISASTEGRGQEVPTD YYMYTSTKNNNTVELSM QTTSGVSYLYNNFNFRDY MSKYRPQVDLQSDEFARRI VSDYIKELSIDYYLSAVIPP DESIEIKLQVYDFSINRWL TVSINNLSFYEKNIGSNIG YIKDYLNSELNMFTRLEIN AGKRDSVDIKVNYLDLM FYYYERGIYTIKPYKALIE NYLDISRETYVEAFKIASL SNGDIITKTGFQPIGYLKL VGNYENTRPSTINIVAKDT DNNPIESNELDVYNTVEN RNLLQSYKGANTIAREITS TKEFTVSGWAKEIYSTNY LSKVLKPGKVYTLSFDIEI TGNDLTLKSYSDNHGIYL YSNTKGIVVNGVKSMERT IGNKVSVTQTFTAPTITDH RLLIYTGRYTSDGKASTPP VFFNTVKITELKLSEGTSN LEYSPAPEDKPNVIEKGIK FNNILTNIQTLSINSDTILK NVTLYYSYYGDNWVELK TLGNISTGETTETNNLIDL YGLQTVDYSNINPMSKVS LRSIWNVKLGELNNQEGS LSNMPNDYFNAVWQDID | | | | | | | | |

FIG. 14GGG

Table 11 - Features of phage F125/10 gene products and assignment of putative functions.

| orf | Start position | Stop position | SEQ ID NO. | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | KLSDIEIGSMRMVKDTEG GVFDGATGEIIKATLFNV GSYTDLDMLAYTLTNYTE PLTLGSSRLISELKEELLTS ESFNVDNRIKVIDSIYEELP NTSIIKNGFVEREVTGSKY LDYGLYEPIEDGTRYKLIV EGEFKDNIEFIYLYNSNPN FNETFIYPSEIINGVAEKEF IAKPSTEDKIPRLNTDVRIY IRPYDSTISKVRRVELRKV | | | | | | | |
| 191 | 11152 | 11204 2 | 1269 | MAIATYNSHVELAKYLVS KADSVYLTIGKSTPWSNE TNPPQPDENATVLQEVIG YKKATKVTLVRPSKSPED DNKNLISYGNKSWVEVTP ENAKAEGAKWVYLESSIV GDELPLGTYRQVGFVMD LVAKSGISKFNLVPSEVES TGTLLFFDNKQFQNRSEQ TTAKERFIVEV | 173. | hypothetical protein KgORF64 [Staphylococcus phage K] | YP_024494.1 | 6e-96 (173/173) | | Bacterio-phage T4, Gp8 | pfam09 215 | 2.26e-03 |
| 192 | 11206 3 | 11552 1 | 1270 | MAINFKGSPYLDRFDPSK DRTKVLFNPDRPLQQAEL NEMQSIDQYYLKNLGDAI FKDGDKQSGLGFTLSEDN VLTVNPGYVYINGKIRYY DNDDSVKITGVGKETIGIK LTERIVTPDEDASLLDQTS GVPSYFSKGADRLEEKMS LTVNDPTSATIYTFMDGD LYIQSTNAEMDKINKVLA ERTYDESGSYKVNGFELF SEGNAEDIDHVSVVVDA GKAYVKGFKVDKPVSTRI | 1152 | hypothetical protein KgORF65 [Staphylococcus phage K] | YP_024495.1 | 0,0 (1151/1152) | | No putative conserved domains have been detected | | |

FIG. 14HHH

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | SVPKSYDLGTAENESTIFN KSNNSISLANSPVKEIRRV TGQVLIEKERVTRGAQGD GQDFLSNNTAFEIVKVWT ETSPGVTTKEYKQGEDFR LTDGQTIDWSPQGQEPSG GTSYYVSYKYNKRMEAG KDYEVTTQGEGLSKKWYI NFTPSNGAKPIDQTVVLV DYTYYLARKDSVFINKYG DIAILPGEPNIMRLVTPPL NTDPENLQLGTVTVLPDS DEAVCISFAITRLSMEDLQ KVKTRVDNLEYNQAVNA LDDGAMEGQNPLTLRSVF SEGFISLDKADITHPDFGIV FSFEDAEATLAYTEAVNQ PKIIPGDTTAHHWGRLISAP FTEERTIYQGQASETLNV NPYNIPNKQGVLKLTPSE DNWIDTENVTITEQKTKK VTMKRFWRHNESYYGET EHYLYSNLQLDAGQKWK GETYAYDREHGRTGTLLE SGGQRTLEEMIEFIRIRDV SFEVKGLNPNDNNLYLLF DGVRCAITPATGYRKGSE DGTIMTDAKGTAKGKFTI PAGIRCGNREVTLKNANS TSATTYTAQGRKKTVQDI IIRTRVTVNLVDPLAQSFQ YDENRTISSLGLYFASKG DKQSNVVIQIRGMGDQG YPNKTIYAETVMNADDIK VSNNASAETRVYFDDPM MAEGGKEYAIVHTENSDY | | | | | | | | |

FIG. 14III

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name [organism] | Acc No | E value and identity | | Name | Acc No | E value |
| | | | | TMWVGTRTKPKIDKPNE VISGNPYLQCVLFSSSNAS TWTPHQNSDLKFGIYTSK FNETATIEFEPIKDVSADRI VLMSTYLTPERTGCTWE MKLILDDMASSTTFDQLK WEPIGNYQDLDVLGLAR QVKLRATFES | | | | | | | | |
| 193 | 115570 | 115728 | 1271 | MPREVRDPYSQAKLFIPT VEEKSIKELEKTYKEKIDE ATKLINELKKERGEK | 52 | ORF262 [Staphylococcus phage G1] | YP_240931.1 | 3e-20 (52/52) | | No putative conserved domains have been detected | | |
| 194 | 115729 | 117651 | 1272 | MAFNYTPLTETQKLKDM YPKVNDIGNFLKTEVNLS DVKQISQPDFNNILASIPD SGNYYVTNSKGAPSGEAT AGFVRLDKRNVNYYKIY YSPYSSNKMYIKTYANGT VYDWISFKLDEGNLYNEG NTLNVKELTESTTQYATL VNPPKENLNTGWVNYKE SKNGVSSLVEFNPVNSTST FKMIRKLPVQEQKPNLLK DSLFVYPETSYSNIKTDN WDTPPFWGYSSNSGRSGV RFRGENTVQIDDGSNTYP LVVSNRFKMGKELSVGD TVTVSVYAKINDPALLKD NLVYFELAGYDTVDDTSK NPYTGGRREITASEITTEW KKYSFTFTIPENTIGASGV KVNYVSLLLRMNCSSSKG NGAVVYYALPKLEKSPK VTPFITHENDVRKYDEIW SNWQEVISKDELKGHSPV | 640 | hypothetical protein KgORF66 [Staphylococcus phage K] | YP_024496.1 | 0,0 (633/640) | | PHA01818, hypothetical protein | PHA01 818 | 5,89e-04 |

FIG. 14JJJ

Table 11 - Features of phage F125/10 gene products and assignment of putative functions.

| orf | Start position | Stop Position | SEQ ID NO. | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Predicted function | Name | Acc No | E value |
| | | | | DIEYNDYFKYQWWKSEV NEKSLKDLAMTVPQGYH TFYCQGSIAGTPKGRSIRG TIQVDYDKGDPYRANKFV KLLFTDTEGIPYTLYYGG YNQGWKLLKQSETSTLL WEGTLDFGSTEAVNLNDS LDNYDLIEVTYWTRSAGH FSTKRLDIKNTSNLLYIRD FNISNDSTGSSVDFFEGYC TFPTRASVQPGMVKSITL DGSTNTTKVASWNEKERI KVYNIMGINRG | | | | | | | |
| 195 | 11767 3 | 11804 4 | 1273 | MAVKYDIGNNEIVLHLRE GKYITGFTTVGGYDKELG QVKVNREILPAYFFDNFA YERYLYYSKPEEVIENKN YVPPQINDDEESQQITVPK EQYDSLKEELELMRKQQE AMMEMLQKLLGQKG | 123 | hypothetical protein KgORF67 [Staphylococcus phage K] | YP_024497.1 | 2e-63 (123/124) | | DUF2977, protein of unknown function | pfam11 192 | 2.73e-12 |
| 196 | 11805 1 | 11942 7 | 1274 | MALNFTTITENNVIRDLTT QVNNIGEELTKERNIFDIT DDLVYNFNKSQKIKLTDD KGLTKSYGNTALRDIKEP GYYIGARTLATLLDRPD MESLDVVLHVVPLDTSSK VVQHLYTLSTNNNQIKML YRFVSGNSSSEWQFIQGLP SNKNAVISGTNILDIASPG VYFVMGMTGGMPSGVSS GFLDLSVDANDNRLARLT DAETGKEYTSIKKPTGTY TSWKKEFEPKDMEKYLLS SIRDDGSASFPLLVYTSDN | 458 | hypothetical protein KgORF68 [Staphylococcus phage K] | YP_024498.1 | 0,0 (448/458) | | PHA01818, hypothetical protein | PHA01 818 | 0,0e-00 |

FIG. 14KKK

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| | | | | KTFQQAIIDHIDRTGQTTF TFYVQGGVSGSPMSNSCR GLFMSDTPNTSSLHGVYN AIGTDGRNVTGSVVGGN WTSPKTSPSHKELWTGAQ SFLSVGTTKNLADDISNYS YVEVYTKHKTVEKTKGN DDSGTICHKFYLDGSGTY VCSGTFVSGDRTDTKPPV TEFYRVGVSFKGSTWTLV DSAVQNSKTQYVTRIIGIN MP | | | | | | | | |
| 197 | 119517 | 121265 | 1275 | MRLRIKNLYTYVEFEEDD KYLKDIFLKRVHTTIGAR QEGFQYSPAYKRGSWDG YVDFYVYEEDKFPTGLLF KIELLGELQSRYNFQFET IDERDESFLSEEDIDDEITL LDNNVGQITLRDYQYEAV YNSLTFYNGIAHLATNGG KTEVASGIIDQLLPQLEKG ERVAFFTGSTEIFHQSADR LQERLNIPIGKVGAGKFD VKQVTVVMIPTLNANLK DPTQGVKVTPKQNISKKI AQEILPKFEGGTNQKKLL KVLLDNTTPKTKVEQNVL SALEIIYQNSKTDAEVLLN LRNHNAHFQKIVREKNEK KYDKYQDMRDFLDSVTV MIVDEAHHSKSDSWYNN LMTCEKALYRIALTGSID KKDELLWMRLQALFGNV IARTTNKFLIDEGHSARPTI NIIPIANPNDIDRIDDYREA | 582 | putative helicase [Staphylococcus phage K] | YP_024499.1 | 0.0 (580/582) | Helicase | HELICc, helicase superfamily c-terminal domain | cd00079 | 1,74e-13 |

FIG. 14LLL

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | | | | YDRGITNNDFRNKLIAKL TEKWYNQDKGTLIIVNFIE HGDTISEMLNDLDVEHYF LHGEIDSETRREKLNDMR SGKLKVMIATSLIDEGVDI SGINALILGAGGKSLRQTL QRIGRALRKKKDDNTTQI FDFNDMTNRFLYTHANER RKIYEEEDFEIKDLGK | | | | | | | | |
| 198 | 12127 7 | 12289 0 | 1276 | MATKTQRKLYQYLEENA TENKFHISTKKELADSLG VSISALSNNLKKLEEENK VVTVSKRGKNGGVIITLV REYDTEELKEFNNSTDNII TSDLQYAKALREKHFPSY RYERKEQRRRTKIEMAQY NAIKDEKRRIIADMNFYSE GLPYPSKDIFNMSYDPEGF YKAYILCKLYDQYAISHM DAKHTSHLKAMSKATTK DEYDYHQHMSEYYRNK MIQNLPRNSVSDNFFGSK MFNTFYNFYLKIKDKNIN VFKYMQNVFKNVTFYYE NGMQPNPIPSPNFFSSDKY FKNYNNYIKGIKKGVNST NRHLGDTDSIINSSDYVK NPAVLHLHQLYTTGLNST LHDIDTMFEQALDLENAS YGLFGDMKHIILLQYNSM IEEEIKNLPREEKDIINKYV KQCIINDYSPTSISPSARLS MFTMQKEHIVYNKQLNK GIKREDLLPLSLGGIVNKD SLSGMDIQNLEQNGNEYL | 357 | putative Rep protein [Staphylococcus phage K] | YP_024500.1 | 0.0 (536/537) | Transcription regulator protein | HTH_2, Helix-turn-helix domain | pfam12 840 | 2.66e-03 |

FIG. 14MMM

Table 11 - Features of phage F125/10 gene products and assignment of putative functions.

| orf | Start position | Stop Position | SEQ ID NO. | Aminoacidic sequence | Size (aa) | Homologous/similar proteins Name[organism] | Acc No | E value and identity | Predicted function | Conserved Domains Name | Acc No | E value |
|---|---|---|---|---|---|---|---|---|---|---|---|---|
| | | | | YMRQHTSTYYILRMFGD YLGYEVNLREVKYIVEKY NLIDKIPLTKEGMLDYNK LIHLVEEVNNYE | | | | | | | | |
| 199 | 12288 3 | 12432 5 | 1277 | MSKKIKELILHKSMKDIHF AREVLDNLPKNLFSAESE DMGYLFTAIKRTAHISDK MSNEALAIKVEQLMGNN KEDEEKVTKTLTYLEDLY KVDVNEKDESVNYEIEKY IKTEMSKEVLVKFIAENK QEDSDNLHELVDKLKQIE VSDISGGNGEFIDFFEDTE KKQELLSNLATNKFSTGF TSIDNHIEGGIARGEVGLII APTGRGKSLMASNLAKN YVKSGLSVLYIALEEKMD RMVLRAEQOMAGAEKSQ IVNQDMSLNNKVYDAIQN HYQKNRKLLGDFYISKH MPGEVTPNQLEQIIVNTTI KKDKNIDVVIIDYPHLMR NPYAKYHSESDAGGKLFE DIRRLSQQYGFVCWTLAQ TNRGAYGSDVITSEHVEG SRKIVNAVEVSLAVNQKD EEFKSGFLRLYLDKIRNSS NTGERFVNLKVEPTKMIV RDETPEEKQEHIQLLSDN GKEDTSKFQNKDNKIEAI NNTFGGLPGV | 480 | putative helicase [Staphylococcus phage K] | YP_024501.1 | 0,0 (480/480) | Helicase | 41 helicase | PHA02 542 | 1,01e-9 |
| 200 | 12440 | 12542 | 1278 | MKFVFFTDSHFHLFTNYA KPDNEFVNDRFKEQIEAL QKVFDIAKKEEATVIFGG | 341 | putative exonuclease [Staphylococcus phage] | YP_024502.1 | 2e-172 | Exonuclease | MPP_Mre11 _N,Mre11 nuclease, N- | cd0084 | 1,01e- |

FIG. 14NNN

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| | 4 | 12580 9 | | DLFHKRNSVDTRVYNKV FSTFAKNDEVPVLLLRGN HDATTNSLYTDSSIDTFEY LPNVSVIKSLNTILKDNVN IVFTAYGDETKEIKTYINS NYDKDMVNILVGHLGVE GSLTGKGSHRLEGAFGYQ DLLPDKYDFILLGHYHRR QYFQNPNHFYGGSLMQQ SFSDEQEANGVHLIDTEK MTTEFIPIHTRRFITIQGEDI PENFEQLIEEGNFIRVIGTA NHAKVLEMDDSMKDKN VEVQIKKEYTVEKRIDSD VSDDPLTIASTYAKQYSPE SEQEILECLKEVL | | K] | | (295/345) | | terminal metallo-phosphatase domain | 0 | 20 |
| 201 | 12542 9 | 12580 6 | 1279 | MKKYREYLNKTDAENLA EDWEKVTEDLWKVFKD MKPKINTLDISNVESKNL DKSKPILQFQDSDGVIENI CNVEGLEDGLSKMKKVF DDSNFEKHYYSRVVDHD EYYWIDYGSHHCFFRVTK GDK | 125 | hypothetical protein KgORF73 [Staphylococcus phage K] | YP_024503.1 | 7e-65 (121/125) | | PHA02275, hypothetical protein | PHA02 275 | 1,65e-21 |
| 202 | 12580 6 | 12772 5 | 1280 | MVVFKQVEVNNFLAIKEA TLELDNRGLILIEGENKSN ESFHSNGSGKSTLISAITY ALYGKTEKGLKADDVVN NIEKKNTSVKLKFDIGEDS YLIERYRKDKENKNKVKL FVNEKEITGSTNDVTDKQI QDLFGIEFNTYVNAIMYG QGDIPMFSQATDKGKKEI LESITKTDVYKQAQDVAK | 639 | putative exonuclease [Staphylococcus phage K] | YP_024504.1 | 0.0 (638/639) | Exonuclease | 46, endo-nuclease subunit | PHA02 562 | 1,71e-21 |

FIG. 14OOO

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| | | | | EKVKEVEEQQNNIRQEIY KLGYQLSTKDFYFQREIE QYNQYKEQLVQIENSNKE KDRLREQEEKQIEAQIEQL ASQIPTIPEDEFKHSEEYN KASQSLDLLSNKLTELNQ VYSEYNTKEQVLKSEIAT LSNSLNKLDTNDHCPVCG SPIDNSHKLKEQENINNQI ENKKQEITSVLEMKDTYK EAIDKVKDKSQEIKDKMS QEDQQEREHNNKINSIIQE ASRIKSDISSLENNKTYLK VKYQHQSVQGLEREEPSK EKHEEDKKELQESIDKHE ENIVQLETKKGKYQQAV DAFSNKGIRSVVLDFITPF LNEKANEYLQTLSGSDIEI EFQTQVKNAKGELKDKF DVIVKNSKGGGSYKSNSA GEQKRIDLAISFAIQDLIM SKDEISTNIALYDECFDGL DTIGCENVIKLLLKDRLNT VGTIFVITHNTELKPLFEQ TIKIVKENGVSKLEEK | | | | | | | | |
| 203 | 127725 | 128321 | 1281 | MKLKILDKDNATLNVFHR NKEHKTIDNVPTANLVD WYPLSNAYEYKLSRNGE YLELKRLRSTLPSSYGLD DNNQDIIRDNNHRCKIGY WYNPAVRKDNLKIIEKAK QYGLPVITEEYDANTVEQ GFRDIGVIFQSLKTIVVTR YLEGKTEEELRIFNMKSEE SQLNEALKESDFSVDLTY | 198 | hypothetical protein KgORF75 [Staphylococcus phage K] | YP_024505.1 | 2e-111 (197/198) | | No putative conserved domains have been detected | | |

FIG. 14PPP

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| 204 | 128336 | 129403 | 1282 | SDLGQIYNMLLLMKKISK MRFEDFLTQELGEPKENTI GELRYCCPFCGEKSYKFY VKQALDSSNGQYHCKKC DESGNPITFMKTYNITG KQAFDLLESKNDIERAPL LTTNNKDLTESEKLILML RGVHQDKGTTSIKPPRLPE GYKLLKDNLNNKEIIPFLK YLKGRGITLEQIINNNIGY VINGSFYKVDGESKVSLR NSIIFFTYDNDGNYQYWN TRSIEKNPYIKSINAPAKQ DEVGRKDVIFNLNIARKK KFLVITEGVFDALTFHEY GVATLGKQVTENQIKKIID YVSIDTSIYIMLDTDALDN NIDLAYKLKTHFNKVYFV PHGDEDANDMGTRKAFE LLKQNRVLVTPESIQSYKI QQKLKL | 355 | putative primase [Staphylococcus phage K] | YP_024506.1 | 0,0 (354/355) | DNA primase | dnaG, DNA primase, catalytic core | TIGR01 391 | 1,95e-16 |
| 205 | 129469 | 129807 | 1283 | MSNNKKDILEFVDEYITA LRVGNEQRQHQLEEMGK EETATLTDVAKAITNLML GVNEQMTDLEYNNELNL NILIDALYKAELNEDVLD YIQESIDKSQEEPKNEEEK GEQE | 112 | ORF127 [Staphylococcus phage G1] | YP_240943.1 | 7e-56 (112/112) | | No putative conserved domains have been detected | | |
| 206 | 129807 | 130259 | 1284 | MEKNISTHTKGISQADME KWIEAVVQGTVDGKQVD EKTAKQLDRIGSRSVSLEE ATRIAKVLNAVTAQEVTG | 150 | ORF098 [Staphylococcus phage G1] | YP_240944.1 | 2e-78 (149/150) | | PHA02277, hypothetical protein | PHA02 277 | 9,45e-43 |

FIG. 14QQQ

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | DFNDAFNAIDLMMIIMED ELGVTQEKVGKAKDKLN EKREAYLKEKQEELRQKQ QEEAQKETESDSNEKVIQ LKKNDEQ | | | | | | | | |
| 207 | 130246 | 130854 | 1285 | MTNSKKKGDTFERKIAKE LTAWWGYQFNRSPQSGG ASWGKDNNAVGDIVVPQ EANFPLVVECKHREEWTI DNVLNNREPHTWWEQV INDSSKVNKTPCLIFTRNR AQSYVALPYNEKVYEDL RNNEYPVMRTDFIIDNIRK DKFFYDVLTTMNGLTSF TPSYIISCYDKKDIKPYKK VESNLSEVSKHEDELINDL LSDI | 202 | ORF064 [Staphylococcus phage G1] | YP_240945.1 | 2e-115 (201/202) | | No putative conserved domains have been detected | | |
| 208 | 130844 | 131263 | 1286 | VIYKEGKISMTSKERPLIV YFSGTGQTERLVNKININN SFETFRVKSGKEKVNKPFI LITPTYKKGAIPKQIERFLE INGSPKEVIGTGNKQWGS NFCGASKKISEMFKIPLIA KVEQSGHFNEIQPILEHFS NKYKVA | 139 | putative NrdI protein [Staphylococcus phage K] | YP_024509.1 | 1e-68 (130/130) | Ribonucleotide reductase protein | Flavodoxin_NdrI | pfam07972 | 1,62e-29 |
| 209 | 131278 | 133392 | 1287 | MATYGKWIELNNEITQLD DNGKNKLYKDQEALDEY LKYIEDNTRKFNSEVERIR VLTKEGTYDKIFDKVPDTI IDEMTKLAYSFNFKFPSF MAGQKFYESYASKQYDE NKKPIFVEDYEQHNVRVA | 704 | putative ribonucleotide reductase large subunit [Staphylococcus phage K] | YP_024510.1 | 0,0 (699/704) | Ribonucleotide reductase large subunit | PRK07632, ribonucleotide-diphosphate reductase subunit | PRK07632 | 0,0e-00 |

FIG. 14RRR

Table 11 - Features of phage F125/10 gene products and assignment of putative functions.

| orf | Start position | Stop Position | SEQ ID NO. | Aminoacidic sequence | Size (aa) | Homologous/similar proteins ||| Conserved Domains |||
|---|---|---|---|---|---|---|---|---|---|---|---|
| | | | | | | Name[organism] | Acc No | E value and identity | Predicted function | Name | Acc No | E value |
| 210 | 133406 | 134455 | 1288 | MDITQKVKQHNKNAVLK ATNWNIEDDGMSDIYWE QGISQFWTPEEFDVSRDLS LYLFQNDYVKARELLVQL MEQTFQPSTPTYNNSGQA NRGELSSCYLFVDDSIES LNFVEDSVANASSNGGGV AIDLTRIRPKGAPVRNRPN SSKGVIAFAKAIEHKVSIY DQGGVRQGSGAVYLNIFH NDILDLLSSKKINASESVR LDKLSIGVTIPNKFMELVK EGRPFYTFDTYDINKVYG KYLDELNIDEWYDKLLD NDSIGKVKHDAREVMTDI AKTQLESGYPYVFYIDNA NDNHPLKNLGKVKMSNL CTEISQLQEVSEIYPYSYS NKNVINRDVVCTLGSLNL VNVVEKGLLNESVDIGTR ALTKVTDIMDLPYLPSVQ KANDDIRAIGLGGSMNLHG LLAKNMISYGSREALDLV NSLYSAINFQSIKTSMLMA KETGKPFKGFEKSDYATG EYFVRYIRESNQPKTDKA KKVLDKVYIPTQDDWDE LAKAVKVHGLYNGYRKA EAPTQSISYVQNATSSIMP VPSAIENRQYGDMETYYP MPYLSPITQFFYEGETAYK IDNKRIINTSAVVQKHTDQ AVSTILYVESEIPTNKLVS LYYYAWEQGLKSLYYTR SRKLSVIECETCSV | 349 | putative ribonucleotide reductase minor subunit [Staphylococcus phage] | YP_024511.1 | 0.0 (348/349) | Ribonucleotide reductase | NrdF, ribonucleotide-diphosphate alpha | PRK09614 | 4.21e-80 |

FIG. 14SSS

Table 11 - Features of phage F125/10 gene products and assignment of putative functions.

| orf | Start position | Stop Position | SEQ ID NO. | Aminoacidic sequence | Size (aa) | Homologous/similar proteins | | | Conserved Domains | | | |
|---|---|---|---|---|---|---|---|---|---|---|---|---|
| | | | | | | Name[organism] | Acc No | E value and identity | Predicted function | Name | Acc No | E value |
| | | | | SWNSLTESEKNTYKKVLA GLTGLDTKQGGEGMNLV SYHEPRPKYQAVFAFMG GMEEIHAKSYSHIFTTLLS NKETSYLLDTWVEENDFL KVKAQFIGYYDQLLKPN PTVFDRYMAKVASAFLES ALFYSGFYYPLLLAGRGQ MTQSGAIIYKITQDEAYH GSAVGLTAQYDYNLLTEE EKKQADKETYELLDILYT NEVAYTHSLYDPLELSED VINYVQYNFNRALQNLGR EDYFNPEPYNPIVENQTN VDRLRNVDFFSGKADYE KSTNIKDIKDEDFSFLDSK EYSTAKEFL | | K] | | | minor subunit | reductase subunit beta | | |
| 211 | 134473 | 134802 | 1289 | MDRKEAMDLLSKAEILFK KHDEFSCVSDINDPMKLF SNSKDAKADDTSKSFQLE FMHDMTMYTLSYGSGQL KLIDLAEGYEAQKATVVN SFPEIIKTLEKDDSEDGKN E | 109 | hypothetical protein KgORF82 [Staphylococcus phage K] | YP_024512.1 | 1e-55 (107/109) | | No putative conserved domains have been detected | | |
| 212 | 134786 | 135106 | 1290 | MEKMNSLVDLNTAIRQK KDVIVMITQDNCGKCEIL KSVIPMFQESGDIKKPILT LNLDAEDVDREKAVKLF DIMSTPVLIGYKDGQLVK KYEDQVTPMLQELESL | 106 | thioredoxin-like protein [Staphylococcus phage K] | YP_024513.1 | 1e-53 (106/106) | Thioredoxin-like protein | PHA02278, thioredoxin-like protein | PHA02 278 | 2.95e-30 |
| 213 | 13531 | 13590 | 1291 | MDELISKSRRYIMRDENH YMLFNEKYNNDRLIEKVC | 198 | hypothetical protein KgORF84 | YP_024514.1 | 7e-109 | | No putative conserved domains | | |

FIG. 14TTT

Table 11 - Features of phage F125/10 gene products and assignment of putative functions.

| orf | Start position | Stop Position | SEQ ID NO. | Aminoacidic sequence | Size (aa) | Homologous/similar proteins | | | Predicted function | Conserved Domains | | |
|---|---|---|---|---|---|---|---|---|---|---|---|---|
| | | | | | | Name[organism] | Acc No | E value and identity | | Name | Acc No | E value |
| | 3 | 9 | | KHGKVTYYTDSVLPYY VLKDLSSHPDSEVVYRMR NGFTAKEVDNIALSFMGT KVIIDISVVFPYVNPYDIIR SLHDIKTNVDEVHLSFPRI LEVDEKQEKFYFFDGEAY DLKPEYKVDFADKIRVSL SVWKMYIYILTSSRDFED VDNVITKLKQQRKIKI | | [Staphylococcus phage K] | | (196/198) | | have been detected | | |
| 214 | 135919 | 136224 | 1292 | MSTANRRDIARKISENTG YYIQDVEEILSAETDAISD LLEEGYTKVKNHKFMQIE VIERKGKKAWDGLNKEY FHLPNRKAIKFKPLKELEE VIDRLNEEEK | 101 | putative integration host factor [Staphylococcus phage K] | YP_024515.1 | 2e-51 (101/101) | DNA binding / bending protein | Bac_DNA_binding | pfam00216 | 4,57e-12 |
| 215 | 136300 | 139518 | 1293 | MKVLILFDHIREEHFSVSK DGSVKSNVLNTPNGKTLK KLLEKCSNLKRDKTNRDY DIDFLYNAVPTPIRNDYG KIIKYQDVKQAEVKPYYE RMNNIIDNSYDMIIPVGK LGVKYLLNVTAIGKVRGV PSKVTIENGTSSHDVWVL PTYSIEYTNVNKNSERHV VSDLQTVGKFVEQGEEAF KPKEVSYELVDNIERVREI FNKEVKNDNYDGVDITA WDLETNSLKPDKEGSKPL VLSLSWRNGQGVTIPLYK SDFNWENGQDDIDEVLEL LKNWLASKEDIKVAHNG KYDIKFLMSTENFKDFESI QDTKVGWYLAVTQEVKE SLRLSDLAYEVTDVGGYD | 1072 | putative DNA polymerase [Staphylococcus phage K] | YP_024516.1 | 0.0 (1065/1072) | DNA polymerase | DNA_pol_A_pol_I_C, Polymerase I | cd08637 | 7,32e-72 |

FIG. 14UUU

Table 11 - Features of phage F125/10 gene products and assignment of putative functions.

| orf | Start position | Stop Position | SEQ ID NO. | Aminoacidic sequence | Size (aa) | Homologous/similar proteins | | | | Conserved Domains | | |
|---|---|---|---|---|---|---|---|---|---|---|---|---|
| | | | | | | Name[organism] | Acc No | E value and identity | Predicted function | Name | Acc No | E value |
| | | | | KPLEDFKLWFVTKLLRFF SDKIKEIQKENKKIAKKEY DVKAPEYKEWLENKLNE TVVELDDTEKKFRVSELE KKYIQLGLSPEIVNMNLV MNNDFFISIAEQSPEYMG LSDYAKSYTLNTAINLINE YRDVKDVVNDIDGGNFN YDWFPIELMHPYASGDTD VCRRIHCDVVKKLKEQDR PKSMIHLLEVNYPRLTKSL ARIESNGLYCDLDYMKEN DESYESEMAKNHATMRE IIWAVKEFEEYQYNLYQM ALEEHEKKPKDRDKDIHQ YRDKFKDGKWMFSPSSG DHKGRVIYDILGIQLPYDK EYVKEKPFNANVKEADLT WQDYKTDKKAIGYALDN LELKDDVRELLELLKYHA SMQTKRNSFTKKLPNMIN KQKRTLHGSFSETGTETS RLSSSNPNLQNLPAHTSD VNKFDYKHPIKRSFVSRFE NGVLLGADYSALEMRIIG LFTKDPDMLQSFLNGEDI HKATASIVYNKPVEEVTK EERQATKAVNFGLAFGES PSFAGKNNMEVSEAEEIF EKYFQTKPSVKTSIDNVH EFVQQYGYVDTMHGHRR FIRSAQSTDKKIKNEGLRQ SFNTIIQGSGSFLTNMSLT YLDDFIQSRNLKSKVIATV HDSILIDCPPEEAKIMAKV TIHMENLPFDFLKAEIDG | | | | | | | | |

FIG. 14VVV

Table 11 - Features of phage F125/10 gene products and assignment of putative functions.

| orf | Start position | Stop Position | SEQ ID NO. | Aminoacidic sequence | Size (aa) | Homologous/similar proteins ||| Predicted function | Conserved Domains |||
|---|---|---|---|---|---|---|---|---|---|---|---|---|
| | | | | | | Name[organism] | Acc No | E value and identity | | Name | Acc No | E value |
| | | | | KEVQYPIEADMEIGLNYN DMVEYDEEIDT | | | | | | | | |
| 216 | 139588 | 139830 | 1294 | VNTGEIRFNRSMDEWIITS MYQDELGEMNIVVTFYN REENKHGSTVLPTESSTGE VAEELASLEEEYPLALPLS SISVNI | 80 | ORF181 [Staphylococcus phage G1] | YP_240959.1 | 2e-36 (77/80) | | No putative conserved domains have been detected | | |
| 217 | 139847 | 140329 | 1295 | MEIHIDSLDFTNFTIKDRN GNSQEFDITDELRITEYTIQ EDFMQQSAKYAFWASILE KVRAYSEMEQRNLETIGS KLNLTIRQEYFQQGKKPT KDMIESSVYIHDSYQQQL KVVEAWNYKVKQLQYV VKAFETRRDMMIQLGAEL RQTNKNGGITNPFSH | 160 | hypothetical protein KgORF91 [Staphylococcus phage K] | YP_024519.1 | 6e-90 (160/160) | | No putative conserved domains have been detected | | |
| 218 | 140416 | 141687 | 1296 | MDFNQFINNEASKLESNN SSFNNNVESYKPKNPVLR LGNIKDANGNKVVKENA FVRVLPPAQGTNVFFKEF RTTGINYSKDGSQGFTG LTLPAEEGSSVLDPYIQD WITNGVQFSRFPNKPGVR YYIHVIEYFNNNGQIQPKT DAQGNVMIQPMELSNTG YKELLANLKDTMLKPSPN APHSFISANEAFLVNIVKA KKGEMSWKVSVYPNAPL GALPQGWEQQLSDLDQL AKPTEEQNPNFVNFLINN VNNTELSHDNFKFNRETN VLGEEPSEPKQAPTQQDV | 423 | hypothetical protein KgORF92 [Staphylococcus phage K] | YP_024520.1 | 0.0 (421/423) | | No putative conserved domains have been detected | | |

FIG. 14WWW

Table 11 - Features of phage F125/10 gene products and assignment of putative functions.

| orf | Start position | Stop Position | SEQ ID NO. | Aminoacidic sequence | Size (aa) | Homologous/similar proteins | | | Conserved Domains | | |
|---|---|---|---|---|---|---|---|---|---|---|---|
| | | | | | | Name[organism] | Acc No | E value and identity | Name | Acc No | E value |
| | | | | DSQMPSNMGGQPNQPQQ GQVGQYAQQGQSNGQGQ QLQGTQQPINNTQFGQGT PSGQQPSNTGSVDWDNL AQQQSQPDSNPFNDFDVS SVDDSQVPFETQPQNTQQ APEPHQTTQEPPKQKQTQ SIDDVLGGLDLDNL | | | | | | | |
| 219 | 141749 | 143014 | 1297 | MARAKKGKEVDLTDLNT IDLGKELGLTLLSDSNRA DIKNIVPTMVPQYDRILGG GIPLGRLTEVYGLTGSGKS SFAVHLSRISTQLGVITIWI DIEGTADNNRMEQLGVD VSKLFSIQAGEGRLKNTV ELSVETVGKELDYWIDTF NEKAPGVPILFIWDSLGAT RTQAEIEEGVDHRKLGTK ATATQKVINAVSPKLNDT NTGLIVINQARDNLNMSN PYDDPIKSTGGRAFEHGA SLRLKITKGKESDLKQSDS MTGKPTYKGHVMRVETK KSKLSRPGQKAEADLLSG YEVGSGSDITQLNGIDPYH TIYKEAVERGLITKGTWR NYITLNGEEIKLYDKDWV PRLIDDHELYLELFSRVYG EHFPNGYSPLLNTKVIVTQ LEEYQALENYYEEWAKD NKQEEQEEESKGESQEKD SE | 421 | putative DNA repair protein [Staphylococcus phage K] | YP_024521.1 | 0,0 (351/421) | RecA | cd00983 | 6,13e-22 |

FIG. 14XXX

Table 11 - Features of phage F125/10 gene products and assignment of putative functions.

| orf | Start position | Stop Position | SEQ ID NO. | Aminoacidic sequence | Size (aa) | Name[organism] | Acc No | E value and identity | Predicted function | Name | Acc No | E value |
|---|---|---|---|---|---|---|---|---|---|---|---|---|
| 220 | 143018 | 143371 | 1298 | MYNLIDKNMRQVKESLG NANSSDVLPLPYKDIAKK FEEVKEKGESIIEEGGFPY TDSTVMYIEHVTDRWAG GYSLIRHEGEEVKVPKTIH FSDIYVKDKSHKVRIIFEG ANPYEEG | 117 | ORF121 [Staphylococcus phage G1] | YP_240963.1 | 2e-59 (114/116) | | No putative conserved domains have been detected | | |
| 221 | 143358 | 144020 | 1299 | MKKAKNGNRYVIDIDGIP VDFERDLDSLLNRYKNLR WSLYHKYAGILSNDFERQ ELREYIDEQFIKLVKEYNI RSKVDFPGYIKAKLTLRV QNSYVKKNEKYKRTEIIG KKDYTVESLTEDLNEDFE DNQIMSYVFDDIEFTEVQS ELLKELLINPEREDDAFIV SQVAEKFDMKRKEVASE LTELRDYVRFKINAYHEY YAKKELNNHIRVNTENHI WEN | 220 | putative sigma factor [Staphylococcus phage K] | YP_024522.1 | 2e-121 (218/220) | Sigma factor | No putative conserved domains have been detected | | |
| 1a | 144114 | 144994 | 1300 | VRIEKHKIKNNKVINEMSI TANNLYNHANFILRQNFF NNKTNKGYRKFLNYNTH RILKNMNEENYIKLPRQTS QQVLRDLINNWSSFRKSE KDYFKNPNKYRNRPKPPK YKAKGGKGTIKFTNQQCR IHKKDGLIHLPTPLQDITIK PYKAKNIRELVCIPKSDYF EVLVCYKEENSNKTLNDN ENIASIDLGLDNLITMVSI VDKPIIINGKGLKSKNKYF NKKIRYYQSLLQNNSYSS KRILKYWEKRHNIILDYF | 293 | IS element Dka2 orfB [Hyperthermophilic Archaeal Virus 2] | YP_003773391.1 | 5e-18 (109/405) | Transposase | orfB_IS605, probable transposase | pfam01 385 | 2.87e-36 |

FIG. 14YYY

Table 11 - Features of phage F125/10 gene products and assignment of putative functions.

| orf | Start position | Stop Position | SEQ ID NO. | Aminoacidic sequence | Size (aa) | Homologous/similar proteins | | | | Conserved Domains | | |
|---|---|---|---|---|---|---|---|---|---|---|---|---|
| | | | | | | Name[organism] | Acc No | E value and identity | Predicted function | Name | Acc No | E value |
| | | | | HKATNEVVKYCVKNDIS KVVIGYNKQQKYKSKLK | | | | | | | | |
| | | | | | | | | | | | | |
| | | | | | | | | | | | | |

FIG. 14ZZZ

FIG. 15A

```
                              sequence.txt
                           SEQUENCE LISTING <110> DA COSTA GARCIA, MIGUEL ANGELO
      SOUSA DE SAO JOSE, CARLOS JORGE
      RODRIGUES LEANDRO, CLARA ISABEL
      RODRIGUES PARDAL DIAS ANTUNES MARCAL DA SILVA, FILIPA MARIA

<120> ANTIBACTERIAL PHAGE, PHAGE PEPTIDES AND METHODS OF USE THEREOF

<130> 16395-105003US1

<140>
<141>

<150> 61/384,015
<151> 2010-09-17

<160> 1300

<170> PatentIn version 3.5

<210> 1
<211> 113073
<212> DNA
<213> Unknown

<220>
<223> Description of Unknown: Bacteriophage F391/08

<400> 1
attatgcaaa ctaaacgaaa tcatacactc cactaattaa aggttgacaa catgaaacgc        60
tttgtaatat catctaaacc ggcggcaaaa ttgaacaaaa tggcaagctc ggaactggtc       120
aaaatgcagc gcgatatggc gcggcgttac cgctcttatc agcgcggagg tcagcaaggc       180
ttaccgatga tttgggataa catgatgcgt tatctaaaat ctttacaaaa taacgtttga       240
caatctgccg ataacgcttt attatagaat ctcaataagc aacaccgctc tttaaaaatt       300
tggaaaagtc gattctctca gtaagggtaa ttgagttttc tgttaacact ctagcagtaa       360
aagagtgtta accggataac ccaataaact aaactggagt aagaaacatg caaaacgtta       420
aaaccccaat gatcggtgat tccgtttta ttcctttcgt tactggcgac gtaagtaagc        480
cgggcgaaaa tgaaaaaatc ggatatatca aggggcggc gatgatcccg tttgataaaa        540
ttaatgcggt atacgccgaa acggaaaaag caaaaaacag cgacgcgaag atttacagcg       600
tccgggtaga ttccggcgac gtggtgaaag tcattcgcaa agatgataaa tggttggctg       660
tcgcttaaca gccaataagt ttaaccccgg caaataatgg gatgcttccc ctatgttaga       720
cttccgatgt atattccatg cagcgcaagc aatgttatgg tgcgcaaatt aaacttatgt       780
gctggaactt atatcatgct ttgaacggca attgtgagtt aacacgaatc tatagcgtga       840
aatagacgta atagcgtaat tattaaaggc agcgtatata tacaatgccg ctttaaatag       900
ctttaaattg aaaactaaaa taaagagttt tcgttatata ttctagctag aatatatagc       960
ggctaacttt ctagccttaa cccttaaata aaactggaga tatatcatga ctgctactaa      1020
```

FIG. 15B sequence.txt

| | | | | | | |
|---|---|---|---|---|---|---|
| aaccgaaaaa | ttcgcatgga | acgaaacaaa | cgccgctacc | gccgttgaaa | tgtacgaaaa | 1080 |
| gatcattgct | tccgatggtc | tggaggtggc | taactcgcaa | ggtcttattg | atattgcaaa | 1140 |
| ggctgtaggt | gctgaatcgc | atgttaaagt | gcgctctaaa | ctggttagcg | caaaggtgta | 1200 |
| tcagaagtcc | gataagccgc | gcaaagtcgg | cggcggctcc | tccctgcgta | aagctcacta | 1260 |
| tgtgcgcgtt | ctcactcagc | acgccattgc | tgacggcctg | attgatgatg | ccgatggtct | 1320 |
| ggcaagtctg | gaacaaatga | agctcgacca | actggacgtt | atcgcccgta | tggttggcgt | 1380 |
| tcaggatgaa | gtaaaagaat | cagcagaata | attataatgc | gcctccctag | cggggcgcat | 1440 |
| aattaaatat | tttgtccccc | ataactggag | aaataaaaat | ggctttaatt | aaaggctccg | 1500 |
| ttattaaatt | aacgggaacc | gttgtggatg | aattaatcca | aacggggtat | caggataata | 1560 |
| aggttatgac | gcccccaagc | gttaaagtac | ctgaatatat | tgttttgtgg | gttaaccctg | 1620 |
| atgcggatac | tttcgggatg | gctattaacc | gcgaagtctt | taagccggaa | atgctggaat | 1680 |
| tatcttcccg | cgaaatttac | cttctcaatt | acgctttcag | cgtagaagaa | aaggaggttg | 1740 |
| taaaatgatc | ttttccccta | ctgaatcctt | aattcttatc | gctggctttt | tcgccgccgc | 1800 |
| ttgtctctat | ggttactata | atttcatgga | aataggcagc | gaacaaacgg | atttattacg | 1860 |
| ccgtgacttc | tggttcaaga | aagcgagtat | ttgccgccgc | tggtcaataa | tctttattat | 1920 |
| tctagcggta | actttcggaa | tatcagcaag | cattatcccg | gcaatagttt | agagtcgcaa | 1980 |
| attataacgc | caccagcaac | aaggcgttat | atttggcaat | tctgcctata | tcccattaac | 2040 |
| tggagaattt | agataatgat | cattgcaatt | gagaaacaaa | aagctatttt | aaccgctgct | 2100 |
| aacaacctca | attttggggg | taaacgcctg | cgcgctaaaa | agctggagat | ctgcgacgaa | 2160 |
| ttgagcaaag | agcattacgg | gacggcgaaa | cactctagcg | aaatttgcga | ttggctggat | 2220 |
| agtaacaagc | ctgttaaacc | cgctgctgaa | aaacgcgccc | aacgtgttgc | ggtggaagat | 2280 |
| tcccgccccg | ttgccgctgg | tcagcttaat | tccagcgtcg | aaagctggaa | ggtaattccg | 2340 |
| ggccgccgtt | ttctgctaac | gtcgattcaa | aataatacct | tccctcatgc | taatttctgg | 2400 |
| aaaactttac | aggaggccgc | gaaatatctc | ggcgctactc | tgttagtaag | caaatacgcc | 2460 |
| tacaacaaaa | aaggcttcca | aaacgggcaa | ggcaacgatg | aactgaaata | tgatgatgct | 2520 |
| ttctcagatt | tcatttgtga | tgaaaacgtg | tttttgggca | accgcgaaac | cggattcgca | 2580 |
| ttcatggcgg | aaattaatat | tctgccaact | gctgattttc | cgctgtccgg | ctttggcgag | 2640 |
| actgcgaccg | cctacggcct | gaaagggctg | gctattggtc | acgctaaaat | caccgccgaa | 2700 |
| agtgtcccgg | caatgaaggg | cgacactgtg | cgccgtatgt | attcaactgg | cacagcgacg | 2760 |
| ctgaaaaatt | atattcagca | aaaagcgggc | caaaaggccg | aagcgctgca | taactatggc | 2820 |
| gctttgctgg | tagagatcga | cgacaacggc | aacttctttg | ctcgccaaat | cgaaacgatg | 2880 |

FIG. 15C sequence.txt

```
gacgaaagcg ggatgtttta cgatcttaat cataaattta ctgttaacgg tggcgaggag    2940
gtaacgggcc acgttgccgc gctgcaatat ggtgacattc acgccgaaaa gctggatcac    3000
gctgtcgcct ttgcttcatg ggggccgtgt gatgattctc tagtgaacgt cctgcgccct    3060
cgttaccaga ttgtgcatga tgtgcatgac tttacatcac gaaaccatca taaccgcgct    3120
agtggcgttt tccttgcgaa acaatatgcc gccggacgtg acaaggtaat tgacgatctt    3180
atcgataccg ggcgcgtact agaagcaatg gaacgtgaat tcagtcaaac ggtcattgtt    3240
gaatcgaacc acgatcttgc gctttctcgc tggctggatg atagtaaagc taacattcaa    3300
caagacccgg cgaacgccca tctttattat cgcctgaatg ctgcgattta tgaagcaatc    3360
gaaaacaagg acgatacttt taacgtacta gattacgccc tgcgcaatgt tgctggctgc    3420
gattttgctg cgatcttctt aaccacggat gaatctatga aaattgcggg catcgaatgc    3480
ggttcccacg gtcacaacgg cattaacggc gctcgcggca acccgaaggg attccgcaag    3540
ctcggcaaga tgaacactgg ccatacgcat acgcccagca tttacggcgg cgtttatacc    3600
gctggcgtcg ctggttccct cgatatgggt tacaacatcg gcgcgtctag ctggtcacaa    3660
acgcatttga tcacctatga aaacgggcaa cgtaccttga ttgactttaa agacggcgtt    3720
ttctttgcat aacaaaaaag ccggggtaat tgccccggca ataaataacc cataaataaa    3780
taaataagct ggagaaacaa atgaaactta ctttcatcta taacaatcgt aaatctttca    3840
ccgcgtccaa cgtcgtagaa aatagccttg ttatttcccg cgatagtgaa gggcgcccgc    3900
atgttagcta tcagaaagtt aacacggtgg acggcgacac tgttttaaaa gctctagccg    3960
ctatcctccc gcgccccgct gaatttaaag aatccggcat tgtgtcgcaa ttagtcgccg    4020
ccgattctat tctttatgag gctgatatct gcgagatcgt agagattgac gccgccgccg    4080
ctggccttat gtttatcgtc gtaagcgaaa atgattatga tgatacctat ctgctcggcg    4140
acgtgatgga ttattcttct agcgaatata cgccgccgct ggcaattgtc ccggtaatgg    4200
ctacccggat taaaccggct gaattagccg atgccttaac tttattcttc tgataattaa    4260
caaagcgagt tataatatag ctcgcttgat taattaccaa caaccccgaa accggagaaa    4320
tgaaaaatgg cttttaataa actggcaatt aaggcaatta agttatggga tttagacgga    4380
actgttatta attcctttgc ccgcgtgttc ccgtgtatgg atgataaagg gaacttagat    4440
ttaaacatgt accgggaaaa ggcttgcgta catgatgcaa ttatgaccga cactctttta    4500
ccgctggttg aatatatgcg ggcatcgctt aacgatccca ctgtattaaa cattattgtc    4560
accgctcgtt atatgggtaa gagtgactac tatttcctac gcaaacaacg tatccgggcg    4620
gggcgcggtg gtaatatcca gatactgtcc cgcgatgtat tgcaccgata tattggcgat    4680
gctgattata aagaggtgta ctattcgaaa gatggtatct ataaaacgca ttatttcgaa    4740
atgcttaaag ctgaatatcc gaacgctact atcactatga ttgacgataa tagaggcgtg    4800
```

FIG. 15D sequence.txt

| | | | | | |
|---|---|---|---|---|---|
| ttggctgctg | ctgctgctgc | tggccttcaa | acgatggacg | ctaccgcaat | taacgatatt | 4860 |
| ctatctattg | gtgtgcgcct | tgcgggtgag | tcattcatag | atgaagcgct | ggatgatgat | 4920 |
| aatgattatc | aatatctttg | cgagcgttta | gctcattgct | gggaaggtat | gaccgaagaa | 4980 |
| gaaagaagcg | actacggaat | taagccgcaa | caatttattc | aatcgttagc | catcgcatca | 5040 |
| taagaaagct | aatagtaccc | tagcgaaata | gttagggtac | taatagttag | ctagggggt | 5100 |
| aatcggacta | ccataccacc | ccccgaccct | ctaagcccac | ctccatgtgt | aactttatga | 5160 |
| aatttggaga | aaaggctaaa | gggagtactt | aggcaaactt | agaacgagca | gcccgaatca | 5220 |
| aagctactac | tgctactgcc | gctgtcgcaa | taagaacttc | ccgagtcata | cccgctatac | 5280 |
| gttgcaactg | ccgcagttgt | agctatgatt | gctgcagtcg | acccatcatc | gctccgagaa | 5340 |
| cttcccgagt | tcgatgaagg | acttcccgaa | actttccgag | aattatccga | gcctgcccgt | 5400 |
| ttttgcttgc | gtttcgcgac | ctgtggtgtc | actggaggga | tgtagtacgg | gttgctcggg | 5460 |
| tcattccgaa | gatcgttcat | gactcgttgg | tgttttgaga | tcgctacttg | acgttctgcc | 5520 |
| cgagtttgaa | ggatctcttg | atgcagactt | tgttacgaa | gatctgccgc | tactaccgcg | 5580 |
| ttccgcaggt | catgtgcccg | cacaccaaac | caaactgctg | ccaggaaaaa | gaatgttgtg | 5640 |
| aaaattaata | caatagtcat | gttttacacc | atacccttag | taatgtagat | tttgtttgct | 5700 |
| gattctagtt | ctgccttgca | ttcagacagg | tttaactgtg | ccttatgcag | caaacgggtt | 5760 |
| tgattgtcat | aagacttctg | cagcaccccg | ttagtgcgtt | ctagctgttt | gattgcctta | 5820 |
| ccctgcttta | cggtaatgac | gaatagtacg | attgagagta | aaacaagtgc | tcctataact | 5880 |
| acttccatag | tggtcctcct | agatggtttt | aaaaaatctg | gtttacttgg | cggttgattt | 5940 |
| aatttataat | aatattatat | tataaaagtc | acttgttagc | aagtgagatt | tgaggtttt | 6000 |
| tatgggcttt | tatgcaggaa | ggataggcga | caaaaaagtg | ttgtctctta | cctctggcaa | 6060 |
| caataaagac | gttaataacc | acactaatcc | aggttgggat | actatattcc | atagcgatat | 6120 |
| gcctcacgtt | gtagttttag | aaactcacga | aagagacctc | tgggatggtg | gtgattggta | 6180 |
| tcgttgtact | agaatgccag | acagaattat | tcaggtactg | tccgcagact | acgacagggt | 6240 |
| tgtcttaact | gaagttgagt | ttgaggatgg | caccagacgt | ttcatttatg | gtacatccct | 6300 |
| gggtgtgggc | gctaaagcgt | ataacgctta | ctttagtaat | actgtcggtt | cccaggcttc | 6360 |
| tgcaggtact | atggctagta | tgaagactaa | cgttgtgct | tctgcagact | tacacatgga | 6420 |
| tattagtttc | tatttcgaag | agacgccagg | tactattaac | gagaagctac | gagacggtac | 6480 |
| tgggtgtatg | tacacctggg | gcgttaactc | agaatgggga | gacagagggc | ctgggccgcc | 6540 |
| ggttggagct | cctatacgtc | ctaactttga | gactattatt | aaagctggat | gggtgctcta | 6600 |
| taggggggct | tttagtggca | atatagccgg | ttctgtgtct | ccgcccaata | gacccctcac | 6660 |

FIG. 15E sequence.txt

| | | | | | | |
|---|---|---|---|---|---|---|
| tattggtgtt | gatgctatgc | gccacccgtg | gatgcgtact | actggtgtta | acagtatatg | 6720 |
| tttgcgtggt | gagactctca | accgtaatat | gtacggacat | atggggccta | gatatgggca | 6780 |
| gagctccaat | cccgttggtg | gtccttatgc | tcataacatc | cagactgagt | cttatcagga | 6840 |
| ggttcagtac | aaagcaggtt | ttttccgtgg | tccgcccaat | aactttatgg | ggtgggaaaa | 6900 |
| cacagataac | aacaatgctg | gtagtggttg | gggtaacaat | gccatttacc | gtgacaataa | 6960 |
| cttccgtgtt | cctaaacgtg | ttcgctggta | tattactaat | atgaaataca | atgggcaggg | 7020 |
| gttctacgca | gagaacgtat | ttggctcccg | caaccaggag | attaaaatca | gccctagaga | 7080 |
| gttcattgta | aacggtataa | acctaatgaa | cactgggtgg | aagttcataa | accagaacga | 7140 |
| tataaactac | agcccaggta | ataggcctga | tatccgagtt | attgcaacca | acgtcgccag | 7200 |
| atttagtggc | aaccctactg | ttggtaataa | tggatatgtt | cactttaatc | agcctctaac | 7260 |
| tcgaccagat | aatggtgctg | agtttggaca | aggtaacgtg | agtgagatgc | atgtaaccac | 7320 |
| tgtaggggtt | tacaattta | gatctgatgc | acagtggtac | gtaaaatcta | acccgccgga | 7380 |
| aatcggaaac | cagtggggtc | cagtatggtc | tgaatcaact | cgacctctcc | gcctagtggg | 7440 |
| cggtaccggc | tctgctgata | ttggagggaa | cctacgtact | agcggtaatg | ctagtcacca | 7500 |
| cctggctacc | ttgtggttag | gggttaataa | ctcccgaaat | ggggcttgcg | tcgtcactct | 7560 |
| agactggaaa | aatgatgagt | ggattgctgc | tgcagggatt | ggatgttata | accctctaga | 7620 |
| agatcttacc | cagtggagcg | aggtggatag | taggctgaga | attttcggaa | atcacttcca | 7680 |
| gaaacgtgtg | catcaaatca | tgtgtttgcc | cgttaacatg | tgtgtgccgt | tccactttat | 7740 |
| acgcgggacc | gtaacccagt | gtgggttat | tcctgggaac | aacgccatgc | aaatgaaggc | 7800 |
| tatgtgggca | cctactacta | ccaactctgc | cactcagggc | gattatgcca | ttatctattg | 7860 |
| gctgatagct | agggctgacg | gtagtgttga | agtttggtt | aacgttgaga | tgagcaatat | 7920 |
| catgaatatg | cgagtaattc | ttcctgaggt | taggattgct | gtgcaaaggc | ttgcctaaag | 7980 |
| gaggcaatat | gagcaatgat | ttaattgtac | cagatacaat | gtctccggaa | ggcatgctag | 8040 |
| ttatagaggc | ctacctggag | tctggcagcg | acgttgcgaa | agcagcgtta | gctgttggca | 8100 |
| tggaggaacc | taaattccgg | gagattatgc | gtaaacctga | ggtcaaagcg | taccttacgg | 8160 |
| atatcttcat | ggaatctggc | ttccgtaacc | gtgataaatt | cttcggcatt | ctagacactg | 8220 |
| ttctaactat | gaaaatggag | gaactggatg | aaactggaat | gggttcagag | atggatatta | 8280 |
| tggatatcct | caaactcatg | cacaaaatga | agatggatga | gatgaagatg | cagatcgagt | 8340 |
| atgagaaggt | gaagcaagct | aaagctccaa | tacaccaaaa | taatactcag | atcaacctgg | 8400 |
| caggggggtca | cgactctaat | tacacggacc | ttctgtcacg | cattgtggga | gcaggtaagt | 8460 |
| aatggaaatc | tcacgtagtt | atattaatac | gactgacgtg | gtggattttg | gtgttgataa | 8520 |
| acgattcttt | aaattcccgg | tgtccggctt | gctggccacc | gagggatcg | ttccaaatgg | 8580 |

FIG. 15F sequence.txt

| | | | | | |
|---|---|---|---|---|---|
| cccgcagtgc | gcaatcataa | acgcactgga | agacccacgt | caccgtttcg | ttacagcatg | 8640 |
| cgtatcacgt | cgtgttggca | agtcgttcat | tgcgtatact | ctaggcttcc | ttaaactcct | 8700 |
| agagccgaac | gttaaggtgc | tcgtagtagc | tccgaactac | tccctggcaa | acatcgggtg | 8760 |
| ggcgcagatc | aaaggtctga | ttaagaaata | cgggcttcaa | actgagcgtg | agaacgccaa | 8820 |
| agataaagag | attgaacttg | ctaacggttc | gctctttaag | ctggcttctg | ctgcgcaggc | 8880 |
| tgactccgca | gttggtcgtt | catacgactt | tattatcttt | gacgaagcag | cgatctccga | 8940 |
| cgttggtggg | gacgcttttg | atattcagct | ccgtcctaca | ctagacaaac | ctaactctaa | 9000 |
| agctctgttt | atctctactc | ctcgtggcgg | taactggttc | aagcgcttct | atgaacaggg | 9060 |
| attcagagag | gatcttccgc | aatgggtatc | aatccacggt | acataccgag | ataaccctcg | 9120 |
| cgtatctctt | gcagatatcg | aggaagcacg | taagactgta | tctaagaact | acttcaaaca | 9180 |
| ggagtatgag | gcggacttct | ccgtattcga | aggtcagatt | tacgacacct | tcagcgtttc | 9240 |
| cgagcacgta | caggatcttg | caggtatggg | gcacttcttt | gctgcggacc | atgagttcga | 9300 |
| aaccattcta | ggtatcgacg | ttggttacag | agacccgaca | gcagtactta | ccattaagta | 9360 |
| ccactatgac | caagatgtgt | actacatcct | tgaggagtac | cagcaggcag | agaagactac | 9420 |
| agcacagcat | gccatgtaca | tacaacactg | catagaccgg | tataacgtag | accgtatctt | 9480 |
| cgttgactcc | gcggctgcac | agttccgaca | ggacttagca | tacgagcatg | aaatatcctc | 9540 |
| tgctcctgcc | aaaaaatctg | ttctagatgg | cctggcatgc | ctagctgctc | tattccagca | 9600 |
| gggtaagatc | attgtcgacg | cctcgtgcac | tgcgttaatt | cacgcactcc | agaactacaa | 9660 |
| gtgggacttc | caagaagggg | aggaaaagct | ctccagagag | aaacctcgtc | acgatgccaa | 9720 |
| ctctcactta | tgtgacgcac | tgcgttacgg | catctactcg | atttcccgtg | gcaaataaga | 9780 |
| gctgagttgg | aacggatagt | agtgagtaca | aattccgttc | caactttata | aaattcactt | 9840 |
| tacaatttcg | tgtgtggcag | ttataatata | ttcataccct | gagagatctc | atagacatca | 9900 |
| gggtgaatga | gaggaatatt | taattgctat | acccgaagta | gtattttccc | aactaagagg | 9960 |
| aggaacactt | tggcttccaa | tgtaaaatat | aagagagatg | caatctccat | aatgcgtgac | 10020 |
| ggaatcaaag | cccagtacaa | aagaggcaac | tgttgcgcca | tttgtgactc | acaggaaaac | 10080 |
| ctggagctac | accactactc | gactgtggcc | ttactagtta | aaaactttgc | taaagaattc | 10140 |
| caactggatt | tcactgactc | agaagtcgtc | ctaagtaatc | gggataagtt | ctataaacat | 10200 |
| tattggcatg | agctagtaga | ggacacggtc | accttatgtg | tctttcatca | tcagacctta | 10260 |
| cacaaggtct | atacgaaaga | acctccgttg | ttttcagcta | acaaacagaa | gatttgggtt | 10320 |
| gagaaacaac | gtgaaagatg | tatgaatcca | gaggcacctc | gtacaagcaa | cactggcgaa | 10380 |
| agatcaggct | ttgcgaagtg | gcttccgact | gacgtcaaga | ctgagaaatc | aggattcgca | 10440 |

FIG. 15G sequence.txt

```
aggttcctat aatggctatt cgtgactggt tagttactaa actaaaccgc ggacaacgca   10500
taatcaggga cttggaggat gttagtcacc gtactaacgt caagccattc acgactggca   10560
aagcctattc gtctattgag atccttaata gatccgcgaa catggtaatt gacagcgccg   10620
ctgagtgctc ctacaccgta ggtgaacagt ataaacaat aacaacctat ggcacgatca    10680
ggagtaaaac tcttgagacg ctgcttaatg ttcgccctaa cccgtacatg gattccagta   10740
cttttagacg cctaatagtg tctgaccttc tattcgaagg gtgcgcgtat atccattggg   10800
acggttcgtc tctgtaccat ctgcctgctg ccctaatgga agtaaaagca gatgacaaaa   10860
aattcgttaa caaattcgtc tttaataata tgatcgacta tcgcgttgat gaaattatct   10920
tcatcaaaga taatggccag aatggtggta ttaactccca gattacgggt caatctcgtg   10980
tggctaccgt aattaactcg cttactaagc gtgagaaaat gcttgagttc aaggagaaat   11040
tcctggacaa tggtacggtt atcggtctta ttctagaaac agatgaaatc ctaaataaaa   11100
agctccgtga acgtaaacaa gaagagcttc agctggacta taccctagt accggccaat    11160
caactgtgct cattctagac ggcgggatga aggctaagcc atactcccaa atctcctcct   11220
ttaaagatct cgatttcgag aacgatatcg ctcgttttaa taaagacgta tgtatcgctc   11280
tcggagtccc acaactattg atcgatgggg gtaacaacgc caatattcga ccgaacattg   11340
agctgttcta ctacatgact attgtgccta tgctcaataa agtatgtagc tctcttacgt   11400
tcttcttcgg ttttaaagta acgcccaata ctaaagacgt agtagcacta actcctgaca   11460
aggagaaaga ggctaaattc gtaactgcac tggtcaacaa cggtatcctt accggtaacg   11520
aaggtcgtat agagcttggt tacgaggagc tggctgacga gcagatgaag aaaattcgca   11580
tccctgccaa cgtagctgga tcagctaccg gagtaagtgg acaagaaggt ggcgctccca   11640
ataaagacga ggaaaaacaa tgattgacta taaagcatta aaagcactat tccctaatgg   11700
tctccccgag gcacataacg tgtttgcaac cgttaaggca catctcactt accagattct   11760
gcgtaaggag tatgggtacg ctgctactaa cagtaaaacc tgggatcagt ttaaggaagc   11820
ctacgcggaa gcaactaagc cagtaccggt agcttctgtt agtatcacgg gcgctcctgc   11880
atccttagac tatactaaga ctgtacagct tgccgcaact gtcctaccaa caaacgcaga   11940
taataaaact gtaacgtgga agactagtga tgctacccta gctactgtga gctcaacagg   12000
attagtaaca gccctgtcta aggcaggcac tgttaaaatt actgccactg caggtggtaa   12060
atctagtgaa gtgtctattc aggtcaaggc tcctgttgta gcagttaccg gtgtcactat   12120
gtcacctaag actattacaa tcgaagcagg taagaccggc aaacttactg gtaccgtagc   12180
cccggctaac gcaaccaata agtctgtaac ttacacttct gctgatacca ccaaagctac   12240
cgtagctgcg gacggtacgg taactgttcc tgctaacctg gctgcggata gtaccgtagt   12300
tattactgtt aaaacagctg acggcaataa gaccgacact gcaatagtaa cagttaaggt   12360
```

FIG. 15H sequence.txt

| | | | | | |
|---|---|---|---|---|---|
| tcctacagcg | ggtgtgtaat | atctgttaac | tggggagctt | cggctcccca | tttttctatg | 12420 |
| ctagtgcata | actattttca | gtgtaaccaa | tttcgactac | ctactaattc | cacacaccgt | 12480 |
| gtgggatttt | caaatatctt | ttgacattcg | cgatttggta | tgtaataata | gtatctgaaa | 12540 |
| actgaggaac | aacacgaaag | tgtttggagc | aaacgatgca | gaatattaat | cttaatgctg | 12600 |
| agattaaatc | tgttaaagct | gtcggtgagg | gtgataatcc | tcctttaaaa | atcaaagggt | 12660 |
| atgctaacac | gattaccaaa | gaccgcgccg | gcgacgttat | tctctccgaa | gcgtggacta | 12720 |
| ccagtaacgc | cctcaagaat | tttatgaaga | acccgatcat | gcttttcggc | cataaccata | 12780 |
| gccgcccaat | tggtaagatc | ctagacctgg | taccaaccga | gtccggactt | atggttgagg | 12840 |
| gtgaggtaag | tgctgctgat | ctacagattt | actcattaat | acgtgatgag | gttcttaaaa | 12900 |
| cgttctcggt | aggcttctat | attaaagacg | ccgaatggga | cgatatgact | gaaacgttca | 12960 |
| ttattaaaga | tctggagtta | ctcgagatct | ctgtagtctc | ggttccctgc | aaccaagact | 13020 |
| caactttag | cctttcgaag | tctgtaaacc | ataatgatta | catggagctt | cgtaagtctt | 13080 |
| ttgtaaaatc | ttcgcaggtc | cagcctgttg | aacaacctga | actttctaat | ttagagaaat | 13140 |
| tcctagtagc | cgctggttac | gctaaaggat | aatggagaaa | taataatgtc | ttacgatatc | 13200 |
| gcacaactgt | ctaaagatct | gggcctgggt | gacattgctg | agcagcttaa | aggtctaacc | 13260 |
| gcctctcaga | aagctgaaga | agctcgcaaa | tttgctgctg | agcaggaagc | taaagaactc | 13320 |
| aagcgtatgg | aagacctggt | tgctaaagca | actggtgaag | accgtaaaaa | cctggcagaa | 13380 |
| gctctggagc | ttgtaaaaaa | cctggatgag | aaatccaaac | agtccgctga | agcgttcgtt | 13440 |
| aaagcaatga | actcccagca | ggaagaaatc | actggtctga | agaagaaat | caaatctctg | 13500 |
| ctggccgctc | gtgaaaatgg | tcgctctttc | gtagctgatg | gcgttgctaa | ggcaatgttt | 13560 |
| ggtaagcagg | aagatttcga | agacgaagtt | gagaaactgg | ttcttctgtc | ctacgtaatg | 13620 |
| cagaaagatg | tattcggtac | taagcgtggc | gaagcccacc | tgaaagctgt | taacggctct | 13680 |
| tcttctatcg | aagtttctac | cgaagcatac | gaaccatct | tctccctgcg | tatcctgcgt | 13740 |
| gacattcagg | ctaaactgat | tatcggtacc | atgttcgaag | aactgccgat | gtctagcaaa | 13800 |
| ttgctgacca | tgatggttga | gccggaagct | ggtgaagcta | gctgggttga | cgcctctact | 13860 |
| tacggtactc | ctgctactgt | tggtgcggaa | gacaaaacca | agctgtctga | aatcaccttc | 13920 |
| aagacctaca | aactggctgc | taaagcgtat | atgaccgacg | aaacagaaga | agatgctatc | 13980 |
| ttcactctgc | tgccgatcat | gcgtcgtcgt | ctgattgaag | ctcacgctat | cgcaatcgaa | 14040 |
| aaggcgttcc | tgaccggtac | tggtgctgcg | ggtactccga | aaggcctgat | ccagttcgct | 14100 |
| aaagacgatg | gtaaagtggt | tgctaccact | gctaaagctg | acggttctgt | taaagttacc | 14160 |
| gctaaagaaa | ttcacaagct | gcgtcgttcg | ctgggccgcc | acggtctaga | cctgaacaaa | 14220 |

FIG. 15I sequence.txt

```
ctggctctgg ttgtttcgat ggatgcttac tacgatctga tcgaagacga agaattccag    14280
gacgttgcac aggttaccgc taccaccgct atcaaactgc agggtcaggt tggtcgtatc    14340
tacggtctgc cggtactggt ttctgagttc ttcccagcta aggctgcaag cgctgagttc    14400
tgtgtagttg tttaccgtga caacttcatc gttcctcgtc agcgtgcaat cactgttgag    14460
aaagagcgtc aggctgaacg tcagcgcgat gcgtactacg ttactcagcg tctgaacctg    14520
atgcgtttct tcgagaacgg cgtagttgct ggtgcttacg ctgcttaatt tggctatact    14580
gccgactaaa ggagagcttc ggctctcctt ttttattggg taaaatatgc aattcatgac    14640
agattctgat tggagaacat atggaggcct taaacgtcct gacttagagt caaatatccc    14700
aatgttaatc aaagcagcca atgctctgat tactcagctt ctaggtattg acgacactgc    14760
taacgttgta gacgttctgc ctactaaacc agcacgcaaa aagtacttcc tgtcttctcc    14820
cgtgcctagc acgatcacta aaattacgat taacgatcag gagatcgata agtcgcaata    14880
taagaactac ccggatggta cgctcttgct gaaattctcc cctccagagg ggtatatgga    14940
agtagagttt actcagaccg gcttcacctc gatccctgac gacctggtac tagcagcctg    15000
cttcctagtt gatcactggg tcaagaagga ctaccgcgag tctcgtacat tcggcggaga    15060
aaccgttact ttcaatacca ctaaatctgg cgtaccggaa cacattcgta ctataatcga    15120
agtataccgg aggctgtagt ggcgttgggc gatctagctc gacagatagt taaagaacag    15180
ctggacatta tgagtggtgg tagccactct accaagaaca ccgtgatata tagtgcggaa    15240
actatggata accacaaaga tggcaccata ggcaaggtat ccttccgatt taccaagccg    15300
gtatcggagg atttactgaa tgttcggacg tcctctattt taaaagctgt ctcgtcgtca    15360
cttaatctgg aaggtgacgt tggtgttatc gataaccttc taaatagtat cactggtaaa    15420
aaatccaaaa taggaagaaa acggtctacc ggtagggtag aggttaactt tggagatcct    15480
tcagatgctg acaacggtta cgctggtgct atttctggcg cttctgggcg tttcgtctca    15540
aacacaaacc ttagagcgtt acttgaactc gtagcgaaag aatacttagt caaggatatg    15600
aaaaaagctg gggcacccct taaatttaga acggggcgtt tcgctaattc cttgaagatt    15660
aaagacgtgc tgttaagaga agacgcaggg gcaaagactc ctgacctcaa catcacgtat    15720
aactacatgc ttaagcctta ctctgtgttc aaccctgccg tctctaccta ccgcggactt    15780
tccttacggc cttttcctgg tgctaggaac ccgcagaagc tgatcggcga ggcaatcgct    15840
aaggctgcaa gagacccttat ccattctaga taccggataa gagtaaatca gggtacataa    15900
tgaattacag aacaagtatt gctgatgccc tagtggaacg actgaagaag gacatggatg    15960
ggagtaatcc cacagagttc ttcactaata tgtatgggaa cgtatcccgc cagacttatt    16020
cgtttgagca gatcaatgag ttcccttaca tagcagtcca tgtgggtacc gaaactggaa    16080
actacctgcc gtctgcacag cagtgggttt accttgaaat tcctattctt atctatgata    16140
```

FIG. 15J sequence.txt

```
aagaaaagga tgatattaac atgcaacttg agaaactcat agcggatgta aaaacctcta  16200
ttgacactgg aggaaattta caatatacta taatgaaacc tgatggttca actatcgatt  16260
ctgaagccac tgacatgcag atcacgtcgg tgtccacaga cgagggtata ctgtccccgt  16320
ttggttttgc tcaagttaac gtaacagtcc ggtatatgcc tctgagaaga gcgctggata  16380
gataagttac agctcaggag aaatttaaat gtctgtacaa ctattacgta atacacgaat  16440
cttcgtgtca accgttacta cggggttcac taaggccaac actcaggaga tcctagttca  16500
ggatgatgtc tcctggagcc aggacagtaa ctccactgat attaccctaa atgaggctgg  16560
ccctaagccg acccgcggtt cgcagcgctt taacgattca ttgaacgctg ctgagtggag  16620
cttctccact tatatcctac cgtatgacga tgcaggtaaa cagatcctgc cggactacct  16680
actgtggcac ggactggcaa ctggagctgc cgtgaatcta gcaggtacta ctggcgtatt  16740
ccagaatgct actaacctgg ttgtcaactt taaagacaac gggtaccacg aactggccat  16800
gttgaacatc tacatcctaa ccgatagctc ttggtctgtg atccgtaact gccaggttgg  16860
gcaggctgag gttaacgtag atattgatga tatcgggcgt gtaacctggt caggtaatgg  16920
tactcgcttg gagaccctag cttctcagcc gttcgaccct aaaaccatag ggatagacga  16980
cgctctttat gctaagattc agagttctta tatcaagaac aaactgacca ttcttaagct  17040
gaagaacaac gctaccggcg gaaaaaccta taacatcccg atcacgggag gttctttcac  17100
tatgaacaac aacgtgacgt acctgactcc taacatcatg tctcgtgttg acgttccgat  17160
cggttcattc actggttcct tcgagctgac tggttccttg acagcgtata tgaatgatgc  17220
tgccaacggc tctatccagc tgtacaaaga tctggtttcc gacctgaaag ctgtgaacga  17280
cttcgaagtt gcaatcatcc tgggtggaga gtatgatact gctcgtccgg cagctgttct  17340
ggtggctaag cacgctaacc tgaacatccc gtcaatcgaa actgatgacg tgctgggtgt  17400
gtctattgag ttcaaggcta ttccgactca gatggacgca ggggatgaag gttatctggg  17460
cttctcttcc aagtacacca agacttcgat cgcgaagctg atcagctctg gtgacggtaa  17520
ccctgtcaca ccataaggat aactaatgct atactcccta atgcgggagt ctagagtagt  17580
catcgagtac gatggcaggg cgtacggatt tgacgccctg tctgattaca ctgctggaac  17640
gtcctacgaa gagtttaaag caaatcgtag gacgattcac agacgcagta actacgccta  17700
ttcgaagata actgctcagt ctccttcttc aatttctcta actcttaact tctctagcaa  17760
tgctctcgaa ggtctatttt tcgagttgat ggggtttata gagatagacg gaatgtatca  17820
gatgcccttg ttcagtaata atattgagcc taaaatgttc tccgtatata ttattaacaa  17880
gaacacgagc ttacgtttcg ataactgttt tgctaccacc tgcgactttt ctctagataa  17940
gagtgtcccg gtgctaaacg ttggtatcga gtcgggatac tttgaggaag taggccaccc  18000
```

FIG. 15K sequence.txt

| | | | | | | |
|---|---|---|---|---|---|---|
| actcaacagc | tatacgcttg | atcaaggtga | ggtgctacca | ttttcattac | ctcaggtatc | 18060 |
| ttcgaatggg | agagtgctcc | caggacttat | gtcagccggt | atgtcattcc | agcagcaatg | 18120 |
| cgaatggcga | ggtgacagaa | gtttattcga | tatcaataag | atttataata | atagaagggc | 18180 |
| aatcgttaac | gaattgaact | catccgcttt | gatatcgatg | tactatgcaa | agagtcttca | 18240 |
| gatagactct | acgcataaca | ttaaacctga | tattggccta | ccggtacaaa | tcagaaataa | 18300 |
| atatattgtg | gtggatttcc | cttccactcg | aatcacaaaa | cgcctagact | taaccgacgt | 18360 |
| gtacaagatc | gattatgacg | taatacctac | tgagcaatca | gatcctgtcc | gaatcaagct | 18420 |
| aattggagaa | taacaaatga | gtattaacct | aaaagatatt | gcactggata | ccaaacagat | 18480 |
| caccattgca | taccctggcc | taccacactt | caaactgaaa | gttaactacg | tctcccgtaa | 18540 |
| gctctccaag | aaaattctgg | aagctgcaca | agagaaccag | tttgttaatg | gtatcgctgt | 18600 |
| taaagtgcaa | aacgatgaca | aattcgcaga | agagttcgtc | aaagtggcta | ttgcaggttg | 18660 |
| ggaaggtctg | accgtcgcag | atgttgagaa | actaatgctg | atcgaagttc | cagaagatcg | 18720 |
| tctggaagac | aaagtcgaat | ttagtatcga | caacgcgatg | atgttggtgc | gtaactccag | 18780 |
| tgccttcgag | acttggatga | acagcactgt | cttccaccta | gacacttttc | gtggctcaaa | 18840 |
| atcggaacct | actgcttaag | gaaatagatg | cctttgcaga | acgatgtgtc | aaaggagggg | 18900 |
| actccaaaat | tacacgggag | cagtatctga | cgatgtgcga | atccctcggg | gaggaaccta | 18960 |
| accccgaggt | acttaaacgt | ttcgtagaga | tccatgactt | ccctgaaatc | gcacagaccg | 19020 |
| ctctaacaat | atataacaac | ttatcggata | actatatccc | cggagattat | ccaacctatt | 19080 |
| taggcaagga | taagagtgct | ttactagttt | tcttcgatat | ctacggagtc | gaagacgctg | 19140 |
| atgagaagag | ccttatactc | caaatcatca | atatattcga | ctcacatgcc | gtggcagcct | 19200 |
| ctcgtaaacg | cgttgaagca | gctattaaga | agtctaaaat | gaagtcttct | agtaggtagt | 19260 |
| gagttacagt | ttcctccaac | gggcgttcca | cgtgaggctt | ggcctagggt | taatgcccta | 19320 |
| ggccttttta | ttggaaaaaa | tcatgacaga | tagactaata | cgagaattac | ttgtagatat | 19380 |
| caagcagcgt | ggtggatcca | aagccgctaa | acaaatcagg | gatgttgaag | ctgctttaga | 19440 |
| cggggctgct | cagagctcag | agggtctaaa | tacaagcttg | ggcaaacttc | ctgggtcttt | 19500 |
| cacggcgctg | gaacgatctg | tatcacgtac | tgctaagtcg | ctggagaaat | tatcctcgac | 19560 |
| caccagcatt | acagcattag | cagcgtctat | cggcatgcta | agcggcaagt | ttacctcgtt | 19620 |
| cgaggttgac | ttggctaaat | ccgtactaaa | aatcaacgca | aacctaaacg | gggtgacttc | 19680 |
| cgccgctaac | aaaatggcct | ctggttttga | cactgcagcc | acttcttcgg | ttgcggactt | 19740 |
| aaaccgcgtc | aataaggctc | ttcaggagtt | agatgcgcac | gcctcttcag | tagctaaagt | 19800 |
| gttgcagacc | ttgaaggcgg | gggccgggtt | agaatctatt | agctctagtg | ctgctaaggc | 19860 |
| tagtacggat | cttagccacc | tagtatctgg | ggtggaaaag | ataggtaacc | aattagctag | 19920 |

FIG. 15L

```
sequence.txt aatggcggag caagccgtgc tggcaggcag gtctcttcag gggctgaaag ccgactcctt    19980
aggggctgcc ggagagcatc tgagtaaggc tgcgtccggg atttccgtag ctgtatcttc    20040
tatgggcgaa gaggtgaaca agctaaacaa actacttctt gagttggcag taaaggctga    20100
tttagcgagt aaatctatag caaatattgc accagggacc aaactgaata gtctgggaac    20160
tgaaatccag aagattaata ctagtttagc cactgcagcc aatacctcgg tagctgagat    20220
atctaagatt aaagcagccc ttacgtcttt agtatcctct accgctacag ctgccgcttc    20280
aatgaaaacc gtaggaaccg gtagtggtct gagcaagcta atctcagaga tatcagcagc    20340
cacctcagct tccacttcgg atatctctaa agtaacagcc gctttaaaac agcttaacgt    20400
agatgctacg gcagcaggaa aagcactgca aagtattaaa gcaggcgcaa atctttcttc    20460
tgtacctaca gttgttggaa agataggtac ttcaatgacg cagttgcgtg ctcagttaga    20520
aggatctgta accggtatcg agaaaagcct aaatgatcta tctagagctt ttgccactat    20580
gggaggtacg ggaaacctga atccactggg taactccatc agaggtatga tcccgtcact    20640
cacccagctg gctaaggccg ctgtgcaagt taactccgct ctgtcaaaaa tacaggcagg    20700
caggggcgta cttcaattac ctacccaatt caaagcagta acggcctcat taaatgccct    20760
ggagactaaa ctggcctcta cgtctcaaat actagagcgc ggattctcca agggatttca    20820
ggatatggcg tctaaatcaa cctcgtcatc tacgagaatg attaacaact tccagaaagt    20880
ggtaccggag ctcaacgcta ttgaagctgc tgctatacgt tctgctgctg caatagacaa    20940
gctaatagcc aaacgtatac gcctcggaca agctggggga gggggtaacc ctgcagcgtt    21000
caatatgggt gccttagtag cggaaatgaa caggattgta acctccattg aagctatggg    21060
caacaaaatg aataccacca tggctgatat ggcacggagt acggacaagg tatctgacaa    21120
attaacagat ctaaactcgg gagttcggga tgttaatact ggtttaggtg ggttgaattc    21180
aacgttaacg ggtacgggta gcgctgctaa tagggcgtcc agagcgttgg gaaatacttc    21240
aggatctgct cgcggagcta ctaggaactt cgcagcacta gctatggtga ctggccctat    21300
gcctcttatc tacggtgcta tagcctctaa cgtatacgtg cttaaagcag cgttcgatca    21360
gctaaaactt ggagaccagc tgaaccgctt agaacagttt ggatctatcg taggagcgaa    21420
gacaggtaca cctattcagt cccttgctgt ggcactgcag gaagctaccg gccacgcggt    21480
atcctttgaa gaggcaatgc gtcaggcatc tactgcggcc gcgtatggtt tcgacgctaa    21540
acagattagc gagtttgctc tagttgcacg tagggcagcg gctactcttg gcgttgatat    21600
gaccgatgca ctcaaccgtg taatcaaggg tgtgtccaag caggaaattg agcttctaga    21660
cgaattaggt gtaaccatcc gtttaaatga tgcgtatgcc gaatacgtta aaatacttaa    21720
tgcggctaac actggtataa cgtataacat tcagggtcta acttccttcc agaagcagca    21780
```

FIG. 15M sequence.txt

| | | | | | |
|---|---|---|---|---|---|
| ggcatatgct | aatgcggtag | tagcagagtc | taccaaacgc | ttcggctacc | ttgatgaggt | 21840 |
| actacgagca | accccatggg | agcaatttgc | ggctaatgcg | gattctgcat | tacgcaaggt | 21900 |
| tcaacaagca | gctgctaaat | atctaggtcc | agttattgca | tctataaacg | cagcattcta | 21960 |
| tacgtctaag | gcttcggtat | ctgcagaggc | agctactgcc | cagcaagagt | cgattaagca | 22020 |
| aatggacggt | aaagactcta | acgcagtggt | catgaacctt | gaggcttctc | agaaaggctt | 22080 |
| ggatgatgca | gtcaaagcaa | aagaggaagt | aaaaaataaa | ctcgcagctc | ttaataagga | 22140 |
| gataatggat | agagaggcga | agatggatat | gtccactgca | ctggccacag | ccgccaacta | 22200 |
| tagtgggttc | ggtaatctgc | ttaccctggg | agcctctaaa | gctaacaaag | aatttacaca | 22260 |
| acagactgca | gatatgcgta | gacaggcgta | tatgttacag | caggagttag | cagattctgc | 22320 |
| gggagctatc | caaaaatgga | aagacgccag | ggactccgct | ctatctaagg | ctcagaaaga | 22380 |
| gaacccagaa | ctggcgggga | aacttaatat | agggcagaac | gttgaagcaa | gtaatggact | 22440 |
| atacaccttt | gacaacgcag | cattagacgg | ggcagttgct | ctacggaagg | agttcaataa | 22500 |
| tataaagaaa | acttccggag | atctgagcaa | cgatatccag | aactttgcac | aggactctaa | 22560 |
| cactgcgtct | cgagctactg | cagcactggg | tgatgcactt | aaggcggttg | agtcattggc | 22620 |
| gggtggatct | acggaaaaag | ccaatcaaat | gaccaaggac | cttaatttgg | gctattccac | 22680 |
| cgtaaccgag | atgaacactg | cgtataaagc | catgtctaac | tatcagaaga | tagtgaatga | 22740 |
| tgaggctaag | tctaagctag | atgttgagaa | acgtatagcg | gaggtctacg | ctgccactcg | 22800 |
| taataaggat | aaggcggaag | aagctggtag | agccctagaa | atgcagcaac | ttagcgcgaa | 22860 |
| gaaagaggca | ttgaaagctg | tgctggcgac | gaacaaggac | aacaaggcta | ttcaaaaaga | 22920 |
| gttgaccctg | ttagagacgg | aagagctcaa | agtgaagaac | cagggcatgg | aagcgactaa | 22980 |
| gaaggagaaa | ttctataagg | ataagatagt | aggcatagat | cgagaaatag | cactcctaaa | 23040 |
| taatcgcact | atgacagatt | ctcagtataa | cgtggcgaac | cttaaattaa | atctacaagt | 23100 |
| agagaaagat | aggttagcct | tactgaagac | tcaggcagat | aaggagaagg | aagccgaaca | 23160 |
| gtctagacgt | aacattgcct | ctattgaaag | ggaaatctgg | aaagagcagc | ttgaccgtaa | 23220 |
| tgccaaaact | gctgagatgc | gtaaagaaga | attcgagcgc | aatcaaagca | tgaagcctct | 23280 |
| aatgggagag | tcacagaaaa | tgcaggagca | gctagcgttc | taccaagaaa | tgaaggaatt | 23340 |
| cacgaaaggt | aacgctgatg | aacaggcgcg | ttggagcaag | gaaattgcta | acactactgc | 23400 |
| gcaaatggcg | gctctcaaag | ctcagcgtac | tgcacagatg | atggatcgcg | taggacagtc | 23460 |
| cttgggcgca | gactatacgc | ctactactgg | cctggagggg | gaggataaga | aattcgccga | 23520 |
| catggaaaac | cagatggcgt | catacgatac | cgctatcggt | aagctctctc | agctaaattc | 23580 |
| ggaggctact | gctactgctc | aaagtatggg | gaacttagct | aacgctatga | tccagttctc | 23640 |
| tcaaggatct | ctggatacta | cgtccatgat | tgcagcgggc | atgcagacag | ttagccagat | 23700 |

FIG. 15N sequence.txt

| | | | | | |
|---|---|---|---|---|---|
| gatcagctac | ggtactaacc | agcagatttc | agcaattgat | gcagctatag | cggcagagca | 23760 |
| gaagcgtgac | ggtaaatctg | agcagtctaa | gaacaagatc | aaaaagatgg | aagcggagaa | 23820 |
| gattaaactt | cagcaggaat | ctgctaagaa | gcaaatcatt | atccagacag | cagtagcggt | 23880 |
| aatgcaggca | gcaacagctg | ttccgtatcc | gttctctatt | cctctgatga | tcgcggctgg | 23940 |
| gcttgcaggt | gctctgtctc | tagcacaggc | gtctagtgct | accggaatga | ccgatatagc | 24000 |
| aggatctggt | ggtgaaaccg | cctcttacct | aaccttaggt | gagcgccaga | aaaacgtaga | 24060 |
| cgttagcatg | ggcgcaaacg | caggtgaact | atcttacgtt | cgcggcgata | aaggcatagg | 24120 |
| tagtgctaac | ggatttatcc | ctcgtgcaga | aggtggtaat | acctacccag | gtgtctccta | 24180 |
| taagatgggt | gaacacggaa | cggaagttgc | aactcctatg | gtgcctacca | aggtaactcc | 24240 |
| agcggataaa | gtggcttctg | aaacttcttc | tggcggtgct | agaagaccgg | ttaatctgaa | 24300 |
| catccaggca | atggacgcta | agagctttat | ggagtacgca | ttggaaaacc | ctgcggcatt | 24360 |
| ccaggcagct | gtagagttag | ccttgaatga | acaagggctg | agcttaaaga | acctgaatta | 24420 |
| actaaactaa | agggaggacg | taattgtcct | cccttctttt | tggaatttat | aaaattatct | 24480 |
| tgaaaatttt | tcttgatatg | actataatat | taacattgag | aggagaaaac | aaaacatgag | 24540 |
| attaccagat | ccctttacac | atcctcagta | taacggcctt | gggtttgata | aagctacgct | 24600 |
| gatcgataat | gatccagtga | tcagagacga | gctaccaaac | ggcaaggtta | acgaagttaa | 24660 |
| aacagccact | cagtactggg | gtcttaacat | tagttatcct | gtgatgtttc | ccgacgagta | 24720 |
| tgctgtactt | tcgtcagcaa | ttctagagta | taagcgtacc | agaggctatc | tcgacgttat | 24780 |
| actcccacat | tacgagtctt | accgagtaag | aggggatgcg | aacaactgtc | gcattgccgc | 24840 |
| tggacaaaaa | ggctccacac | tggttatcac | caatacgaat | tccttatctg | gagaacctaa | 24900 |
| gccaggtgat | ttattccagt | taaccacaca | tccaaaggtg | tataagatta | catctttaa | 24960 |
| aaacgtagca | ggagtatgga | cacttaatct | atacctgat | ctgttgctca | ctaccaacgg | 25020 |
| ctccgagaga | ccacgtttca | atgggattct | tttccaaact | aaattaatga | acggagattc | 25080 |
| attcagcgaa | gagatcacag | ttgatggtgt | atacgacggg | gttaacctag | ttctgagaga | 25140 |
| aagtctatga | gacagatcct | tccttctgcg | aaagcctacc | ttgccaacaa | tgacaagata | 25200 |
| cgattagcgt | atcttgtctc | tatcgaactc | ccggggtcca | cgggtaataa | cgctgtttat | 25260 |
| gcttatatga | cggactatat | gagagatatc | aactatggtg | gtatactctt | ccaatcaggg | 25320 |
| aaaattaaaa | caattagcag | ccacaaacaa | aaccgtacgt | taaccgtcgg | cagtttgagc | 25380 |
| tttagtgtta | ctggtacgga | tgccaacgaa | gtcattaagc | tcgtgcaaag | tggtgtatca | 25440 |
| tttttagatc | gctctatttc | tatatatcag | gcgatcatcg | acgacaatgg | ggaaatcctt | 25500 |
| ccagtggacc | cagatactaa | tggccccta | ctcttcttta | ggggtaagat | tgtaggtggt | 25560 |

FIG. 150 sequence.txt

```
ggtatcaaag aaagtaatac agtatccgga gttggtactt ctgttataac ctggaactgt    25620
tctaatgaat tctatgattt tgagcgggtt gctggacgct tcacagatga cgcttcccac    25680
cgaggacttg agattgtaaa tggagaatta ctgccttctc acggtgccaa acgaccggaa    25740
taccaagaag actatggatt cttccacgcc aacaagagcg ttaacttcct agctaaatat    25800
caagtaaaag aagaacgata caagctagaa tctaagaaga aattattcgg tctctccaag    25860
agctacagcc ttaaaaagta ttatgagact gttactaaag aagtagacct ggacttcaac    25920
cttgcagcca aatttattcc tgtagtatac ggtactcaaa aagttcctgg tatcccggtt    25980
ttcgcggata cagagagaaa caatccaaac gttgtgtacg tggtttacgc gttctgtgag    26040
ggtgagattg aaggattcct agacttccag tttggggacg cccccatgat ctgtactgat    26100
caaactgaca gtacatctcg tacatgcttt ggacaaaaaa gggtgtcggg agatactatg    26160
gcaagaattt ccacagggct cccatcaaca tctctctcca cgcatggtca agaatacaag    26220
tataatgacg gtaacggaga tatacgaatc tggacattcc atggcaagcc agaccaaacg    26280
gtagctacgg tactaagaga cattgctgct gctaacaatt tcttccttca aggagagaac    26340
ggtaatggtc cggagtactg ggattctagg tacaagttat tagacaccgc atacgctgtc    26400
atacgtttca ctatcacgga gaacagaact gatattcctg aagtatccgc agaattaagc    26460
ggacgcaaag tgaaagtata ccaggcagat ggttctgtta aatggataa aacgagtcag    26520
aatggtgtgt ggcaaacatt tgactaccta acctccacca cctttggtgc aagtatcccg    26580
atagacagaa tggtgattgg tgactggaga aaagaggccg atctattaaa cattatagac    26640
acctcttatc aaactagttg gcaacctttc tggagatacg ttggatggga gagctggaca    26700
gccgaaaaca gacaaataat gcaaatgaac acaatcctgg ataactccaa ctctgtgttc    26760
aaaaacgtgc aggagctatt agaatccttc caggggcgt tgaataacct atcaggtatc    26820
ttccgcatca ccgtagagaa agattcaaaa actccgctag aacttaattt cctagatact    26880
tatggggacc tggatctatc agatactaca ggccgtaata agtacaactc agttcaggca    26940
tctctgattg atcctaccct gaactggaaa accaactcta taacgttcta taattctaag    27000
tttaagaatg aagatcgtgg agttgacaag aaacttcaac tttctttgc taacataacc    27060
aactactaca ctgctagaag cttggcagat agagagctta agaagtctcg ttactctcgc    27120
tctctgagtt tctctttacc ttacaaattc cttggtatag aacctaacga tcctgtagta    27180
ttcacctacg atcgttatgg ctggaataag aagttcttcc tagtagatga ggtggagaac    27240
acaagggatg gtaagataaa cgtaactctt caggagtatg gtgaggatgt atttattaac    27300
tcaacgcagg tggataacag tagcgaggcc gttcctgaaa tatccaataa cgtcctgcca    27360
ccaagagact taagtacac ccctacacca ggtggaatgg taggtgatgt tggcaaaaac    27420
ggagagcttt catggcttcc tagcttgaca cctaacgtag tctattactc gatacgtaaa    27480
```

FIG. 15P sequence.txt

```
tccgaccgcg tggatcctta tattgtgcag cagactgctt tcacacctaa cgttagaatg    27540
ttccaagata tcgtgggtga gcctgctggc ctgactattt tcgagatccg cgccgttgat    27600
attaatggtc gtcgtagctc tccagtaaca atttctgtag atttgaactc agctaaaaac    27660
cttagtatgg tggaaaactt ccgagtgctt aaccttgccc ctgaccctgc tgaatgggta    27720
ggacctgact tagagttagg gtgggacaag ctgcaagaag aggggctgat ttcagggatt    27780
ttctacacgc ttgaaataag gacaacact aataaactgc ttagatccgc aaagatcacc    27840
agtttatata actacagcta cctgttgggc tataataagc tcgactacaa ggccaacaac    27900
tcgaatactt tggggattta cagagcactt cagccaagaa ttcaggcgga gggaccaaag    27960
ggcgagaagt cggttgcatg gcatatatc taaatgattt caaacatagc accagctaaa    28020
atggtactgc agaatatcgt gaccggctat acgattgcga gtattcagca ctcaatcttt    28080
tccgattacg acgtaattgg tagaactttc tggctaacta cgggtggggt aactacccgt    28140
agggactta ccggcgttga tacattcatt gccacaatta acaatctaat cgctggcgct    28200
acctactctg cccagggtgc tttctatgac tcgatggttg atgcagagct gatggctgct    28260
aaagtaggta tgaacctctc tagcaccatt aacttcaaga tgaaaactgc tccgaagatt    28320
accaaagtgt cctcttttgc agaatctgtt gacgtgggtg tgggtgctcc tatggttgtc    28380
gtagagcttt ctggggaggc cgaatacgtt accatcgaaa tgaaacctga gggctctagc    28440
acctggacta aatactaccg tggtccaatc actgagcaga tcatctttgg gggtgttcca    28500
gttggcagat acaatatccg ggtatctggt gttgtcacta tgccagatgg tgttactgtg    28560
gatgtttctg ggtatgatac ctggccgtca ctgtttaacc tgacctacaa cttcactcca    28620
ccgtctgccc caactaacct gcgtttcaaa actgcccaca tccaagatgg tatggagcgt    28680
tttgacgttc gcctggaatg ggattggact cgtggtacgg gtgctaacgt tcgtgaattt    28740
atcatccagt atattagtaa cgatgagttt gcaaaaactg gatggactaa ggccaacaag    28800
ctaaacgtgg gtgcagctaa agctggtact atcactagct tcccttacaa aatccgccac    28860
cgcttccgtg tactatcggt tgcttggggc ccagatactc agtctataac taactctaac    28920
gaggttactt atattataga cgagagcacc actttcgaca atgcattcat taacgagacc    28980
ggtgtagaaa tgacctacgc aggtatcaag ggtaaactct ggaactctaa caccaaacag    29040
tgggagcaga ctttcttagt cgatgctgct acaggtgcag tagttcttgg tacactcgat    29100
gaaaatggta agcgccgat ttcattcgac cctgttaata agattgtaaa cgtcgatggt    29160
aaagttatca ctaaagacat taatgctgct aacgtaattc ttactaacct gaccggtaaa    29220
gataacccgg caatcttcac tcagggtaag aagtacggta ataacgcagg tggtgtctgg    29280
atgggtgttg acaacgttga cggtaaggcc aaatttgacc tcggtaataa cactcagtat    29340
```

FIG. 15Q sequence.txt

| | | | | | |
|---|---|---|---|---|---|
| gtgcgctggg | acggtgatac | tcttcgcatt | tctggtaacg | ttgtaatcgg | tactcctgga | 29400 |
| ggcgatgtag | accttgaaac | cggtatgcag | ggtaagcaga | ctgtatttgc | ttataaactt | 29460 |
| ggtacatctc | tgccaagtcg | cccgcttgac | caagtttatc | caccagctgg | atggtccgca | 29520 |
| ttcccgccta | accgcactgc | tcagaatcag | aacgtgtacg | ttgtgcaggg | tactctggat | 29580 |
| cctaagaaga | gtcctcctgc | tctagtagac | ggtaccaact | actcagctgc | atcccagtgg | 29640 |
| tctggtgtcc | caggtactgg | tggtactgat | ggttctaacg | gtgattacac | tgttcagatt | 29700 |
| taccagatca | gtgctagtaa | gcccacgaaa | ccaggcaata | tcaatgaccc | tagcggttgg | 29760 |
| agtcgtaccc | caccgactgg | aacccctctt | tggatgtgtt | ctggtagatt | caatggcgat | 29820 |
| actaacgctc | taactgttga | ggggttggtca | gacccgatcc | gagtagacgg | cgagaaaggg | 29880 |
| gctactggtg | ctactggtgc | tactggtcct | caaggtcctc | aaggtccggc | aggtggttca | 29940 |
| gtagaagtac | agtggtctaa | agatggtact | actaactggc | atgcaaactt | tactactggt | 30000 |
| gatatctaca | tgcgtcagcg | tgttggtaca | ggtgggtgga | gttcagctat | ccgtgcagtt | 30060 |
| ggggaagatg | gtactaatgg | tactcctggg | tctaagggta | actacattgg | gatgcgcttc | 30120 |
| cgagtggcgg | ctgagaaacc | tgccactccg | actggccaga | ccccttcagg | ttggtcagat | 30180 |
| gcacctcctc | agggaaaccc | tctatggatg | gttaaagctg | agttcaacgg | tcaaaccaac | 30240 |
| gccctagtag | gtacgtggtc | agaaccagtt | cgtattgatg | gcgaaggtat | tggagtaaac | 30300 |
| ctgtatccgg | ttaagaaaac | actggatcag | tggaccggaa | tgagcaacgg | tactatggtt | 30360 |
| aagaacccag | ataccctcag | ctttaccata | accaacacag | agagcactac | ctcctctacc | 30420 |
| ggaccgggtg | cacatcctgt | tccgttccag | ggttcacaag | gtcctatagt | tgagattcca | 30480 |
| gtaaagccga | atacagcgta | catcttcact | tatgaggtta | gtactgatag | caccagcttt | 30540 |
| gttctgagag | acctgttact | agagttctct | agcattaccg | gaagttttac | caacttccaa | 30600 |
| gagttactga | ctggagccaa | aggtaagcag | gaagctaaga | ttgtcactcg | tgctgatact | 30660 |
| aagttcctga | gcttccgtcc | aggtgtccgc | actgccggag | ctacggttac | ttattctaat | 30720 |
| ctaaaacttg | aagaaggcat | taaagctacc | gcttacagcg | tagaggcttc | cgacagtatc | 30780 |
| ggtgagaaag | gagaccaagg | tactcagggt | ccacaagggc | ctcagggtaa | tcagggtcca | 30840 |
| cagggtaatc | aaggcccgca | aggtgctaag | ggtgataatg | caaaaggatt | cagcctctct | 30900 |
| tctctcggtc | agacgtttac | gtacgacgca | gaaggtaaac | tgaagtccga | tgcaaccatc | 30960 |
| ctgttccagg | ctttccgtca | gaatactact | gcaaacgtta | cttggtcagc | caaggacgag | 31020 |
| aaaggtggga | acatcactct | gacaagtact | agcaatactg | gtgctacact | gaccgccgct | 31080 |
| aacttcaaaa | catcgaagtc | tgtagtagtt | acagccgtct | gtgatggtat | caccgatcag | 31140 |
| atcactattg | tgcgtctaga | cgatggttcc | aacgctctcg | tagggcttct | gaccaacgaa | 31200 |
| ggttccacag | ttctagcgaa | ctatgctggt | tacgtgcaaa | actatagtac | tggttctggt | 31260 |

FIG. 15R sequence.txt

| | | | | | |
|---|---|---|---|---|---|
| gacttcaaag | tattctatgg | ggcgaaggat | atcacctcag | aatgcacctt | cagtactatg | 31320 |
| gagaagaata | accttgatgc | tgatattact | tcagcgggca | aatatacttt | aaaaggtatg | 31380 |
| ccggctggta | ctgatgttat | caacggctgg | gtcgacttac | gtgctgtaca | ccctacttac | 31440 |
| ggtgccgtgg | tccgcagagt | ggcaactact | aaatctatcc | ttgcaaaagg | ttatgatcgc | 31500 |
| gttattacca | cttcattcga | gaacggaaat | aagggtacct | ggtcgactgg | tagtgtccaa | 31560 |
| ggggtttctg | gtgccacaat | tgtagccgca | ggtttcagca | aggccctagt | gatctctgct | 31620 |
| agagactgta | tagaagatgc | taacgcattc | cctgtagtag | ctggtcagaa | atatagactg | 31680 |
| ggcatgtgga | taatggctag | tgagtctaaa | gtcaatatca | acatgggaat | gcgaattgta | 31740 |
| agggcggccg | acggagttgt | tgattggcaa | ggaacccta | tgattgcaca | aggtactgta | 31800 |
| gtacctggtg | gctggtccta | catcgaaaaa | gagtttactg | ttggcagttc | taataccggt | 31860 |
| atagcaatgc | cgtggatcca | gatggctggg | tcttctggta | gtgacttagg | taaagcttac | 31920 |
| gttaccgata | ttcacatttt | cgccctagaa | atggatgggg | agaaaggtga | tactggtgca | 31980 |
| actggtgcta | caggttctca | aggtccacaa | ggtccacagg | gtaataaagg | ggacaaaggt | 32040 |
| gatactggtg | caactggtgc | tcaaggccct | gctggtagct | ctgtaaacgt | ccagtggtct | 32100 |
| aaggatgggt | ctactaactg | gcatgctggt | ttccaacctg | gcgatatttt | catgcgtcag | 32160 |
| caggttaatg | gagtttgggg | cagtgctatt | cgtgcagttg | gcgaagacgg | taaaaatggt | 32220 |
| gctgatggta | ctgacggtga | ctacatttca | atgaagttta | tcgttcagga | taccaaacct | 32280 |
| ggcacaccta | ctggtaacaa | cccaggtagc | tggagtgatg | ctcctccagt | tggtagccct | 32340 |
| ttatggatga | ctaagggcac | tatgaatgct | agcggtcaac | tacagggtac | gtggtctaat | 32400 |
| ccggtccgcc | tagacgggac | tatcaaccct | aacctgttcg | cagtacgtaa | gtggatggca | 32460 |
| gggatgactg | gtacggaagc | cggcacatct | aagaacgata | tcgagaagct | agcgcatacc | 32520 |
| ttgactcgta | cttccggaac | tgataatacg | gctccagggt | gctatgcgac | cccgtatcta | 32580 |
| ggtagtgggg | cgttttccca | tccagtgact | ccaggtaaac | gctacactct | aacctataat | 32640 |
| atcgacgcgg | ctagcgaggt | ccagacccga | gatactatat | tctggcaggc | taatccagac | 32700 |
| tcaggacaat | ccacctacat | agaggaactg | aataccggga | cgtctataaa | ggttaagcgt | 32760 |
| acctttgtag | ttcctacagg | tatgaactac | ctaaccctac | gcccttctgc | tctgacactt | 32820 |
| aacgtagcga | ctacgtggag | caagattaag | ctggaagaag | gcggagagaa | aactgagtat | 32880 |
| caagtagaat | actcagacag | tatcggtata | gtaggtaaat | cagttttagt | acagtggtct | 32940 |
| aaggatagct | cttctagtaa | ctggcatgat | accttccaaa | caggtgactt | gttcatgcgt | 33000 |
| cagaacgttg | acggtgtttg | gggtcctgcg | attcgtgcta | taggtgagaa | aggtgagatt | 33060 |
| ggtcctgacg | gtaagaaagg | taactacacc | aatatcatct | tccgtatttc | ggatactaaa | 33120 |

FIG. 15S sequence.txt

| | | | | | |
|---|---|---|---|---|---|
| ccagctaaac | ctactggtaa | caaacctacg | gattggtttg | atgctccacc | tgatggttcc | 33180
| cctctttgga | tggcaacagc | aacgtttaat | ggggatacta | acgctatcat | tggtgcttgg | 33240
| tctgaccctg | tgcgaatcga | tgcttccggc | gtaggcgaaa | acttcttagc | gttcaaagag | 33300
| tggatgatgt | ctattcagag | ggctgagggg | acgggctctt | cagttagcaa | gaatccggac | 33360
| cagatgagat | tccgggtaac | agctgggcca | tccagaaatg | acgcgtacac | taccccttac | 33420
| caaggaaccg | gcacacattt | tatagaagtg | tcgcctaata | ctgtgtatac | tttatcattt | 33480
| gaaatggaaa | ctgctgtgtc | cactagaatg | atgctgttgc | agtttgataa | tggtaatggg | 33540
| ggcacgcacg | cacgtaacaa | tcaggttata | tcaaccagta | ctggtataaa | cagtctgact | 33600
| attactacgg | gtgctaacac | tacccacctg | tctatgcgta | tgtcaatctc | taacatggga | 33660
| gagactaacg | tactgatgaa | acctaagctg | gaactcgggg | cgtttcctac | ggcatacgtg | 33720
| gcgcatccta | gtgatctact | tggtaaagat | ggtgctactg | gagctactgg | tcctcaaggt | 33780
| ccgcagggta | acactggtgc | tactggtgct | acaggcccac | aaggtagtaa | aggtgacaca | 33840
| ggggctactg | gtcctcaagg | tcctcaaggt | ccgaaaggta | acgcaggtga | aaacgctaaa | 33900
| ggattcgccc | taacgtcaga | ttatcagtca | ttcgtgtatg | atactgtagg | ggacattaaa | 33960
| tccgctacta | ctattctgtt | caagggacta | aaacagaata | ctactgcagg | gatcacgtgg | 34020
| agtgctgtaa | ataatacggg | agctgcagta | acactgatga | attctggaga | taaccgtcag | 34080
| ctaaccgctg | cgaacttcgg | cgcctctaag | tgggttacga | taacagcaac | ctgtgatggt | 34140
| ttatcagatc | aaattactgt | ggttcgtttg | caggacggtg | agaacgtgtt | gaccgctgtt | 34200
| atgacaaatg | aggcagctac | ggtacttgct | aactactccg | gatattgcca | gagttacgaa | 34260
| aacgccaaag | gtcagatgag | agtttggtac | ggaagcaccg | atgttactgg | tcagtgcact | 34320
| ttctctgagg | gcggaagaag | taacgtaact | cctagcatca | actcagcaaa | tgggaactac | 34380
| tccgttactg | gtatgttgga | tgggaccgat | attaccgaag | gttgggtgga | cgttaaggct | 34440
| actcatccaa | aatatggagc | aattaccaag | cgttttgcgg | taactaaggt | attcctagcc | 34500
| aagagctatg | agatggttat | caccaatacc | ttcgagaatg | gtaacaaagg | ttcatgggca | 34560
| ggagctctgc | agagtgtttc | cggcccaaca | aaccagagca | tctctaaggc | gctgcgtatc | 34620
| acagctagag | ataacctaga | gggtaggaac | accatcccag | tagcagggg | gcaaaaagtc | 34680
| cgtatcagat | tctggtacaa | cccactagga | ttagaggaag | ccatttttag | agtaggcttt | 34740
| attgttcacc | gcaaagatgg | gggcaaaggt | taccccctcca | gaactgtggt | tacgggcccc | 34800
| gctcctaata | gctcctgggc | gtacttcgat | caagagttga | ctctaagtgc | taacgatgag | 34860
| ggtattgcct | ggccgtggtt | ccagttagat | aacaaaactt | ctggttcttc | attagggtat | 34920
| atgcttgttg | ctgacataca | cttcgaagat | ctatccatgg | atggtgcaga | cggagctact | 34980
| ggtcctcaag | gtccgcaggg | taacactggt | gctacaggtc | ctcaaggtaa | caaggggat | 35040

FIG. 15T sequence.txt

| | | | | | |
|---|---|---|---|---|---|
| actggtccac | agggtccaca | aggtcctgca | ggagcttcag | ttggtgttca | gtggtctaaa | 35100
| accggcaacg | cgagcgattg | gcacacaaac | tatgctactg | gcgacattta | tatgcgtcag | 35160
| caagttaacg | gtgtgtggtc | ttcggcaatc | cgcgcagttg | gcgaggatgg | gcgggttggt | 35220
| gctgatggta | aatataccct | cctgagattc | caagtagctg | caactaaacc | tgctagacct | 35280
| acagggaact | ctccggctaa | ctggtctgat | tcacctccag | aaggttcccc | actctggatg | 35340
| gttaaaggtg | agtttgactc | cagcaaccaa | cttcagggaa | cctggtcaga | tccagttcgt | 35400
| ctggacggtg | agacggtcaa | cctcaacctg | tttgctaaca | aagcatggat | tgcgtctata | 35460
| acgggtgcca | gtggtagtgg | atctgttgta | gccaaaaacc | ctgacgaact | acgcttacgc | 35520
| attaccgcag | gttctggtgc | aactgacgcg | tataccatgc | ctagtggtgg | tgatggtacg | 35580
| ttcttcacta | aagttaccgc | aggtaagcgc | tacactatgt | cgttcgacac | ggatagtgct | 35640
| ctggaaatga | gaatgcatgt | gttctttatc | caggcaggag | caaatactac | tacctcatca | 35700
| ttctcttgga | tagcgtcaac | aactgctggc | agaactagct | ggtcgttcac | tgttcctgca | 35760
| ggatgtgata | gggtatctgt | ccgtgtgtca | ctgaacaaca | acccaggtgg | aaccaacgtt | 35820
| gtttccaata | tcaagctgga | agagggagat | ttcgccacag | cgttcattag | gaacgagctg | 35880
| gatactattg | gtgctgatgg | ttcacaaggc | ccacaaggtc | cacagggtag | taaaggtgat | 35940
| aaaggggaca | caggagctac | tggtccacaa | ggtccgcagg | gtccaaatgg | tactagcgcc | 36000
| aaagcctttg | ccttaacatc | cgatagcctg | tcctttagct | tcgatactag | tggtaacctg | 36060
| aaatctaatg | gtactatcaa | gatcgatagc | tggagacaga | ataccactgc | tgcaataacc | 36120
| tggactgcca | agaaccaagc | agggagtaat | ataactttag | gtggcactgc | tactaacaag | 36180
| actataacct | ctgctcagtt | cggaagctca | gagtacgtaa | cagtaaccgc | gacgtgtgat | 36240
| ggaataaccg | attccattac | aatagttagg | ctgcaagacg | gggtgaactc | tctagtcggg | 36300
| tacttaacta | acgaagcggc | taacctgtcg | tgtaactcct | acggttttgt | gcagaattgg | 36360
| gatggcacta | cgggtaactt | taaggtgttc | tacggaacgg | tagatgttac | cagtcagtgt | 36420
| accttcggag | tggaggataa | gagcaatctt | aacggcaaca | tagggtcaag | cggttattat | 36480
| gcccctagcg | ctatgccaaa | cgggctggaa | attacctctg | ggtgggtaga | ttataaggct | 36540
| acgcatccta | agtacggaac | acttattaag | aggtttacac | tcaaaaagag | cctgcccggg | 36600
| attggttacg | acagagtgtt | cacggggtcc | tttgactctg | gtaacaatgg | atcgtgggga | 36660
| cgtacggtag | ttgacatcgc | tacgggcagt | cccggaggac | acaccaaggc | tatacagtgc | 36720
| acctctaggg | acaccatgga | aagtagtaac | tggttcccta | ctcgtaaggg | gatgcgctac | 36780
| cgtgtaactg | catgggtgaa | caactctgag | ggtgagtatc | agctaaggtt | aggcctccat | 36840
| acccagaact | cttctggcag | cgttaacact | ggttacccaa | ctatgctagc | cgcatcagct | 36900

FIG. 15U sequence.txt

| | | | | | |
|---|---|---|---|---|---|
| aaggattccg | agggatggaa | actagtaact | ggtattgtca | cggtaggaga | tgggtctact | 36960 |
| gcggagactg | gtagggcaag | accatttatc | cagatgaatg | gtagtgctag | cccccttcggc | 37020 |
| aacgcttacg | tagctgctat | agcgatcgaa | gacctatcta | tggatggtgc | agatggggca | 37080 |
| acagggccgc | agggtccaca | aggtaatact | ggtgccactg | gtccgcaagg | tgataaaggg | 37140 |
| gatactggtc | ctcagggtcc | acagggtcct | gcaggtaact | ctgtaaacgt | tcaatggtct | 37200 |
| aaggacgggt | ctactaactg | gcacagtacg | ttcacttcag | gtgatctgta | catgcgtcag | 37260 |
| caggtgaatg | gatcctgggg | tcctgcgatc | agagcagtag | gtgagaacgg | ggctaatggt | 37320 |
| acgccaggtt | ctaagggtaa | ctatgtgagt | atgaagttcg | ccgtaatggc | tagcactcct | 37380 |
| agtaggcctt | ctggtagtaa | tccggctggc | tggtcagata | gccctcctcc | aggtaacccg | 37440 |
| ttatggatga | ttaaagcgga | gtttaatggg | gagactaatg | ctattatagg | taattggtca | 37500 |
| gatcctattc | gcctagatgg | ggatagtatt | aacgagaacc | tgttctactt | taaagcctgg | 37560 |
| ttagactcga | ttaccggagt | tgcaggcaac | ggttcatcta | taggtaagaa | ctacgagtta | 37620 |
| ctaagggcta | ggataatcgc | aggtacagga | gttaccgatg | cgtatacccct | cccatcagat | 37680 |
| ggatccgcct | ccatgttcac | ctaccttcct | ccaagcacca | catatacgat | gtctttcgag | 37740 |
| actgataacg | ctgtagaagt | tcgttgtcac | gtattttggt | acgctaaggg | aagcaatacc | 37800 |
| actggaggag | tgctgaagac | tattgcatct | actactgcag | gttttgagcag | ctttaccttc | 37860 |
| accacgccgg | ctaattcgga | taggatatcc | gttaggttct | cagttaacga | atctggggga | 37920 |
| aataacgttg | taggaaggtg | taagattgaa | aagggagcct | tcgtaacgtc | atatgttcgt | 37980 |
| aaccagtatg | acgctgtagg | ggatcgtggt | ccagggttct | atactcaggc | gatcacaaac | 38040 |
| ttaaccggat | ggaacgatac | tcaggcagca | tctttcttcc | agtcaacatt | tggtggacct | 38100 |
| ccggttaagt | atgacgtact | aactcagtat | aagtcgggct | ctccgcagaa | ctcctggact | 38160 |
| cgtcaatgga | atggctcggc | atggacagct | cctgcattaa | ctgttcatgg | tgatatgatc | 38220 |
| gtctccggtt | ctatcactgc | tgataagatt | attgcaaaca | acgcgttcct | ggcgcagatt | 38280 |
| ggtgttgaca | tccttttacaa | tagggccgcc | gcactaagct | ctaacccaga | gggcacttac | 38340 |
| acaatgaaaa | tagacctggc | taacgggtac | attcatataa | ggtaacaaat | gagcacggaa | 38400 |
| aacagagtag | ttgatattat | ccttgatcaa | aacgtgtcat | acggattgat | gctacagttc | 38460 |
| atggatatcg | atgactctgc | gtacccagca | acggaaaccc | ctgtcaatct | gacaggggta | 38520 |
| acccttaagt | cttcaattaa | agactctctg | gaatccactg | gggtaaaatt | agcagatttc | 38580 |
| gtcgtaacag | tagtaaacgc | tacacaaggt | caggcgtcgc | taggattaac | tgcggctacc | 38640 |
| gtggcaacaa | tcgttagtaa | agcaagtaaa | gaacgagata | aatataatcc | tagacttcgg | 38700 |
| ttcgcaggtt | actatgatgt | aatcatgacc | aaaggaacag | gagctaccgc | tacctcttat | 38760 |
| agagtcatgg | aggggagcgt | gtacgtcagt | gatggagtaa | ccgcgtaatg | gctattacaa | 38820 |

FIG. 15V sequence.txt

| | | | | | |
|---|---|---|---|---|---|
| caagaattat | tgcacaacag | gttaccgctc | ttgacggagc | taactcaagg | gtaagtaagt | 38880 |
| acccaaaatt | taccgtacag | ctaggatact | cagttagttc | tctggctgct | acagaattac | 38940 |
| tagatgctgc | cactagatcg | gcagcatccg | ccgccgccgc | taaaacttcg | gaaaccaatg | 39000 |
| ctaaggcttc | tgaaaccgct | agtaaaaatt | cccagacagc | agctaagact | tcagaaacta | 39060 |
| acgcggcagc | atccgcccaa | gtagctcaga | atttggcagg | taaagcgtcc | ctagtaacac | 39120 |
| cactaggagt | gatgaccggc | tcggcagaag | ctaagattgc | atctataaca | atagccgcaa | 39180 |
| atcagtcttc | tagcgttcac | gtattatttg | cgctctacgc | tacaggtaat | ggagccaaca | 39240 |
| gggatgatat | atacaatatg | gagatagtat | ccctggcatt | acctggtcct | gtaacctctg | 39300 |
| taaccgcgga | caacatcggc | agcttcctta | gtcatcgagt | aataggtccg | gccaacacta | 39360 |
| atggatttat | ggtaggactt | aaatctacta | ttgagggtag | caacgtgacc | tatgatgtat | 39420 |
| acctcaaatc | tcgtagtagt | ttcagagacc | ctaagatggc | attcttatcc | ggctccatat | 39480 |
| ctgttactcc | acctaccgga | cctttggtgg | acggaacatc | ccctgcgtgg | aaaactacag | 39540 |
| gttttgatac | tgatgttatc | tatgtaaata | gggcgcaagt | aattgatgat | ggcattagtt | 39600 |
| tagcccgcat | caaacaacta | gctataacta | acggtaaaac | cgatagctct | atacttcttt | 39660 |
| tatcctattt | aaatgaaaca | ggtatactat | ctaccaataa | gaagtctatt | tccctccggc | 39720 |
| caggaggtac | gagtgactct | agtattgcag | ctacggagtt | tctacctaac | gggaatataa | 39780 |
| ttctgcctaa | tggggatact | gggaaccaaa | ctattagttg | gttaggtggt | ccccgcatac | 39840 |
| gagtcaactc | caacgggtct | tttgttcttt | ctactaataa | tcccagtaat | caaactagtg | 39900 |
| ggtttataac | tttcaggcca | caaggtgatc | aagtaacttc | cactgagctt | cagattaggg | 39960 |
| atgatggtaa | cattaagcag | acagctccac | agtcatcggc | aggcaatgca | cttatacgcc | 40020 |
| aggatgcggc | tattcaacat | atcatggata | aggctccggc | tgccggtatt | actgctaacc | 40080 |
| ccctaagcga | cttgaacgta | ataccctacgc | ctgaaggtac | agatccttgg | ggagcagacg | 40140 |
| gtgtacgtgt | attccaatca | ggggtatcaa | caaaaaatac | tccggacgga | actactggtc | 40200 |
| ggcttggaac | tatcctcaac | gttaggcaca | cccagtaccg | tataatgcag | ttcttcatgc | 40260 |
| agagtaatgc | tactgcacct | attctgcata | ttagatcatt | aagggctgat | cagggtaata | 40320 |
| ccccaccggc | atggtttaaa | gtttatacag | aatactctaa | acctaacatt | cagtctgaca | 40380 |
| tagcaggtat | tactatagac | ggcaatggtt | tcgttaagaa | agcctccccg | atcgccaagc | 40440 |
| tcatagccga | aattcctagc | aaagaggatt | cattcttctg | gacaggcgtg | gaaactgtgg | 40500 |
| gaggttacgt | agggtgtaac | gcagaggctc | aaggtgtatt | tgctgtaaaa | actggactag | 40560 |
| gcaagtatac | tattaaaggg | agtttaggct | ggaacacgga | aggatggaaa | tttgagctac | 40620 |
| caagagatga | taacggcaat | atgttgtgct | tcgtggaatc | ggattggaat | gaggaagaga | 40680 |

FIG. 15W sequence.txt

```
aagagctaaa catacaggtg ttcacccgta agtttgatat taacacaggt aatatcatcg    40740
ctggtgaacc tatggagata ccacaaggtc gttggattga tctacgtctg gaaatgccaa    40800
aagtggaaat accagaagtg gaatttccag aagatccaga agtataataa aataaaaccc    40860
cagtcggagc aatccgctgg ggttttttcta tttacatctt accagaactt ccgaagccac    40920
cttcgccacg atcagtgtcg gtcagactat cgacaatttc aatgtcattg gggttataat    40980
gaggtacgat caccaactga cacagacgct caaagttatc aatcggttgt gtctcgttgc    41040
tcatattcaa caggttcatc ttgatggttc ctcgataatc tgagtcaatc accctgttg     41100
tattggcaat cattagccga cgtttccta gagaacttct cggaaccacg attcctaccc    41160
agccttcggg aatctcaacc gcaactccgg tatcaatcat caatgactcc ccaggaggta    41220
tggcacgcaa taggtcggaa gcacgatctc cgaagtaggc ccgtagatcc ataccggctg    41280
cttccgagct tccaacgtga ggtttacaat cggggtgaga taatttaata cgcattatac    41340
ttctcctgtg gcaatagccg taatgtcttt aacaaattga tcgtagatat cttgtcctgc    41400
tgcggcaact gcttccccac agaaacttgg gagatctact agagttaggt tacgttccat    41460
aagttcgcct gatttattca gagcctggac gaattttga gttcctggga gcggtagtgc     41520
atcaataatg tctagcacgc taccatgttc ccggattagg ttgtagccac gtttttcgcc    41580
gataccttca acaccacgaa tgttatcccc catatcgccc ataatggctt ttaatgagat    41640
aaactgatct acagtatcta cgttatggtt gtcgaacata tctttctcgt gatattcttt    41700
acgagtagta aacgagaagc gggagatatt cggagcaagc agggtatccc agtcaccgtc    41760
tgtggagatg agccagatat gatcgtagtg atgacctatc agctgaataa tgaaagccgc    41820
catgtcatct gcttctactc cgcggattcg gaaagtaggg aattggcttg caataagatc    41880
aaacgcatcg tctaagtatt caaagaattg acgatccgcc tctacttccg cttcggagcg    41940
atcggcgtac ttagcgtctc ggttgccctt atactccggg aaaatattgg tacggaagat    42000
actcttccct ttatccccta gaacgatagt gtgcttcgca tcgtaggagt ttgccaaaga    42060
gttgatggtg tttgcaaagg atgctgcaat aggcttacca ctatctttct tgaagcggaa    42120
gcctaagttc gtaccgtcaa caatcataag attacggcgt gaggcgaggc gttgttctgc    42180
ctctcgtttc attgttcccc aggatttact catttaacta aatctccaat ttcacatgcg    42240
tttaaccacg gctcaaaaag accgataaca atttccattc cacgtttatt aactatgaaa    42300
tgtgctctac tcatgaggtt atcaatcata gggtcgctac tatccagagc gataagccat    42360
tgaccacgat ctttcttaaa gatcagggcg ggtttcatgt tcatttgctc accttcacgt    42420
gcggcttggg cccaccattt ttctagctgg gattctccaa cgtttaggat attgctatta    42480
aattttcgt ctgcgtagtg tttgatctca aaacagtatt ggctcatttt acctacgcta    42540
ggtggcagat acacatcccc ctttagggag tgggattggc caaaagctcc tgaaccagga    42600
```

FIG. 15X sequence.txt

| | | | | | |
|---|---|---|---|---|---|
| acacgttccc | agtccaagga | ggtatattta | cgcagcatat | cacggatttg | gtattccgcg | 42660 |
| cgttttcctt | tctcgcgact | atctacggcc | attaggcctc | caaaattgat | aagccagctt | 42720 |
| cgtcttgttt | aacctcaatc | ttatgtgcat | acggatgtgt | gtgcccgtga | gatacgatga | 42780 |
| ttgagttcag | ctgatcttct | tcctgtagaa | gttctacgag | ggtattaatt | ccatccgggt | 42840 |
| caatataact | tacaacttca | tcaaggaaga | gcaggttgat | attaacttta | ctaatcgttg | 42900 |
| aaagcaacat | tcgaattgct | aatagcgtgg | aaatattgat | acggctctgc | tgaccagtgg | 42960 |
| agcagttgac | catagaagtc | ctgttaccat | cattgtagat | gacaacctgt | agcttcgtct | 43020 |
| cgtctaactc | gaaccctaga | gcaaatttac | cgctggtcat | gatagagaga | taatgattga | 43080 |
| tcatctcttc | aaataccttg | acactatgct | ccagcttata | ccctaccaga | tcttttagcc | 43140 |
| cggtaattaa | gatatctaga | tccgctactt | cttctgcaac | taaggacagt | tcagcctgga | 43200 |
| tcttatcaaa | ctcctgctcg | gccttttgaa | tctgttcacg | cttagcttca | tatttcgcat | 43260 |
| tttcacgtac | aactgattcg | ttatgggttc | ttgcaagttc | taccgaggat | ctgccttgac | 43320 |
| gaatgctaga | ctcaatagct | ttgatacgct | cagctaaccc | gctagcgtct | acgatttcat | 43380 |
| cctgcgttcc | attgacctca | tcaaattcct | tgaggttttt | gcgagcctgt | tccagagcgt | 43440 |
| taaacttaga | gatataatcc | ttaaacgccc | tatcttcctt | cctaagttct | tcaacttctg | 43500 |
| cttccagctt | ttgacgttct | ttatagagcg | gatcatactc | ctccttagtt | cgtctcatag | 43560 |
| cttcttgggc | ggcggaggta | tctaagtgag | ttccgcacgc | agaacactga | gttttacctg | 43620 |
| cggcattttt | gaaatcgtag | taacgtttct | tcaaatcatc | cgctctagtt | gccacgaccg | 43680 |
| ttaggttacg | cgtaacactc | aggagttcct | cagatttcga | ggtgggcgca | ggtaaatttt | 43740 |
| cgaatggtgc | aaaagttttt | tcggcagctt | gtacggccat | gtccaaagag | ctacgttttg | 43800 |
| caatactggc | ttttgcttc | tgagccagtg | ctaccttgac | ttttgcttcg | gttaattctt | 43860 |
| cgactagtgg | ctcttcatcg | aaaacaggga | ttgggatctc | tgattgaggt | gcgccaagcg | 43920 |
| aggcttttga | ggaaagtata | gattgggcag | ttcgcaggct | accttccaat | ccggacagtt | 43980 |
| ttgccgagac | ggctttacgt | cccgctttaa | cacgttcaga | aacttcctta | tattgttcct | 44040 |
| gatcaaacag | gttaacgagg | aaagtcttgc | gctgagcatc | cgtagtcttg | aggaagtcga | 44100 |
| gactggatcc | aactgactga | tatacgagct | tagtaaatgt | cgtaaaatca | caggcgagta | 44160 |
| cctcttctat | cagcttatac | gtttgggttg | cggtgtgtcc | gctgatatct | tcaccgtttt | 44220 |
| tagtgagagt | tactttggcg | gttgacttca | caactttctt | gacgttgtac | acgtcaccgt | 44280 |
| cttttgtgaa | ctgaccttct | agcgtatagg | ccttggagcc | agtatgccag | ttaaacaggt | 44340 |
| cgtccttctt | gataccacgt | gagttcttat | tataaagaag | ctcctctaga | gctgtaccaa | 44400 |
| ttgttgattt | acccagcccg | ttacgcccga | ttaactgagt | tacgcggtga | ttatcaaatt | 44460 |

FIG. 15Y sequence.txt

```
ctatcaccac gttctcagca tatgacataa aatggctgat tgtcaattta ttaattacta     44520
tcgacatact cagcggctct ctttaatatg cgtgttctag acgcttcgtc tagtttctgc     44580
acgtttgtga aataagtatc cagctcctgt agcagtgaca tatcgtctag atctaactta     44640
gcatctttgg tgacacggtt attgatcttc ttatctaaca gttcgctgtt ctttaacgtt     44700
ttgagttgtg atacgtcgcc ggtgacttcg tatataactc tgtcatacgc atcggcttcc     44760
attggctcgc cgacttcaat agtttttcgt atgagctgtg aagatctcc cagttcaatc      44820
cacgaaaggt agtgctcatg gtctcttggc aagaccgtat cgatgataaa agctccgtta     44880
gttccttttg tcctttctct gtgaaacgaa gttgtaagcg gagatccggg atagagcagg     44940
tcaacatccc cgatcttttg gctgttcttg tagctgtgga gatcgcctgc aaatactttg     45000
gagtacccat gttcgacgaa tctttcgagg tagatttctg gtacgacatg aggcgggatt     45060
gcacctctga catgcgtgaa gcaaatgtct gaaactctgg gcttccaact agctttgtga     45120
aggctgctgt aagggatgat atcgaactct ggagatcggt agtctttgac gactttccaa     45180
agtccatctg ttgcgtcgct aattgctgct gcatagtgat ccaggcaaga aatcgtttta     45240
gatttcattt cgtggttccc ggtgtaaata ataccaggat gttggagggt agctaggaat     45300
gcaaacagta gttcaacttc ttctgaagac gggtctgaaa catccatgat gtcaccacca     45360
ataatgtgaa ggtcacatcc agtagctcca aacacttcgt ccagcttttc accgagaaga     45420
ataaaccgat ttttctgcca ttcctgagga acgttcttcg ctcctagctt gatgtgatga     45480
tctgctgaga aaagtatttt catagtcaaa ataaaaggga gccgaagctc cccttgtttg     45540
gattaatcga ggtcagaagc tgcttcgtga tcgatgttac cggagttcgc ggaaccttca     45600
ttacctttag attcgtcgcc ctcctcatct ttcttacctt ccagccatgc ctggattgct     45660
ttcttctgct catcatagga cggaaccggg taggtaacat ccagtttagg cacttttttcg    45720
aagccttcga attcgtctgc ttcgttgtac agagcctcac caatcagagc aacgtcggct     45780
tcatgcaggg cggcctcttt agaacccggc tgattttag ccatctggaa ctgcattgca      45840
gcgatctgct gtacatcgta cttggtatcg aagccagtac cagatttgga gatagtgata     45900
tcgatctcac ccggatcttc cagattcagc tgggccatga tggagtggat accggtcagg     45960
atggttgcct taacttccat cagcttcagt ttgttatcag tacgatcgat aacaacggcc     46020
aggtagtttt tcttaggacg cagcggctga gccttaccat cttttcttctc cggatctttg     46080
aagcccatgt cgtgaaccgg atcggatgct ccacggatga aacgctcttt ttcacggtcg     46140
aaacgcaggc actcgaacgg agccggttta ccttccttat tctgaatcca gtacacataa     46200
cgcgggagaa cgccggaaac gatacgtaca acgttcttac cgttgttgaa cttcatgtag     46260
tccagtttgt cgccgttaga accgccagta gtagaacccc aagatttagt agccatattt     46320
aattttcctc gataaatgtc aattttgact tgttgattgc gattagtggg tggtgctcga     46380
```

FIG. 15Z sequence.txt

| | | | | | |
|---|---|---|---|---|---|
| taactgctct | aggaacccac | ggtggaatat | attgcatatc | cagtgatgta | tccttcgaga | 46440 |
| agctatattc | ggcatagttt | ctaaaactca | aaagtcctag | atactcagcc | aactgtcggt | 46500 |
| ctgacagctt | tcgtttatta | taaacgattg | tatcttcgtt | caagataaat | gatctacccg | 46560 |
| ttaacataac | atgagcttcg | ggatcttcaa | ccattcgtct | gataatctgt | acaatcagcg | 46620 |
| atgagttacc | tcgtgctaat | atgtaaattt | tttcgtaatc | ataaaacaac | atgattatta | 46680 |
| tacaccattt | tgagagaatt | tagcaactaa | gtttttattt | ttctgcttcg | gactttccga | 46740 |
| agattcagtt | gctgttccca | ttaatttata | cagatattat | atcgtatttt | tgaggactca | 46800 |
| gcaactgaaa | tttttaacta | tttgcttaac | tcttctttgt | aaatctgtct | ctcagttcaa | 46860 |
| tataaatatt | atatcaaact | ttggggttct | tagcaaacag | aattttatct | aagtttgcca | 46920 |
| tattcttctc | gttaaagtca | agaacttccc | acccattgag | acgatatacc | gcttctctac | 46980 |
| ccgccgcctg | cttaaatcct | acacctccta | gcttcagatc | cacgaggatt | gggtctaact | 47040 |
| tatcatctgc | catacgttgg | acacgacctg | ccaactgttc | gattagagat | tcgttattta | 47100 |
| ttaaagagcc | taacactaaa | cacgataaag | catttaatga | tacaccctcc | gagaagatgc | 47160 |
| tttgggaagc | cgctaacaca | cacggaccgt | cattggtcac | gtcaatctgt | acttgctccc | 47220 |
| tatcatcgag | cgaagttaca | ccggtgatcg | tgtaggtctt | cacacccctg | agttccaaag | 47280 |
| cattcgtaac | tctctcaatt | agatctatac | gatcggacac | aaacaggact | ttatggcctg | 47340 |
| ccatcgaata | tagctcgcac | aagtcaacaa | cctgttgaaa | gtattctggc | tgcgaatata | 47400 |
| catcgttagc | tcttatcgcc | cacggcacat | tcatatttcc | agaaacctgc | gttttagcg | 47460 |
| caaacctatg | gatagtaggt | ggcatagtgt | tatttaccgg | aggactatat | actttcgttc | 47520 |
| caaaatagtc | cttaaacata | acctgcaaac | catccttacg | ttttaatgta | ccggatagcc | 47580 |
| cgattttata | tcgtgccgaa | gactgctcta | gaaacttggt | aaacgtggtg | gcaacgcagt | 47640 |
| gatgcacttc | gtcaacaata | acggtgccga | attcttttgc | caaagcggct | ccgtgtttgt | 47700 |
| taactgtctg | tatattacta | ataacgatag | gagaatcgat | attaaatttg | ccagacccaa | 47760 |
| taactcctgg | ctcaatccca | aagaacttgc | gtacctcctt | ctcccacata | gctcgaatgg | 47820 |
| tagtgttggt | acatataact | aacgttttct | gcccaagttt | atgggcgata | gcaagagcaa | 47880 |
| ggattgtttt | accgaaccca | ggcttaccat | taataataca | cgtatcatta | cagtcttcat | 47940 |
| atatagggag | ctgatcccct | ggtcgcaggg | tgaacgatgg | ctttggaata | tccataggaa | 48000 |
| ccagagtacg | tttatctacg | atctctgtca | cttttttgccc | gaaagattct | agaagatcta | 48060 |
| atctggttac | gggaaaccac | ttgatctctt | tacctaccga | tcctgagttc | tggaacatta | 48120 |
| gaggatactt | tgccccaggt | ttaaagatct | ggtatgaagt | gtgttttaat | aagtattccc | 48180 |
| acagttcgtt | gctgggttta | caatagattt | tattagatat | aactatcttc | atatcttaac | 48240 |

FIG. 15AA sequence.txt

| | | | | | | |
|---|---|---|---|---|---|---|
| tctaagtcta | ggagtttctg | gctcctcttc | gtgcgtgtca | aaaataactg | gtgaaccgcg | 48300 |
| aaccaacgcg | tacgaaatat | agttggcagg | ttcactaagt | aagaaaggat | atggaacgtt | 48360 |
| cttgacataa | cactggtact | ttccgttgaa | gattctagtt | gatcctctaa | cgcgttccgt | 48420 |
| gataatgttg | taataagtcg | taggtttcca | tgttactatc | ttacctgtgg | agtcgatgaa | 48480 |
| atgctttagt | ccagagttta | ttatctgaga | taagtacttg | aactgtttct | ttaaaggata | 48540 |
| gagcttataa | ggtaaatttt | cccgctcacc | ataaagaaaa | agccttcgct | gagagaatgt | 48600 |
| cccaggaagg | cttggattgt | ccagcacata | ccttgtaaat | ctcgtctgga | taacaatgta | 48660 |
| ctcccccctct | tggaagagta | catcataagc | ccttaaagca | tatactggta | agctaaagtt | 48720 |
| aagcaccaag | aaccctgcga | acgttgacaa | tatctttgct | gatttccggc | aaaaacttaa | 48780 |
| tattggcgta | cttatcgtga | tcagggtggt | tttcatcgtt | agccgcaata | gcagcgtagt | 48840 |
| cgaagtcctc | cataccgata | atactacgta | ctttctcctc | aaactccttg | tcctcaatgc | 48900 |
| aagcaacaga | aggacgctgt | ttcttgatct | taccacagga | gtaatcacga | gaaccgccag | 48960 |
| cctcggagtc | agagtcgata | ccaataggac | agcccggaat | actaatacca | cggtctacct | 49020 |
| gaatgttacg | gattagcatc | tcgttatact | gatcaactaa | atcctcacga | acaatggcaa | 49080 |
| ccacggagtc | gtgaaccagc | atgataatct | tcatttcgtc | ctgcagaccc | agagagcgaa | 49140 |
| tctcattatc | ggtatcgata | gcgcctagca | ggagactatc | agaagatgca | gactgaatga | 49200 |
| tggcgttgaa | accagaacgc | agttcttcac | cctgtacacc | acggtcttcg | gagttaatgt | 49260 |
| tgtgcagacg | acgcttacga | ccaaagtggc | tgtaaatgaa | gccgttagtt | tggatctggg | 49320 |
| catgagattt | atcgatccat | ttcttaagct | gagggaatcg | gccaaagtag | gtttcgatgt | 49380 |
| actctttcgc | atcaccagta | gtacattcag | tgtacggttt | accggtcttc | atgtgctctt | 49440 |
| ctaggagagc | ttcgtttact | gacgctgcta | ctttagccgg | gccagaaccg | taaagaatac | 49500 |
| cgaatgaaat | agcttttgca | gcctgtcgta | gtgcaggata | cagttttta | acctcagtcg | 49560 |
| gtttacacgg | cagagcaaat | accatgtgtg | caattgaacc | gtggaagtct | gagtagtttt | 49620 |
| ccgggtcgtt | ctgcatgttg | ataaacactt | gctgcatgtt | aatgtcacca | gacagtacag | 49680 |
| cggcgtagta | aatctcagca | gttgttaagt | cccatgcgat | aatacgataa | cctacagggg | 49740 |
| caacaataca | acctttaata | acagactcat | cacgaggtaa | ctgctgaagg | ttcagcttac | 49800 |
| cagacgaact | cagacgaccg | gatgtagtca | tatggatatg | gaatccagta | cgaatgcaac | 49860 |
| cgtcagcatc | aatactgatc | agcatcttct | cgatatacgt | cgagagcagc | ttggagatct | 49920 |
| tacgaatctc | tagcagagtc | ttagctatcg | gatgctggtc | cgaaagctct | ttcagggcat | 49980 |
| ctgcgccggt | ggaatctgca | cccgtatctg | tcatgatacc | cgtcggggtt | aagccaacat | 50040 |
| aatcgaacag | gagcttacga | agctgtacaa | cagaggctgc | gttaaatact | gagccctgat | 50100 |
| cttcctctag | cttacgaact | tctggatact | catacagctt | agcttttgca | agctgtagcg | 50160 |

FIG. 15BB sequence.txt

| | | | | | | |
|---|---|---|---|---|---|---|
| cagtcattaa | ctgaacctga | gcctctttca | gacgatcttt | ggagatcggt | acaccacggt | 50220 |
| cttccatacg | ctgtaggaat | acacatcccg | gcatcagtac | atcgtaatac | agagacttca | 50280 |
| gtcgagggtt | agcttcgact | tttggcagga | agaaattgga | tagacgcagt | gttgcatcgg | 50340 |
| tatccttcgc | tgcgtaaggc | cacatgatat | caaacggaat | gagatcatac | gagaaatcct | 50400 |
| cttctttgat | cttatgcgtc | ttgcaatacg | tctccttgaa | ctggtcgagt | tcaaaatcgt | 50460 |
| agtcccccat | atcggtatac | ttcatcgcca | aagatttcaa | accgtgtgta | ccacgtcgtt | 50520 |
| catctagggc | gtagtgcatc | agcatggtat | cgtggaggcg | tttctcttct | gctgccttat | 50580 |
| caaaggatag | acctaagtga | tagcagtaga | agtgcatatc | aaacttcaag | ttatggaaca | 50640 |
| caacgccatg | ctccgggcta | tcgaacagtt | tctgtaagta | atagacggta | ttttctgtga | 50700 |
| tgacgtctgc | atcaatatat | acgccctgat | actcttggtg | ggagattgag | atccccagca | 50760 |
| tgtaaccatc | tcggcagtat | agcgcactgg | tttcggagtc | atatgcgatc | atgccaggac | 50820 |
| acatggtata | caccatcttc | acatacgctt | cggcttcgtc | cgggcactga | atcgggcggt | 50880 |
| aatcccctgc | tttagagcgt | ttttcacgac | cattgagaat | ggcatgaatg | ctctctactg | 50940 |
| tggcttcaaa | tacaggcttc | atttccggtt | taaagtggag | ctgggccgga | ctgatacttg | 51000 |
| caatccagtt | agcatacccha | tcatgctcaa | cacgtttacc | tgagtaatcg | gaaatgccct | 51060 |
| ttttagctgc | aaacttcaag | aacgggtctg | cacctaccag | aataacgtaa | tcaaaatctt | 51120 |
| ccggattgaa | cgggttctcc | ggtgttccga | tagtgatatg | tttcttgagc | agtcgcccgg | 51180 |
| ttactttctc | actagccatg | aagaaggtct | caacctcatg | gtcaaagagt | tcgaagtgtt | 51240 |
| tctgatagcg | gacgttattc | ggtgatttgt | ctacaactgc | gatttcatt | gatttctcct | 51300 |
| attaggtaag | caagtaaaac | gtcagtgttt | cttctcaaac | ttacccaatt | attatatcaa | 51360 |
| atcttgacat | gttcagcaat | caagatttct | acgtttctga | tgagttggtc | gacttcttca | 51420 |
| gcatctaggt | ctccagggtc | tttgccctct | ggaagcaaga | agttacctat | aattggtata | 51480 |
| attctagtct | tatcacggat | taatttggcc | aacttcttag | ccgcctcatt | accggactta | 51540 |
| tcattgtcca | atatgatgac | tacgtgagta | gtaccggcga | tttggaacgg | catgaattta | 51600 |
| tctgcaatgt | tatctagtga | gaactggtga | gtaccaaaac | aacatgaaac | gttatggcaa | 51660 |
| cctttatctt | ctagattcaa | catgtcgaat | ataccttcga | ctaggattag | gctggggtg | 51720 |
| ttatagcgaa | cagggaagat | tgggggggag | accttcttag | gtctaatcat | atatttcgga | 51780 |
| ggggcagagc | tatccatatt | acggcctaag | aagaataagt | ttctccctac | ggcatccgta | 51840 |
| ataggaaaca | ctacacgacc | ttcccagtcc | tctgtttgtt | ggaatgcaaa | gtatttcttg | 51900 |
| aaagtctctg | ctttgatacc | acgaaagtct | tgatcgaata | tcatggctga | ttctggaatt | 51960 |
| tctagactgc | gaccctcagt | tcggaggtca | ctaatcattc | tgcgaactct | caggagtcta | 52020 |

FIG. 15CC sequence.txt

| | | | | | | |
|---|---|---|---|---|---|---|
| ggcgacgtcc | tgtactgttc | ttcattgaag | taatgaaaga | tgcttggtat | accacgacca | 52080 |
| aatccgcagc | ttaggcagtg | gaaaaccccg | gaatcggggt | caacacgcaa | actaggatga | 52140 |
| gcatcctcat | gatcaggatt | gagacagcgg | atgaggatgt | ccccacccgt | atctctgtat | 52200 |
| tcaatcccctt | tgagatctaa | aagctcggtt | attctactca | taagtctctt | gaggattctc | 52260 |
| cggtgggatt | agtatcctca | tccgaagcct | ttttccttttt | tggtttgtct | ttcggttat | 52320 |
| cgctttcaag | tgggataaca | aactctgctt | ccatctgacg | aatgtcctct | agcttaaggt | 52380 |
| cagaagtctg | atccatacgc | agtgagttcc | agttgatctt | cggcatgaat | gtcataccct | 52440 |
| cggagttacg | agttttttacg | aagtcgaact | tgattgcacc | gtcatgcccc | tcgttctgtt | 52500 |
| tagcagcatt | taggtttgca | gccatatcac | aggaatcgag | aatacctctt | gccatacggg | 52560 |
| cgttaccctg | ttggtcaatc | tggtaagggg | ctacaccagc | aacgttatgc | ttttggcacg | 52620 |
| tagacttgaa | tgtagaggag | acaaccatct | gctgcttcca | atcgtacata | tctagtgtct | 52680 |
| tcgtatccgg | caaacgtacc | tggttgatgt | agtctagcag | ggcgattgtt | accttatctc | 52740 |
| catacttgga | ggttagctta | gttagttcaa | catcgatggt | tgctgtacta | agttccggat | 52800 |
| catacacaat | gatcatcgga | gtgtgcaggg | gtctttcctg | cattagcata | gtctccatgt | 52860 |
| catggaaatc | actcatctcg | ttgagcgtat | aacgtgatac | aaaatcgtta | tatacttcca | 52920 |
| gaccgccttc | aaacatttt | gcacgagtct | tcgcaagttt | gttgagttca | ataccttgta | 52980 |
| aggagtcatt | gcgcatagcc | ttagcggaaa | caccggccat | aatggctagg | ttacgtctaa | 53040 |
| agacctcatt | ctctggcatt | tcgatggaga | aatatggggc | gatatccccg | ttgtaatatt | 53100 |
| gggctacttg | aatgttagaa | cagatgattg | atttacctgt | accacgccat | ccaccgagta | 53160 |
| gcagtgtttc | ttttctggca | attccgccaa | gttgagcatc | aaattcgttt | gagatgccga | 53220 |
| gagagataag | atttaacatg | gagtcttctt | ttctcttgaa | aacacgcata | gtatcggcgt | 53280 |
| tgaagacctt | accagtcgtt | gttactcgtt | cctctagctt | catgtgcaga | gccgctactc | 53340 |
| gatcaagtaa | ttctccctga | tccagtatgg | taatatcctg | caacacatca | gtttctagca | 53400 |
| gattcaggaa | tagatcctgt | gtgtattccg | actctaggac | atgaatcgca | tgcgatatgt | 53460 |
| caacgtctgg | aatctgagtg | tttgctaaaa | cagttagtgc | ttgagacaac | cttgcgtttc | 53520 |
| tgttagactc | tagcattaga | gcatctaacg | aaggcattcc | gttatgcttt | ttgtaataat | 53580 |
| tctggacagc | ttggtagatc | gcggtaaatg | cgtcattgaa | gtgatctttg | cgcagtctag | 53640 |
| agaatgtctc | tagggccacc | tgcttttgat | cggaggctag | gagcattttc | aaaactactg | 53700 |
| cttggacgtt | atacataaga | tactctctac | gccgcgttag | cgtctactta | aacgaaaaag | 53760 |
| gggagaggaa | caaaattcct | ctccccctcag | gtcaaatcaa | ttacttggcg | gatttagcgt | 53820 |
| caagtttagc | gcgcttagca | acaccatcgt | gatccttagc | agagatacca | cggcggctca | 53880 |
| gcatagactt | aacaccacgc | tcggatttac | cagttgcttc | tgcgatctca | gcaacggtca | 53940 |

FIG. 15DD sequence.txt

| | | | | | |
|---|---|---|---|---|---|
| tatcggcgat | attcagacct | tccagaacgt | cttcgcgtgc | cttagcatta | gagacttcct | 54000 |
| ggaccggcat | agcttcgata | cggccttcac | gcagcaggct | cagagcttta | ccacggatct | 54060 |
| gcttaacggt | acgttcgaac | tgagcagcga | ttgcttcaac | ggacgcgcca | ctggcaacgg | 54120 |
| cattaatgaa | agcagcttcc | tgatccgggc | taaagctacg | tacagcagcg | gccttttcag | 54180 |
| tcggcttaac | agccgcagtc | agttccaggc | tcaggatttt | accctgtact | tgtttagcgg | 54240 |
| tataagcacc | accaactaca | gcagcagcga | tttcagcgta | ggtatactga | cccggatgat | 54300 |
| cgttcaggaa | tgcaaccagt | tcatcttcct | gacccggagt | ccacggagat | ttggttacgt | 54360 |
| cggatgcttt | ctgtacttcg | aagccttctt | tacgcagttt | agaaccaacc | gaacgggcgg | 54420 |
| taacttcttt | accagtttca | gcagccagtt | cagcagcgat | gttagcaacg | gcttcctgag | 54480 |
| agataacggt | cgcgttcaga | gcgttagctt | tagcggtcag | ggatgcagtg | atttcttcgt | 54540 |
| tccaggttaa | tttagccatt | tttatttatt | ctccagtaga | attttaatcg | tcaagacttc | 54600 |
| gatgcccagc | gattgtgctt | ttttgtatga | agaagaaccg | atcttggttt | catcttcgca | 54660 |
| gattaagtag | tttacagcct | tagtcacgga | ggttttcacc | gtatacccaa | gactttccag | 54720 |
| atatttggta | gcgtccgcac | gattttgaa | gtcgttgagc | ttaccagtaa | tgcaaagaac | 54780 |
| aactccgttg | gattcagtcg | ccggggtaac | ttgagcttcc | cgcgcccac | tgaatttcca | 54840 |
| tggtagatta | attacgttct | gtcctgccgg | tgtattcttc | cacgaagcta | agttttctcc | 54900 |
| agctttacct | tccgctttca | cagattggaa | atcgttgtaa | agctgggata | atttcttagc | 54960 |
| agcaacttca | ccgataagag | ggatactaag | agatccaaga | accgaaccaa | agtcaacatc | 55020 |
| ttgtctcagc | ttagtttcca | actctagctc | aagtttcgtg | gcgactttat | cacctacagc | 55080 |
| tctgaccaaa | tcttctttag | tcaggaaaaa | gagttctgaa | actttcgtga | tttccagttt | 55140 |
| agcaatcgtc | tgtgggccaa | agccctttaa | cttcatcttt | gagcagaagt | tctcgattaa | 55200 |
| tttactgctt | tgagctggac | acatagactt | gttacggcag | aacaactgat | cgttaactaa | 55260 |
| gtccagtttc | gaaccacaag | agtggcaatt | cagtggaatt | tcaattttca | ttgattttct | 55320 |
| tcctcatcaa | tttatataaa | tattatagca | agaaaatcag | gactaagcaa | tcgaaatttt | 55380 |
| tcagaattta | gctcagtctc | tcaccaaata | tttctttccc | tcaactgaat | gataatagta | 55440 |
| tacaccctgg | cgatgaaaat | gtcaataact | actttaaaaa | atcatcacgg | tgtatctatt | 55500 |
| gaatcaagtg | ttactcgtaa | acacgttcta | cgatgcgagg | gatgacccca | ccactacgaa | 55560 |
| ttacgcgaat | ctggcaaccg | atttctaggt | caagggcagt | gatataacca | acgttattca | 55620 |
| gggtagcttt | tgaaatgaca | gcgtcgtcga | tgactaccgg | ggtgaagtat | ccgacaggag | 55680 |
| taactttacc | ggaagcccca | acttgccatt | ctacccgttc | gagcgtagta | acctcgcctt | 55740 |
| catcatcttc | tttgatggcg | tacgcaccac | gcgggaactt | gttagtccaa | cctgctgcgt | 55800 |

FIG. 15EE sequence.txt

| | | | | | |
|---|---|---|---|---|---|
| taaattggtt | gttgccatcc | atacgaacca | ccacgccgtc | cgttgggaac | caatctactc | 55860 |
| gactggagat | atccagacag | gtaacaaaac | catcaccctg | gaggatatgc | atatctccac | 55920 |
| agaaagtagc | ggtcaggcca | actttgccgg | tttcacactg | aatactatat | gccgtgaaca | 55980 |
| tcaggccacc | ttccgcaata | cgggagagaa | actctccaga | atctttcagg | ttaatagcac | 56040 |
| cagaggcgaa | gttacgcata | ttttcaactt | ctttggtgat | gtgtacttca | ccagtaatct | 56100 |
| gcaccggagt | cttttgggag | atccgtttag | ggatgttcag | taacttcaca | ttatgagtta | 56160 |
| catcattacc | taagacgccg | ttaccacggg | ttaacgcaga | aacgaacttt | ccgtcaatat | 56220 |
| acagaagtga | aatagcacag | ccatcgagct | tcggcgtttc | aatgccctgg | aagggtactt | 56280 |
| cttcgccgcg | gcctgggtac | actttctgta | gggagaacat | acggaatagg | tgaggtacat | 56340 |
| caccttagg | gccaatttct | tcctctagcg | gaaaacgacg | gattaaggca | tcatactctt | 56400 |
| catcagagat | aatcgacatg | cctttgtagt | acgcgtcttg | gcacagctta | ataaattctt | 56460 |
| taacgtgttg | cattatttgg | cctcgtagta | atcgaacagc | atctgagtct | tcccttccca | 56520 |
| gtaaaagttt | tcgcataccg | cctggaaggt | ggacattacc | ctacgcttag | attttggact | 56580 |
| gtacaattcg | catactagta | cgttcttctc | ataccacatg | cctagcatct | ggaagcctga | 56640 |
| cattgtccgt | actacaggtt | tgcccttctc | tttctctaac | caggttagga | ctagctcctg | 56700 |
| accctgaagt | ggcgggctgg | agtatgcgtt | aagcgttatc | ttttgcattc | tttaatgcct | 56760 |
| cgttaacaat | tctagacatg | tgtgctctca | gctgttgagt | gtgagcatac | gtcttagcag | 56820 |
| cttcggtcag | cttattaact | aattgagcga | tttcatgatc | tttcataaag | atctccttta | 56880 |
| aactatgaga | atattatatc | aaggtttaaa | acactaagca | attgagattt | taaagaaaaa | 56940 |
| gccagcaact | tagtcgtcac | tggcttgggt | cttttgagat | tcacggtaaa | cttcatgaag | 57000 |
| aacctctgaa | ttgcttagta | ttttagtaaa | tgcacggaat | agcgtgctgg | tcatttctaa | 57060 |
| cgtgtacggg | aacgagaagc | ctgatttagt | agggaaccag | ttatcttcaa | tatctagtaa | 57120 |
| ccataatcgg | aaaccaaagt | ataaattgcc | tctaaactcc | gagacagtca | tacgaatctg | 57180 |
| tcgcccttca | tcttcaaaga | taacgtggga | ctgatcatca | atatgtcctt | cgtaatcctg | 57240 |
| acaaatgttt | tgattcattt | ttattgttct | cagataaaca | aaaagccccc | gaaggggctg | 57300 |
| attgcgtctt | aacgacctac | tggagtagct | cgatcaagtt | cttggttgag | gctggtgatg | 57360 |
| cgcttaatat | tcgcaatcgg | aatatagcgg | aatttatcgc | tagagcggct | aaagaccagg | 57420 |
| atatgatctt | tgtcagcggg | ttccaggcct | tcacggacga | ttcgctcggc | cagatattta | 57480 |
| tcttgcttag | gatcgaactc | agtcgtaccg | tagaggtaag | ttacccccctt | ggtacgcagt | 57540 |
| ttggtgtatt | gcatgcaaaa | ctcaccgtgt | ttctcacaga | tagctacgac | ttgtgcttta | 57600 |
| ttcattgcaa | taccctctta | tttagtgatt | ttacggatag | cttcagccag | gtgagaggca | 57660 |
| gctttaccgg | tcagtttgtc | aacgatcgat | tcgtccagga | agccatcttc | cagtccagcg | 57720 |

FIG. 15FF sequence.txt

| | | | | | |
|---|---|---|---|---|---|
| tcgttaaatg | cagcgcgcag | ttcagcctga | gcatcagact | tagaagtacg | gccaccagct | 57780 |
| ttaggggcat | caccaccagt | tttagcggta | gacttaccag | cttctttctt | gacgtatacg | 57840 |
| ccagctttgg | acagcttcat | acgaaggccg | ttcggggaaa | caccgtgctc | tttggcgatc | 57900 |
| tcagctacga | tctccatgga | aacgccagga | cgctcatctt | ccgggaagag | ttcgattttg | 57960 |
| gcgacgtagg | cagaagtcag | ttcagcttcg | agttcaggag | accattgagt | tggagtagac | 58020 |
| atatttatta | cttccttatt | tattgttaaa | aagagttttt | aagttttgtt | tcagactatg | 58080 |
| agaatattat | aacaagttac | tgagctgcaa | agcaaacaga | attttctagg | atttggttaa | 58140 |
| cagctaccaa | accattaggg | gacaaacgat | acatcttcag | caaaccacga | tcgtatttgg | 58200 |
| taagccagcc | attatcttct | gcttcgtcca | tgggaagtgc | atagtgcaga | tcccggatag | 58260 |
| ctgtagcacc | ctcggaatag | atctgaaata | agttcaggag | ttgatattta | ctcacccttta | 58320 |
| cctctctttt | ctagtttcag | ggctgctttt | acagcgttat | taaccagttc | agctacgtct | 58380 |
| tctttacccc | acttgaaccc | cagggacttg | atatcaacac | caagtgctac | cagatgttcg | 58440 |
| acagacgcca | gatcccaata | catgtagtta | acatactgct | ggcgggcttc | ggacagcagg | 58500 |
| taaacacgat | acgcgcctac | cggattatcc | agagcttttt | taacttcgcc | aatacactga | 58560 |
| tagccaggaa | cccaaacgtg | ttcgcctact | tcgaatacct | cttttcattga | ttcttctgga | 58620 |
| atcgcaggtg | gaaagagcgg | gtcaacctcg | ccattaacac | gaagcagagc | accgtgagca | 58680 |
| gacagaacca | ttctgatcat | gtttgcggaa | cggtagaaac | gctcggcaat | tgcctcaaaa | 58740 |
| ctatcacctg | acaggtacga | atcgataacg | ttggccagtt | cagccccttc | gatttagta | 58800 |
| ccacgtttct | ttttacgcat | ttcagcggaa | acacgctggt | tatctttcca | ttcctcgata | 58860 |
| aggcgttcca | tcgtggagtt | agacgctacg | ccgaggattt | cgcaagcgcc | tttcttggtt | 58920 |
| ttgccttcct | ctagccactg | aatcgcttcc | ttaaactttt | cgtccgggat | gctattagca | 58980 |
| tgaagttttt | tgcggattgc | catgttcttt | atcctctctc | gaatttatga | aactattata | 59040 |
| atacagattt | agcttctaag | caatcgcgat | tttcatagaa | cgtagggtcg | aaagtaacgt | 59100 |
| gcatgaattc | agatagactc | ttgtaccca | tgttaagttc | catgttgatg | cgtatagaaa | 59160 |
| ggcgtgtctt | tcgctgagcc | tctagccaat | catagatatt | tggcatctgt | gctaagcgaa | 59220 |
| taggtattac | tctacacaat | tctatctctt | tagctttccg | tgctttcgta | tcgcgtttgg | 59280 |
| gaaacttcct | tgtttcccag | cgggcatcac | gcttgctcat | tacgtactcc | aagttcgttt | 59340 |
| tgcgcttcat | cggccagcgc | cttctcctcg | tccgtcataa | actcatacg | tacagagata | 59400 |
| ccctcgatag | aacagtacgt | gcgataccag | tctacgatct | gctccgtctc | catttcctta | 59460 |
| ttaataccca | tttgggttaa | gtacatacgg | gcatatttag | ggttggcaga | ctgtcccgtc | 59520 |
| ctaataaaga | agtccttctt | gtgtttcttc | agggcttcaa | taaggggct | aatcgtcacg | 59580 |

FIG. 15GG

```
                              sequence.txt
ttagaacact tcttaatatc cttccagaat atatcttgaa gtttatggaa gaactccgcc    59640
cgcttgtgtg gtttcttact aatccacatc tccgcatgtt cctgtgtgat actcttgata    59700
gagtccaggt ggaagtactt gaccaacatt agcttggctt cgtatgcgtc cgcatgacgt    59760
ggtgcacacc aatccggggt actactcaaa atagcagaga ctcgttcagc agtatactct    59820
gcggccgagc tatcaatctt accccagctt tcactgaaga tatcgatagt tgctccctga    59880
tccagcagat aataccgcag agtactgata aagttacggg actctagttc acgacgttta    59940
acatacagct gctgagctaa ttctagccaa ccctcatcga tgttatactg ctccgaaccc    60000
gcagagaatc cgctggtgga cttatcgatg aaatagaaga tattcttagc tccccggtcg    60060
cgcctgattg cctggaagcg catgtttggc gcctggttag cggtacgagt aataacgaat    60120
acgttgtcga agtaattaaa gtcaacacca ctcgttactg acggactgca cagtagacaa    60180
tcaatctgct gttcaattaa ctcattcgtt gtataatcca agatacgacg aatatctata    60240
tcagatgtag agtttgagtg aatctcttta acaatcgcac ctgtattgtt tcttagcgtc    60300
aggcctttct cgtttaactc atccggccca cagtcggaca ccagaataga tttctctccc    60360
atctctaggg acgtttggag ggcaacccaa atactggatt catcagggaa ctcatacgcc    60420
tgagcatccg agagcatctt acgatggtgt ttataataag agaccggctt gtcaaaatct    60480
atgagagatc catatgcctc aatggtttct gcgctgatat ccccgtcaga caggataacg    60540
acttttgcag atagcagaat ttcacgaaga actgagatac actcacgacg ttgtttaaca    60600
actggagcaa ataacaggtc attcataact gcgtcgcact catcgataaa gataacatcg    60660
atctgcccaa caaagttttt aaacttgtgg attgagtgaa tagtagtaga catacgatca    60720
atggcaccgc gcttgaagtt taacatatct acggacttat catactgtcc ggcttcaaac    60780
ttcttagcgt tagatgaaac cagggcacgg gtgttagtaa ctgcaaggaa attaccttc     60840
agctgatcac gttctagcca cttcgtcact gcggtggttt tacccgtacc tagagaagcc    60900
ttgataaacg ttaaatgccc ttccggtggt ggacggttga tcttcaaata attcatcccg    60960
tctgggctat cagaggtcaa cttgtgtaca ggaacgcctt taacattcga ctcaggaata    61020
tctcgcatcg agttgttcac aaacgctttt aatgcctgct tacgaccgtt attgaagtaa    61080
tcctgaagac tgcgggaatt atccttcgtg ttgatataat cggacaaagc tgaggtaatt    61140
tctttctcaa gccaggcgaa atcaacaccg tcctccagag ctctgtggta cagtttagga    61200
ataatacgca gataaacacc atcctctgct tcttccagct ctgcaatggt ttgttccact    61260
ttctcagagg ctacgcgctt gcctttaatc tgattaagta gggatagaaa ctcttcttta    61320
aattccccac gagtggcttc ataatctggc atagtattgg gcagttcaat cctagcaccg    61380
ttaactttaa ccagacgtgg cttaccctcc gctttaaacg gatcggtaaa ctgatcccgg    61440
aaaatcgggt cagcgaaata gtgtagctgt acagatgaat aataagctaa gtcggcaata    61500
```

FIG. 15HH sequence.txt

| | | | | | |
|---|---|---|---|---|---|
| tcaaaaccat | acttctgccg | agagctatca | ttgagggacg | taaatagaaa | ctttaactga | 61560 |
| ccctgagtaa | cgggaatatt | actctctaat | agcatgtgca | tacgaatccc | cggcttaatt | 61620 |
| ccagccgaag | acgacgcatg | ggcaataaac | cctgcgttaa | gcgggaacat | gtcctcgctg | 61680 |
| atgctattta | ataacttaat | gacatgacgt | cccataccca | caatgtcaaa | cctgtcgcat | 61740 |
| cctccggtat | cagagattcc | atcgacgtcc | atagcaataa | tattgctctt | atggtcgatt | 61800 |
| ttgaagttag | tacgtttacg | acgcacggcc | ttctctgcaa | ctaagcatgt | acctcgtact | 61860 |
| gctacgagat | gtggatcttg | agtgagctga | accatcagct | catacgcttc | attaagattt | 61920 |
| ttggggtcaa | ctgtatccac | tacgttaaat | ttgtagggca | ttgaggctgg | cttaccttct | 61980 |
| ggatgctcgt | tagaaaactc | cttcgcaaaa | aggtaatcag | ttgtcttcac | ttccttccag | 62040 |
| tttccggaag | cgggatcgcg | ggaaaaaccc | gcgtgtcctt | ctagaataga | aaacattacg | 62100 |
| ttttctccta | tgttgaagaa | taaagcgatc | tcgaactatc | aaggatagaa | cagcttaaaa | 62160 |
| gtccactgac | tcaacaaatt | tccttataga | tggaggggtg | gtcacttcct | cattgctaga | 62220 |
| actggccgct | tcgcacaact | cccacacagc | atgtaatcgc | cgctaagctc | catgtggttg | 62280 |
| accccctattc | gtcgctattg | cgcagaggta | cgttgctact | tacagcttca | cttcttggtc | 62340 |
| atttcagacc | gcggtgctat | ttgctccaca | tgactaacga | acaaatatct | gagagcctcg | 62400 |
| cgatgccaac | ctctcttacc | cgcattctag | atcaattatc | tataattccg | ttcggaatca | 62460 |
| atttcccaat | aagccaaacc | caaccaagca | tgtagcagcc | ggactgttct | gtatgctcgg | 62520 |
| aagtgaatga | gaggaattat | gtcagttttg | taactcacat | catttctctc | aacctatgaa | 62580 |
| tatattatat | aaaaatcgtg | gcgagattgc | aagtaaaata | tttaaatacg | tggtaggtaa | 62640 |
| ctgggtttaa | gcatagaaaa | gaccagagga | taatcccctg | gtctaagcgt | tcaactaggc | 62700 |
| attccaaccc | ataatattaa | ttgagttaga | agaggcattt | tgtttgccct | cacgaagaac | 62760 |
| ctctggagca | tacgtccaag | gctcatcagc | taccaagaac | cccggagaaa | tacctgcccc | 62820 |
| cggttcccgg | aatgctgcaa | aattagaggg | gtggaacaca | acgttgttca | ccagaaccat | 62880 |
| tagccccaga | tccgagaggt | catcccaatc | aaagaggatc | tcataatcct | gggccaaact | 62940 |
| acctttggac | aaaccaacac | acacgtcatg | ctggatgatg | aagcaaagct | cctcgtccct | 63000 |
| caacgcggct | cgcagcagat | tctctgctac | atcaatcaat | tccttgggga | tatccgccca | 63060 |
| ggagatacgt | tccattttag | gaatactcat | ttagttaacc | cttcaacttg | gaaaccgaag | 63120 |
| cgacgcagca | cctggatcca | accgttaata | ttttccggag | cataataatc | ttcattacgt | 63180 |
| ccgacccaaa | tacctgctga | aacacctgta | accccaaccg | ggatatagga | ctcacgcagc | 63240 |
| agacacacgt | agcctagtgc | aaacaccagc | cccatctcag | tcagatcgcc | ccagtctagg | 63300 |
| acttcatctt | gatcttcgtc | cataggaacc | catagcccca | ggtgcatgtt | gtcataatcg | 63360 |

FIG. 15II sequence.txt

| | | | | | | |
|---|---|---|---|---|---|---|
| aagtagacct | ccatattatc | gcaccacaca | cgaagatggt | ccagcagaga | ctcttttacg | 63420 |
| tccagaggaa | tttcagccca | gggaactagc | ccaacccctt | gattaacaac | cttttcattg | 63480 |
| accagcatat | tcttccccca | tttggatgaa | ttcgtgccac | tgctcagagt | ccgctcgtaa | 63540 |
| aacctgatag | tcgtccgata | ggtgactcat | atcttgtaca | tcactgcgat | aacaccaact | 63600 |
| accgttgggc | cataacagga | tatcatcggg | atggtacata | aattttctcc | tccagccaag | 63660 |
| cctcaacttg | acctatgaaa | tgtttgttgc | taaatacatt | ggcagcagta | tcataccaaa | 63720 |
| cggggatccc | gcgttcttcg | tacaaactct | gctccaggta | gttaataccg | ttgttcacta | 63780 |
| cccacacctt | agtacctcga | ctatgggctg | ggaatagttc | ccaattaaag | tcgattactt | 63840 |
| ggttactagc | accaacaacg | attaccagat | cctgggttgt | cagggtatca | aacaggttga | 63900 |
| tctgccccat | ataccacgga | gcggtttccc | cgaagaacgt | aattgcaggc | ttaacccact | 63960 |
| catacttacg | gtaatcaacc | gcagtgtacc | cgatatcttc | cacgatcaca | tccttacctc | 64020 |
| ggcgatacat | tatctccgta | aggtagccat | gagcatggat | cacatcatca | tggggaatgc | 64080 |
| cagcacgctc | tagtagatca | tccacgttag | tagtaaagtt | aacgacttga | ccagggaagc | 64140 |
| gctcatacca | ctcagcaatt | ctcaagtgag | caatgttagg | ctccaccgta | cccagctcct | 64200 |
| gtcgccgcat | gttgtagaac | tcatgggtta | gctcgtacag | gttgcgacta | ggctcatcat | 64260 |
| cagatccctc | agaaagggct | tctaacgggg | gcatagggtc | gttcagatag | tgaaacccct | 64320 |
| tatcgaacgc | ctgaatattg | catacttcgg | ttagtttgta | tttatcccac | aggggagtga | 64380 |
| tggcacccct | acggaacgtt | ggcactcaat | ccagcaccac | ttacgataat | caatctacgc | 64440 |
| attacaggaa | ctccatatag | tttctcattt | cttctttccg | caactgctca | gccttttcgg | 64500 |
| acaagcactc | agaggttctg | ggatcgactt | tatctttcca | caagtggtta | cggcatcgca | 64560 |
| gaagttttac | cacgtcttct | cgggaaatag | atccgtatgc | tccagagtcc | atcataaagt | 64620 |
| agatacgctt | ttcatcagtt | ttatggattt | tcataaatcc | tccgtttctc | aattacaact | 64680 |
| atcttatcaa | aaacggaggt | atttagcaag | tgatttattt | caaattcatg | tgtttgaccc | 64740 |
| tttgcattac | ttcctgttgc | ttaccagggt | taaagggtct | actaccagga | ctacctaagt | 64800 |
| acccacaaac | gcgacgggta | accgagatat | tccccgaccc | acattgagga | catacaaagc | 64860 |
| cgtgctctcc | ggatacagac | tctcctagat | atccgcactc | ttcacattca | tcaactggaa | 64920 |
| tgttaacccc | tatgtagtga | gatttactta | atccataatc | aacaacccac | tctagtgcag | 64980 |
| ggataaactt | acgcatctcc | ggaagttcca | caaggatat | attaccccca | ttggcgatgg | 65040 |
| tggtaaaatt | agcctcatag | tcaaacttca | cgttaggggc | aactttgta | cggacatcca | 65100 |
| ggtggtggct | attagtcagg | tatcccttat | ccgttagcca | gtcgtactca | gggtactgtt | 65160 |
| cggcaatttt | agtattgaac | ctattgcaca | gagactcact | aggggtagca | taaaggctga | 65220 |
| atccaagatt | agtttcctca | gctttttgt | tacaacggtc | tttcatgtgg | ttgagaacct | 65280 |

FIG. 15JJ sequence.txt

| | | | | | |
|---|---|---|---|---|---|
| gtacagcaaa | ttcaatcgca | ggtgggggaca | tggggtcggt | atcctcaaac | attacttcaa | 65340 |
| ccagctcgtt | aataccgata | tatcccaaag | acactgatgc | cctgccttca | aagatgggcc | 65400 |
| atacaagatc | attggctttc | aaccgtaccc | caaaagctcc | gtgcatatag | agaattggtg | 65460 |
| cctgtttagc | acgcacacgc | ttcaaccgct | caatagccca | atcgtgggca | gccatcgctt | 65520 |
| tatcaatgta | ttcgtccaac | aacttccaga | acctatcgaa | gtatccctca | gactctacag | 65580 |
| caactagcgg | caggttaatg | gatacaaccc | ctaggttatt | gcgccccgca | gtctcccgg | 65640 |
| actcaatagc | tgaaaggaaa | gaccgacaac | ccatagggaa | cttaaaatca | cctgtaacag | 65700 |
| ccgttactct | ttcataactc | acgtaatccg | ggtacatcct | cttagaagtg | caggtgagcg | 65760 |
| ccagctgttt | gatatcgtag | ttgggatcgc | tgggagattt | attaagcccc | tctttaactg | 65820 |
| cgaaaataag | tttaggaaat | acagcagtat | gccctgaagc | acccaggcct | cttatacgaa | 65880 |
| cttccagcat | agctttctgc | aacatgcgtg | cctcccagga | ttctcctaga | ccaaacccaa | 65940 |
| atgtcacaaa | tggctgctga | ccattagagt | tgaacaacgt | attaacttcg | tactctagcc | 66000 |
| cctggcacgc | atcatatact | tcttttttctg | tcatttcagt | agcatacact | gctgccttct | 66060 |
| tactatcgtg | aagccaacgc | tggccaatag | ctaagtgctt | atcataggac | ttacggacat | 66120 |
| acggggcaaa | gacctcgtca | atacgatcga | tagacgtacc | cccatactga | cacgagctta | 66180 |
| cctgggcaat | aacttgggca | gttactgcag | ctgcagtaga | gatagatttt | ggagtttcaa | 66240 |
| tctctgctcc | accaatttta | gttccattct | taaacatccc | cgctaaatct | accaggcagc | 66300 |
| agttagtata | cccctgcgct | cggtagtcca | tatcgtgaat | gtgtatctct | cctctattat | 66360 |
| gagccgccaa | taggtatgct | ggaagctcct | gtgctaccac | atacttagag | acttccccag | 66420 |
| ctatcatgtc | cctctgtgta | gggaattgct | cgcttgcctt | attggcatta | ttaaacataa | 66480 |
| ggtcttcttc | accctcgtta | tcaaggatac | tatagatatt | atcaatcagg | tctaattcgt | 66540 |
| tcatatattc | ctccagttag | gcatatatta | taccaaatag | acacaactat | gtcaacctta | 66600 |
| ttttattata | atcaacagta | acttgatctg | gatcatcaaa | acaataaaaa | ctggaaaatt | 66660 |
| ttatttgctt | attcacccta | ttttatatta | ttcgtgtgcg | cccgcgcatc | gcgcgaataa | 66720 |
| aggaaaggat | ccgtcctcca | tatcatccta | gaaaatttca | gttgcaatcc | acgccaaaac | 66780 |
| ttggtatact | ggtattctaa | attgataaac | atggtcgaaa | tttgaccctc | tgtagacctc | 66840 |
| taaggagatc | gcaatgagaa | aagcagcacg | tcgtaaggag | tcgcgccgta | acggtagcgc | 66900 |
| aaaacgtgaa | cgtcacgaaa | acgtcatccc | cgttgatttt | gaagcacggg | aacgttttca | 66960 |
| accaaccgca | aaagaactca | agccgaagaa | cgctgagcaa | aagcactata | ttagcaccat | 67020 |
| ccgtaacttt | acggtgacag | ttggtattgg | agaagcaggt | acgggtaaaa | cgtttatccc | 67080 |
| atctgttctc | gctgctcaag | agttagcaac | gcctggttct | gtgtacgaga | agttcatcct | 67140 |

FIG. 15KK sequence.txt

| | | | | | |
|---|---|---|---|---|---|
| agtccgtccg | aacgaacctc | ttggtaaatc | cctagggatg | ttgccaggag | atctgaacga | 67200 |
| gaagatggca | ccgtggttag | aaccaatcgc | tgacggcttc | aagtgggcct | taggggaacg | 67260 |
| ttcttatcag | gggctggttg | aacgcaaggc | aatccaatac | cttgctatcg | aacatgcacg | 67320 |
| cggtcgtacc | ttcaacaatt | cttatgtaat | tgttgacgaa | gctcaaaata | tctccgtaga | 67380 |
| agcaatgaag | tgtattctaa | cccgcgtagg | tcaggattgc | aaattagtaa | tctgtggcga | 67440 |
| cgtagcgcag | aaagacatta | aatccgactc | tggtctgcaa | ctgatcatgg | atatctacga | 67500 |
| tcagtacgaa | catgtgcctt | tctccttagt | agagttgcat | gataacgtgc | gttccgctga | 67560 |
| atccaaagca | ttccaggcaa | tctttaacga | tatgggaatc | taatatggtt | actgaactga | 67620 |
| tcattggtta | tggtgagggt | attacctctg | aagaaaactg | gggctttgta | ggcttcggtg | 67680 |
| aaggtatcac | ttctcacgac | gaacgtcctg | acctctaact | ctaggagcgc | gtatgaacaa | 67740 |
| cgtatttaca | ctgaacaact | tccgcactcg | taaaacgaaa | gtgcatccag | tatccctggc | 67800 |
| aacagtcaat | aaatacaatg | ctaactatcc | tgaggatgag | cggcgacacc | atgccgcttt | 67860 |
| caagatagca | aacgaatttc | ctaaccaacc | cctcggtact | aaagagttag | ttagtcgaat | 67920 |
| gaaaaaatta | cacttttatt | aaagtagacc | gacacacagg | cagcctcgaa | aggggttgcc | 67980 |
| tgttttgtc | tgtaaaatct | catttgcaaa | atggccgaaa | acaaagtaga | atatctttta | 68040 |
| aatcctgaca | acttccaaaa | ggagttacca | atgacccaac | gtattgaata | cgttatcaag | 68100 |
| cgtgacggta | caaaagaacc | gttcatggcc | cagaagctga | atgactgggc | aaaatacatc | 68160 |
| ggaatccgaa | gcgatgttcc | gtggtctccg | gtagcggtag | ccgcagttaa | gaacctgccg | 68220 |
| aaaggtgatg | tacactcaga | cgatctgcaa | acaatgctga | ttaagtctgc | cgaatcaatg | 68280 |
| atcgagcgtg | atcatcgtta | cgaccgattc | gccctagagc | tgcgtttagc | ccagctccgt | 68340 |
| aagaacctgt | ttgattctta | cacccgccg | tctctgcgtt | tcttccacga | ccacatggta | 68400 |
| gagctgggag | cgtgggaaga | tatgagcggc | tggatctctg | acgaccagtt | cgaagctcta | 68460 |
| aacgaagtta | tcgaccacag | ccgtgacgaa | ctattcacta | atgctggtct | gaagcagttc | 68520 |
| atggataaat | actctagacg | taatatctat | acggaagaga | tctatgaaac | tccgcagttt | 68580 |
| gcctacatgg | gtatggcaat | ggcaatgctt | tctcaacctc | actggagtat | gctcgatgca | 68640 |
| atcgaccttt | ataacgcgct | gtcgctacag | aaaatcaacg | tcccaactcc | gccgctcgtg | 68700 |
| ggccttcgga | gtgctgacag | gggcttcgct | tcttgctgtc | ttgttgatgg | tactgacacc | 68760 |
| ctggactcca | ttgacgcagc | agagcacgtc | gtcttcaaaa | tggtcgctgc | ccgagcaggg | 68820 |
| atcggctatc | atcttgagag | tagatcaatt | gctgatccgg | tgcgaaaagg | cgcgttccca | 68880 |
| cactctggaa | aactgccata | ttatcgacac | atcgaccgct | ccgtaaaagc | taacactcag | 68940 |
| cagtcccgtg | gcggttctgc | aaccgtttac | actgcgttct | tcgatccgga | aatcattcag | 69000 |
| gtaatggaag | ctaagagcaa | ccgttcccct | gatgaaaaga | aaatcgataa | gatggactac | 69060 |

FIG. 15LL sequence.txt

| | | | | | |
|---|---|---|---|---|---|
| aacctgaagt | ttaacagtat | tctcctgaaa | cgcttcctgc | gtaaagagaa | catcacactg | 69120 |
| atgagcttcc | tgtacgctcc | agaagtatac | gcagcattcg | actctggtga | tgtagcagaa | 69180 |
| tttgaacgcc | tgtacatcgc | agccgaaaaa | cgtctagcgg | gcgttaccaa | acgtggtttc | 69240 |
| aagggtgaag | ttctccctgt | agccccagtg | attcctgccg | cagaactgat | tgagttctgg | 69300 |
| aaaactgtac | gtatggaaac | tggccgcctg | tacactatgg | acgctggtga | agtgaaccgc | 69360 |
| aacagccgtt | acaaagatcc | ggtgcgtatg | tccaaccttt | gtgttgagat | tgtacagcca | 69420 |
| acgttcccga | tccctcacgt | agtagatctg | taccgtacag | acgaagaact | ggataaaatg | 69480 |
| gatgtttcag | agtatgggga | agtatctctg | tgcaacttag | gcgggttcgc | cctaggtcgt | 69540 |
| atcaaaactc | tggaagagtg | ggagaagatc | tcttacatcc | tgttgaagtt | cgttgatacc | 69600 |
| atcatcgaga | ttcagcacta | tccgttccca | gctatgaagt | acacggcatt | acgccgccgt | 69660 |
| aacgtaggta | ttgggctgat | gaacgccgca | ggagcgatgg | ccgctgaagg | cctggcattc | 69720 |
| gaaggcgaag | aagcccgtaa | ctggattcac | cgtgaagcag | agaaggcatc | attcttcctt | 69780 |
| cataaagcgt | ctgtacgtct | ggcaaaagag | atcggcccat | gtgaatggtt | ccatcgtact | 69840 |
| cacacttctg | atggtacact | gttaatcgat | acttacaaga | agactgtgga | tgacctggtt | 69900 |
| tccgtaggtc | tggaaatgga | ctgggagagc | ctccgtgaag | agatcaaaac | tcacggtatg | 69960 |
| cgcaactctg | ttctgacggc | aagtatgccg | ggagagtcca | gctctgttct | gattggtgtt | 70020 |
| accaacgcag | tagagcctcc | tcgcagtgcg | gtaactatca | agacttcggg | cgttaacaaa | 70080 |
| gtaattactg | tagctccggg | tctagacgat | tgggacacca | tgcagtccta | taagtatgcg | 70140 |
| ttcgatattg | accgtactga | gcacattaag | tggttagcag | ttctgcagaa | gttcacggat | 70200 |
| caggctatta | gtgccaacct | gtactacgac | tttaacaaat | atcctggagg | tattattccg | 70260 |
| ggtactgaga | ttatcaaaga | tctccttaac | tccactaaat | atgggattaa | gaacctctac | 70320 |
| tacgcaaact | tgacgtaga | taccggaggc | tctgcagcag | agcagggttg | ttccagtggc | 70380 |
| ggttgtactc | tgtaattaag | ctcgatccaa | ccgaaagcaa | aatttatt | gcaagtaggt | 70440 |
| tggattttt | gttataatat | tcgtatatta | aatgagagag | gaaattaaac | aatggcaaca | 70500 |
| gtatttaacc | gcgaatggga | tcacactgag | tctaaactat | tcctgggcca | agacctggga | 70560 |
| atcgccgact | atgtaaacgt | tcgctatcct | cgtttagagg | aacttgcatt | actgcaacgc | 70620 |
| tcgcagttct | gggttgagac | tgagatctcc | ctggaagccg | ataagaaaca | atggcctaat | 70680 |
| ctgccacaac | atattaaaaa | caaaccctg | ctgaacttag | cctggcaaac | ccaagccgac | 70740 |
| tccattatca | cccgtgctcc | ggaagatgcc | attctgaaac | tggtatctcg | ccctgaactg | 70800 |
| gaaggtatgc | ttattcagtg | gagctacttt | gagaatattc | atagccgtgc | gtattccaac | 70860 |
| attattcgta | acgttctccc | taatccgggt | gagttcattg | caaccgtaca | ggctaacgac | 70920 |

FIG. 15MM sequence.txt

| | | | | | | |
|---|---|---|---|---|---|---|
| gaagcattcg | cacgtctagc | actgccggtt | tctgttattg | atgagttggc | cgaaattgcc | 70980 |
| gacatttggc | tggacgctag | agccaatctg | gaaatcgctg | agaaggaagg | tactctggaa | 71040 |
| tacaccgaag | aggcagactt | cttagcactt | actgaacaag | tacagcagaa | gattctggag | 71100 |
| ttctactacg | ctgtatacgc | tctagaagcc | attatgttct | acgcgtcgtt | tgcgtgcacc | 71160 |
| tttgctctgg | cagaaaacga | tatcctaacc | ggtattgcaa | agaacttaca | gctgatcgct | 71220 |
| aaagatgagg | cactccatac | cgttatggct | atggaagttc | tccgtattct | tcaaaatggg | 71280 |
| gaaattcccc | cacatgtagt | ggcagcagct | caggctaacg | ccccgaagat | cctgcgcagt | 71340 |
| attctggaga | cagaaattaa | ctgggcgcat | tatatttcc | cggaaggcga | agatattcca | 71400 |
| ggcctgaacg | ccgatttgct | ggtagagtac | ctgtactaca | acgcacgcct | ggcatttatg | 71460 |
| gcgatcaaca | ttccgtggcc | ggaagatctc | ccggtaatta | tggaagaccc | gattggctgg | 71520 |
| atgaaaggtt | ggctgaacac | caagaaccag | caagtagctc | cgcaagaagc | acagattacc | 71580 |
| aactatcgtg | ttggtgcaac | ctctcaggct | aacccggacg | atctgtctga | tgaatttgga | 71640 |
| gagttcctgt | aatgattaca | gctttatacg | caatgcgagt | tgacgccgcc | ttcgggattt | 71700 |
| ttaatccggc | tacaatggat | gcctacgggg | aacttccctg | gggctccatt | cccgaggagc | 71760 |
| tagaacagtt | ctacagaatc | ctggatacct | atcaggttgt | tatagtgggc | cataatacct | 71820 |
| acgaaacagc | ccctccacga | ctgaaaaagg | cactggagaa | gaaatccatg | gtgtacgtag | 71880 |
| taggttctaa | ggctccagtt | ctgataaaaa | accctccccg | taatgtgcgg | tttattaccc | 71940 |
| acttgggttc | caaaattcgg | gacttctgta | atgaagttga | ggtagtctgc | ataggaggga | 72000 |
| aagctctgct | agaaacccta | gcaactatgg | gctgtctgga | tgcgatttat | cgctccacca | 72060 |
| tttatcctaa | ggccggtaca | gtaccaagcc | tagaccacat | catgtatctg | gaacacccga | 72120 |
| tacttacgtc | cactcctccg | gatgctgtag | taactcatat | agcttctggg | gaaaatgagc | 72180 |
| gctatcgttt | tgttatggaa | ggagtctatc | tgtgattcac | tatattaatg | aaggcaaacg | 72240 |
| cattcttgaa | gaaggtgtat | ggctggagaa | ccctcgaacg | ggggttcgtt | gtttaaccgt | 72300 |
| aatagggtca | aactttgaat | atgatgtact | cggaaagaaa | ttcccactta | tcacaactcg | 72360 |
| taaagcgtat | gctcttcagg | ccatcatgga | gcttatcgga | tatctgcgag | gatatgattc | 72420 |
| cgcagagcaa | ttccgtgcta | tcggctgcaa | tacgtggaac | gctaacgcca | acgaaaacga | 72480 |
| ggcgtggttg | gtcaacccta | acagaaaggg | aaccgacgat | atgggtagag | tctatggagt | 72540 |
| acagggcaga | acgtggcttc | gaccggatgg | ttcccacttt | gaccaactct | ataagatcta | 72600 |
| tgagaattta | cgacgaggca | ttgatgaccg | cggagagatt | ctcaccttct | ggaaccctgg | 72660 |
| cgaatttgat | caaggatgct | tacgaccgtg | catgcatacc | caccagttct | cgctgctcaa | 72720 |
| tggaaatctg | tatctcgact | ccttccagag | atccaatgac | ttcctattgg | gacaagcctt | 72780 |
| taacatggtc | caatgctaca | cgtttcttgc | gcttatggcc | cagatcacag | ggaaccgggc | 72840 |

FIG. 15NN sequence.txt

| | | | | | | |
|---|---|---|---|---|---|---|
| aatcagagca | aaccaacgta | tagtaaatat | gcacatctac | gagaatcagt | acaaggttct | 72900 |
| catggaacat | gggcaatttg | accgcaaacc | tttcccggct | cctcgtctag | agatcaaccc | 72960 |
| ggagataaaa | accctagagg | acgtactcac | ctgggtttct | aaggacgact | ttaaaatcgt | 73020 |
| ggggtataag | tctcatgacc | ctattgcata | tccgttcact | gcgtgaggac | ttatgggatt | 73080 |
| atttaacaga | cgccccaaaa | taaccttctc | cgaaagggag | gagtctcagc | tgaagtttct | 73140 |
| ggttcaatcc | tcgggattac | acatagatgt | tatcctaggg | atggtaaagt | acaagggcat | 73200 |
| ggacgcacta | atgcgtcagt | ttgcccctaa | accacctaaa | gaaaaccctc | cagccaagcg | 73260 |
| ggactataac | agtaatttac | tggttcctcc | agctaaatta | ctataactaa | ggtggccttc | 73320 |
| gggccactta | tattaaaaat | tcatttgcaa | accacgtgaa | tttctaatat | aatagattca | 73380 |
| taaatttgag | agaggaaata | aatatgtctt | ttactgatgc | aaaagcaatg | gcagctaaag | 73440 |
| ccaaaaggtc | taacgatatg | gcagttatag | cagctcgcag | atctattata | tcaaatattg | 73500 |
| atggatcagc | ttcttcaggt | aaaacagaag | tagattctta | cgcattgaat | ggcctgccta | 73560 |
| tcgccgcacg | gtctcagatt | atggaagacc | taaggacgc | gggctatgaa | gtaaaagtaa | 73620 |
| atcatccgtt | tgaccaacgc | gatactgaat | caattaccat | ttcctggggg | cacgcataat | 73680 |
| gtttcatgtt | tatactgatg | gtggttgccg | cggtaatacc | cgtggggtag | acaacgttgg | 73740 |
| tgcttgggct | atggtagttt | acaactccag | cgaagagcaa | atcggcacca | agtctgctcc | 73800 |
| caaacgcaac | acaactaaca | acgagatgga | gcttcaagca | gtcctagagg | ctctgctatg | 73860 |
| gtctaacaaa | aaccctggcc | gaccaatgac | aatctatctg | gactcaacct | acgttaagaa | 73920 |
| tggttgtgag | tcctgggttt | ggggctggga | acgtaaaggc | tggaagaagg | cagatggtga | 73980 |
| tacacctctg | aacttagacc | agtggaagtg | gattatcgac | gaactcaaga | agtatcgtct | 74040 |
| aaaccacaat | gagatcccaa | ctttcgttaa | ggttaagggc | cactctggtg | tagaaggtaa | 74100 |
| tgaggccgca | gataacctgc | taaatgttcg | aatgaccgaa | ctggaaatgg | aggatatgtg | 74160 |
| atgttggaga | atttacgccg | cctagttagt | gaaatgaaat | atgaagtgct | cctgatggag | 74220 |
| cctggtgtgg | atcgagtagt | aatgaaattg | cgaatcgcac | gtatggaagc | ccaaatcttt | 74280 |
| gaagcggagt | ggaaagctct | gaggggtgga | gatgaattat | aatggcacca | gatttgaggg | 74340 |
| atttgttccc | aaacgtacca | cagtaccagc | tcgatctcta | cgccgcgttt | ctggaagcgt | 74400 |
| caaatcggg | gaaccctcta | cgcgtctacc | gccaagaccg | caggcacggg | aaatcctgga | 74460 |
| tcctgagatg | gctgaaagag | aacgagccgc | tcttaaagaa | attgagcgaa | agaaactctg | 74520 |
| tacagcaccg | gcatacaaca | aaggtgggta | ccagtacatc | agctcagaag | agcaggcaaa | 74580 |
| acatatcggg | cggtaacaga | tacgagttca | tcatcttcga | tgatcttgta | gatgaaaatg | 74640 |
| aaaaaacgca | gttgctaaac | gctaaaaatt | aacgtataat | agattcataa | attaacgaaa | 74700 |

FIG. 1500

```
                                    sequence.txt
ccaatcaaaa caaaggaaat aaatcatggc taagcagacc tctaaaaaag cagtagaaac    74760
caaagttgca acttttccca aaactgaagc gaatcgcaaa gcacgtctgg agcgtcatct    74820
gcgtaaacat ccggctgata ctcaagcagc atcagctgta ggcaaaccgg ccccgcgtcg    74880
taagaaaccg gtaactaagg gttctacctc cggctacgtc tccaagatcg tcggttggag    74940
tacgccggat aaggcagaca ccaaagaagt cctgcgcaag acccagggcc gtttcggtag    75000
cgtcaagccg aatatcttcg gttgcgaata cagccgtgag aatgttcgcg ctctgtgcta    75060
cggcgtaggt attaaattta cgggcaaggc aaataagccc cgtaatcaaa aacgcaaacc    75120
agctaagaag gcataatgcg aaattttgta gctaaaaacg atttcaatcg tgcagcgaca    75180
cataagtcgg ccctagatta ttctagggtc aactcccggg aactgatgga ttcgtgctac    75240
gaagaactcg aagattgggc ggctgactgg ccgtcgatgg aagaaaactg ggatgtgtcc    75300
gaagatatga ctaagccacc accggaggtg gcttctaaat gtgataacac atctagaagc    75360
aactttaata acaaaggaaa caatatgcaa aacttacaag accgctggat ctctgtttgt    75420
gatatcgaat ccctgggaac tccgggagat tgcaagagca cctttatcgc tatgccgttt    75480
ttcgctttcg tactgatgaa agatctatcg ttagatccgt atatcgttct aggcactcct    75540
aacgttgccc agcagttggc cctcggtgct aaagtctccg ccggaactat tgcattctgg    75600
atgaatgagg ctcgtgctgg tagtgctccg tcgctgtcca ttattgaagc tctgaacgct    75660
aaagacggtg agtctactgt tctggtctgc aatccgactc atgaatcacc ggtatccaag    75720
catacgttca tggatctgat ctgcccgttc gtagaggcaa aacaggtaat cgaaggcatt    75780
atcgatgagc aaggtatcga cactcgttcc ctgcgccact acggtaatgg cccgcagttc    75840
gatatgtcta tttacgaaac agtggcggct caggctaatg tcttctctcc gtctgatcct    75900
gcaatcgttc cgtggaaatt ctgggatatc tccagcgccc gtaacccgcg tgactatttc    75960
gaggctctcg gaggagactg gaaagcattg gtacgttgtg ctgaaatcta cgcacacgac    76020
gtaatcgagc gttacaacct gattcctgag gggtctatc cgtcgaaaca tgatccggtg    76080
tttgacgccc tggtagaagc gtactgtatt aaaactatcg aatcgaaatt gaaaatttga    76140
tttgactaaa tggctgattt cttgatatac tattattctt gaatcaaaga gtaaaggaga    76200
aataatgaaa gcagccattc taatgatctc catcctcact agcttccatg cgcaggcaaa    76260
gattgatgcg catgagatag agtgcatagc taaaaatgcg tactttgaag ctagagggga    76320
aggagttaaa ggaatgaccg cagttgcaca agtaacgaaa aatcgtgtta actatggaaa    76380
attcccgtcc acatattgta aagtagtcta tcaaccaggg cagttcagct gggttggtaa    76440
gaagaaacat aaactcgatc gtaaagacga agagtggaaa caagctaaag agatagctag    76500
actagtttac tatatggatc ttccagtaga tccgacgaag ggagctttgt actttcacag    76560
taaagatact aaaccttact ggacaaaaga caaggacttc aaaagaacaa gtaaaattgg    76620
```

FIG. 15PP sequence.txt

| | | | | | |
|---|---|---|---|---|---|
| caaccatgtg | ttctataaat | taaaatctca | gttgcctaat | gcttaaaaag | ttgatataat | 76680 |
| agtttcataa | attagagaga | acagcgggcc | gattacgctg | aacttgtttt | aatgtaagac | 76740 |
| tcgtcgagca | ttaagattcg | ttgaatagaa | tcggtgagtt | aagagtgatc | acctgacaaa | 76800 |
| gttcgtgcat | ccagtccgga | taccggccag | ggagcgtatt | ggacgggcgt | aggttagaga | 76860 |
| tctcttgtaa | aactcgggag | ctgtcccgga | gtctcgtaaa | ctcttctcct | gatttataga | 76920 |
| aaatggtgga | atctcacttt | aacctgttcg | accagaatga | agcatggtgc | gtggcctgcc | 76980 |
| ggagaggtgg | ggagctgagc | ctgagaaact | cgtatagctc | ccacactgac | ctgcctaggc | 77040 |
| cgcaaattgg | agacatgtgt | atagcgtctg | gtgctagtta | ttgccaccat | agtggggtgt | 77100 |
| cgaaatcact | tatgtagcaa | cactgccgtc | ctaagttaat | tggtagactt | ctgcacgcgg | 77160 |
| gggagctatc | cccagatgcg | gaaagtgcag | gttcgaatcc | tgcggtcgga | aagagttaga | 77220 |
| taactgatgg | ttctattggc | gaaccactcg | ctgctggagt | acctcctccc | ctcccaggga | 77280 |
| aagacttggg | agactcgcgg | gaacgaaaca | gctaaaccac | gaaggactag | gatgctgatt | 77340 |
| tggctaccct | tacctgatat | atgcccaaat | caaaagaaga | actttaggcg | gtagcctaga | 77400 |
| tagtgaagtt | tttcctccac | gaggagtcgt | ttttcaagct | atcaaaactt | cacatcgaaa | 77460 |
| attcggaggt | gtgattttaa | cagaccgcgt | ggaggatggc | tctccagaag | tgccaaagtt | 77520 |
| agtccttaaa | tacggcatga | tgatcgtatg | aactttggcg | aggtgggatc | tcgcctgatt | 77580 |
| ctaagtggga | aagagtattc | ggatagccgt | tcgtacaaac | ggtggctccg | agacctaagt | 77640 |
| gggacacggt | tgagtataca | gctccgcgga | agctcgtata | ccctgtgtaa | gcatgtgaca | 77700 |
| atggagtcat | gaccggagtc | accccgagcg | aaagcataac | cactatttat | agcaccctta | 77760 |
| cacaggctag | aagtgcccct | gtttggagtg | tgccctcgcc | tagaccgcat | tagccgacgg | 77820 |
| atatccgttg | gccgggatct | ggcaaggtat | attagtcacc | ttgactataa | ctggaagata | 77880 |
| cgtctgacag | aagggccgca | tagcttaaac | aggggaaggc | ccctacctac | tggcggtatc | 77940 |
| tttaagagct | ttcacgagag | ttcttaaaga | tactaattga | cgaggtctat | atgaacgatt | 78000 |
| taagtatgtt | aactaagata | cgctctgata | ttgagtctat | ggtctctcgt | cgtagtgagc | 78060 |
| tgactaaggc | taaacagatc | atcagcggtg | gtacacagaa | acgcttcaca | ttgcaagccg | 78120 |
| gggatattaa | gtttgaccta | tgtggcagcc | agactcgaga | ttacactttc | gaaatgaaac | 78180 |
| cgtgttacga | tatggtgaag | ctggggctta | tcaaagctct | agacaaacaa | atagatcagt | 78240 |
| gtacggacgc | aatcaaaacc | ctaaacgtcc | agttcgccgc | tgaatgcgat | cgtctcaaaa | 78300 |
| actctatcaa | ggtataataa | tggtggcatc | tgtgcatact | cctccgtatg | aacgtccagc | 78360 |
| acctaatctg | acacctgaac | agaaacagct | aatcgccagg | cgcactctag | agtttaaaga | 78420 |
| gtcgctgcat | aagagcgttg | gccggtattc | tgaacaggtt | catgatctgg | ttgtcaaaac | 78480 |

FIG. 15QQ sequence.txt

| | | | | | |
|---|---|---|---|---|---|
| acttaaactt | tattaatgct | tccttagctc | agaggataga | gcaacggtct | tctaaaccgt | 78540 |
| gggtcacagg | ttcgaatcct | gtagggagta | ccactttaat | cgctgcccac | acgtaatatt | 78600 |
| cagtgggcag | cggcagaaag | cccgcagggc | gcagattaag | attgattcta | caaaattttt | 78660 |
| cttgcaattt | tgtcagaaat | tttgtataat | agttctttaa | atcaaagaga | aagtagagga | 78720 |
| taaaatggct | tacaaaattg | aatatttaaa | gaaaggggtt | ctcactgagc | tggttatcga | 78780 |
| tgcgaacatg | gctcgcaacg | agggcactaa | atccgtattc | tataaagacg | gtagcgtagc | 78840 |
| tcgtatgatc | aataccgaag | acattcagga | tctgtacgtg | atctccgacg | aagaagcagg | 78900 |
| tttcgtaaaa | gatcctgagc | cggctgaaga | tactccaact | gaagacactc | cggtagcgga | 78960 |
| taccactact | gaagaacctc | cggtggaagg | cactccggaa | gatgaagcag | cagtataaat | 79020 |
| aactaagggc | tagaaatagc | ccttctcctt | gggccggtag | cttaaagtta | aagcagtggc | 79080 |
| ctcataagcc | aacgagtggg | agttagagtc | tcccctggcc | caccaatttc | ataacaggag | 79140 |
| actaaaatgt | ctactaaaaa | cgcaatcgta | tccttcgtgg | atgacagtgg | tatcgtccta | 79200 |
| gagtccacag | taacagatat | cagtcctaaa | cgtctgctcc | atcgtgatgg | ggatatcctg | 79260 |
| gaaatcctta | ataaacggtc | tgagactatg | ctggtcattc | ctgtaaatcg | tcttctctcg | 79320 |
| attaaaatcg | tgtgggagga | ctaatggacg | ctcaattaca | aacccagtac | tatatgcttt | 79380 |
| taggcatgtt | agaggatgct | ggcccgacag | tcagagggca | ctatgagcgt | cacaaagcag | 79440 |
| cttttgaagc | cctactaaaa | gaagttaatg | agaacgaagg | tggtaaaggc | tctgactcct | 79500 |
| atgccgcatt | cattatcgcg | ctacaagttt | tcctaatcaa | tcaactcaag | taataggcta | 79560 |
| aatatgctga | atattaaacg | taaaggtttt | ttctacaagt | ggcttaattt | ctcttccgcg | 79620 |
| tctttcacct | accggctgaa | cgacaacaga | gtcaccttgt | gtagcctatt | ttggcactca | 79680 |
| gtgtggtatt | tcctgctaca | gattggcgta | actgctattg | ctgtactctt | ctccttgggg | 79740 |
| atgggaagta | tcttatctac | gttcttgggt | ctcacctttg | agctgggaat | tactccctgg | 79800 |
| tacatgcttg | tagggttaag | tctagcagga | ctatctacga | taatagcgat | tctgctggcg | 79860 |
| atagctggga | tcggctgggc | ctgcgctaag | atagggatc | ggatccagga | atggaacgcg | 79920 |
| agtaaatcct | ttgaaagggc | acagaaagag | tataatgctc | gcgatgaaga | gctccgcttc | 79980 |
| ggtaatatct | accagaagat | gcgaatctat | aagaaggaca | aactttgtcc | gctcattcgt | 80040 |
| gtagaccacg | gcgagtagtt | tgcatagtga | cctgcgttgc | cgggtcacta | ccaaaatact | 80100 |
| tgaaaaattc | aattgctaaa | tgctctagaa | tttgagataa | tatttatatt | gaaagggaat | 80160 |
| agccaagtgg | ttacggcatc | ggcctttgac | tccgagatcg | gtaggttcaa | ctcctccttc | 80220 |
| ccttgccaaa | tttaaaatgc | tcctgtcgtc | taagctggtt | aggacaccac | tctttcacag | 80280 |
| tgggaacacg | ggttcgaacc | ccgttgggag | taccaaattt | actgaaaaat | tcagttgcta | 80340 |
| aatgcttaac | aaattgatat | aatatttata | tagtttgtta | aggaattaat | ctgatactga | 80400 |

FIG. 15RR sequence.txt

| | | | | | |
|---|---|---|---|---|---|
| gccggaacca | aaaaacacgc | ttgcagcttg | ctcggtcatt | gtactgaggg | ttcgcaagaa | 80460 |
| tagcggagtg | gctctccgaa | acgcctggta | agcgtagagt | gtatcgtatt | tgtgaagagc | 80520 |
| gggtatcctc | gcatggctaa | ttgcttaggg | tattacgcgc | accggattaa | ttgccttaac | 80580 |
| aaattattgg | gggatgggtc | tgctgggagt | ggacaccgca | cttgcaatgc | gggaatcaga | 80640 |
| acggttcaaa | tccgttatcc | tccaccaaac | aaatggggat | gtggcgaaat | tggcagccgc | 80700 |
| gctagattta | ggttctagtg | gtgaaatatc | cgtgtgggtt | cgaccccctc | catccctacc | 80760 |
| aaataacggg | agttcgtgat | gaacatagaa | atcatgcagt | tggatcgtaa | gaaaaatgag | 80820 |
| ttccgtaagg | tccatacctt | tccgagtaaa | gaagctctag | agtttcatat | taagtgtatg | 80880 |
| ggactggtgc | taccggaaag | cgagatcttc | gacttagcat | gtgctaacgg | agttctgtac | 80940 |
| gtctgggaaa | tcacgtatca | tgctgatcct | gatgaactcc | gtaaagaagt | agagcaaata | 81000 |
| ctaactggag | agtagtgctc | atgggagcaa | gctgacttga | aatcagtcgc | catcggaaac | 81060 |
| ggtgagggtt | cgattccttt | attctccgcc | aaacaacagg | aaagctggtg | aaatggtagc | 81120 |
| cacgcatcac | tgctaatgat | gagtccgcaa | gggcatgaag | gttcaagtcc | ttcgctttcc | 81180 |
| gccaaacaat | ggcccgacga | gtaacggttg | cccctttcta | gagaattttc | tgggcgaaaa | 81240 |
| tccagaagta | atcaactagt | tgtaagtggg | aagagtttct | tagggccgcc | aaatttgagt | 81300 |
| atcattggta | ttgtaggagt | cgtacgctgg | gactacgtag | tacactgagt | gtcctatgcc | 81360 |
| cagtacgcgg | tctaaccaaa | tacggtgtgc | gatgtgcatt | ttatttgtgg | aggtctgatc | 81420 |
| agccctcgat | ggtactcaaa | tttgggatat | tatcataact | ggataatgac | ctcgattgtg | 81480 |
| gatcgagtct | atcttggttc | gaatccaaga | tatccctcca | gattactgca | ccattagttt | 81540 |
| aatggataga | atatagagct | acgaactcta | tggttgaggt | tcgattcctc | gatggtgtac | 81600 |
| cataaaatct | ctgctgagag | tgacgaggtt | agccctctgg | gtcacatccc | tcttctagcc | 81660 |
| gcctcccata | aatgcaagca | tttatgttct | ggccctagac | acaacgttgt | actcagcaga | 81720 |
| gtgcgcataa | ttggggtata | gctcagtagg | tagagcggag | gtctctgaag | ccttaggtca | 81780 |
| caagttcgat | tcttgttgcc | cctgccaatt | gcaccgtaga | ggagaggccg | tcctcgccag | 81840 |
| tctcataagc | tggagatcgc | aagttcgaat | cttgccggag | catccaattc | taggagaaga | 81900 |
| tgatgagaat | ctctttcaca | gaacgagtac | taggtactgg | agtaatgcta | atcacttcct | 81960 |
| gggatggaga | tagctggtgt | aacgtgacag | gcttacgtaa | gtcagaacaa | acacccgaga | 82020 |
| atatcgctaa | aatcaagaaa | cgaatggcag | aagctgctag | tcgtcctgga | gcacctcgta | 82080 |
| atggtaaacg | ttgaggtaac | tatgactcgc | tatcaaggta | tgctaattaa | tacccacaca | 82140 |
| aaagagattg | tattcttggc | accggctttt | cacgacacct | acaatgaagc | cgaggaagac | 82200 |
| gctaggatcg | ctaaaataca | cccggacgag | gaaatctgcg | tccgtcagca | agaacaataa | 82260 |

FIG. 15SS sequence.txt

| | | | | | | |
|---|---|---|---|---|---|---|
| tgcttcaata | gctcagttgg | tagagcaaac | gaccgataat | cgttaggtca | ctggttcgag | 82320 |
| tccagttcgg | agtaccaatt | tttgcccct | ataggatatt | tcatcggaat | atcctccagc | 82380 |
| gatggtacgt | agtatagtac | ttacctgtta | agcctagaca | aagttacttt | gtgggcaaaa | 82440 |
| taggtataga | taggagaaga | atagtagcgt | aagattcttg | aggcaaattc | tttaggtcag | 82500 |
| ttggcagaga | tggtttatgc | actcgcttca | tacgtgagac | tacagtggtt | cgagtccact | 82560 |
| attgaccacc | aaatacttgc | ttagctcaat | cgggagagca | tcgtctttac | acggcgaggg | 82620 |
| tagctggttc | gaaaccagca | gcaagtacca | atttacagtg | agacttcggt | cagggccgtc | 82680 |
| aaacgtccga | gaagctgtaa | tttctgatgg | ggatgatccc | agattcgtaa | gaatacccca | 82740 |
| tccttacctt | cacaggtttt | agcgcaatgc | tgagtaaaag | tctagggaat | cgactccatg | 82800 |
| ccatccagga | gtataaatgg | cgaatctagg | gacttagacg | gtcattgccc | tagcgcgttg | 82860 |
| atgccgtgcc | ggaatcggta | tacggggctt | cctaagggc | gtaagcagaa | catccactct | 82920 |
| gcataagata | cccgaaaacg | aggctgagat | aaatggtcta | tcttgtgaag | gttcgatccc | 82980 |
| ttccggggtt | agcgtgtagt | ggggctaatc | aatccccacg | ttaaacgttc | aagttaagat | 83040 |
| ttgttagttg | cagaagcggg | gaggctatca | accttcagtc | cctgaaagct | ctcagcgctt | 83100 |
| ggaactcttt | cgtccgtaag | gaatagatcc | cctttcgctt | tgactcgcaa | acttcaaacc | 83160 |
| aagtgtaact | aacagctgca | agcctggatt | accgctctcc | ggagcggata | attcaaaaat | 83220 |
| ttatttgcta | aacgctctta | tttactgtat | aatagttaca | taaattaatg | agaggagtta | 83280 |
| gcaaatggaa | aagattactg | caactggtat | tgaatctgca | ctggtggttg | attgggccgg | 83340 |
| atgggacgga | gatcacgaat | ggatggtctt | ttatagctgt | acgcttcagc | cagaactatg | 83400 |
| gactaggctt | accgatgagc | atgctatgcc | ctacggtatc | atagatgtag | aaattgagat | 83460 |
| taacaaactg | gttggcacca | ttatggtgca | tcgagccgaa | ggcgatcaca | aggaaatctt | 83520 |
| ccgtaaaagc | attaaactgg | tagtttctac | cggtgacttt | atttaacaat | taactgagga | 83580 |
| aatactatgt | acacgtcc | tactaatgga | aattctgctg | tagtccgcct | gatgattgtt | 83640 |
| caggacaacc | tgtccaacaa | catcgagtct | ctagaccgtc | gtattgagga | gtatcgcact | 83700 |
| gagatgctgt | ctctgatgcg | cgaacgtgag | gccaagatcg | aagagcagct | agaggtttgc | 83760 |
| gaagctatcg | accgcctggt | tgacggaacc | gcagtattta | tggcggaagc | tcccgcagag | 83820 |
| cctaccttca | ccccggtagc | accagctgac | atgcagtatg | ctattctgcc | tttccatctg | 83880 |
| gaagaagaag | atggcgaagg | cccgtcgctg | gaagacgttg | ttcgcttcct | gcttgcctcc | 83940 |
| ggtttcccga | acggaggtcg | ttaatggatt | ttatcgttgt | ttgcggagcg | aatactgact | 84000 |
| gcttcgagct | gttaaacgac | gccctagaca | aggttgatga | acacatgcag | gaaggcagaa | 84060 |
| ctcctacatt | cattgacctg | tctcaaggta | aaacttactt | ctacccgtct | cttgacgtag | 84120 |
| agcctacagt | tctacctatc | ttcatgcact | ccctctcgtg | ggacgaagaa | gacgattaat | 84180 |

FIG. 15TT sequence.txt

| | | | | | |
|---|---|---|---|---|---|
| gaaaaaattc | atttgcctag | tactctgaaa | tttagtataa | tatttatatt | gaaacgaaag | 84240 |
| aggaaaagca | aatggaagat | gaagttaaat | tgtacatttg | ttcagattgc | ggtgagttaa | 84300 |
| gtgaatgtca | ttgggagtgt | ccgacttgtg | agtcagacga | cttaatggaa | tacgaaccgg | 84360 |
| aataacaaat | taagcggcta | tggtgttcag | cggtcaacat | accggcctgt | cacgtcggag | 84420 |
| ccacgggttc | gaatcccgtt | agccgcgcca | aattctctct | gggctaagag | atatgaccgt | 84480 |
| ctagaggtat | cctcggacac | aagggtcagc | cctagacaca | ataagttagc | aaatatctcg | 84540 |
| tttcgacgag | gtatttgaag | aggttcttac | gagagcttct | tcaaatacgg | gggaatattc | 84600 |
| tgtaagtggt | agcagagcgg | tctgtaaaat | cgttgccatt | gcggctcggg | tggttcgact | 84660 |
| ccatcttccc | ccaccaattt | tgacaatcaa | agagatccgg | gttcgaatcc | cgcgtacgca | 84720 |
| acaggcggca | taaaggcctt | gtagcttaaa | tggacaaaag | cgctttggtt | gttaaatcta | 84780 |
| tttgggagag | aagcagtaag | tggtataggc | ggtcgcctgt | taagcgaatg | acagtgagtt | 84840 |
| cgaatctcac | ctctcccgcc | aattttactg | aaaaggttat | ttaattaacc | taggcacgcg | 84900 |
| taggaatact | gccaccgcaa | ttgaaagatg | tggcccggtt | tggagaggta | tgccgctaca | 84960 |
| cgctacggtg | ctaactccgt | ctaggtgaaa | atcctagtca | gtaatacagt | attagggtaa | 85020 |
| gaacagcgac | ttaggttgca | gtgaagcgtt | agcaatcggg | ggaactccgg | tgcgccctaa | 85080 |
| ttaaacaatg | catcattggc | cgagtgacta | ggcagaggct | tgcaaaccct | cgaagcatgg | 85140 |
| ttaaaatcca | tgatggtgct | ccaattacca | gaggtactca | tgattaagta | taaggcgttt | 85200 |
| gtaacaagag | agtcccaaac | aggagattca | agtattaaat | tcgaaggtac | aacgttacat | 85260 |
| gatacatttg | aagccgcttt | aacagaggcg | gaaacccata | tagtatcgaa | aagctgctat | 85320 |
| gctcatgtat | gggaagtaaa | cactatttta | gatcgctagc | tcaatggtta | gagcactcgc | 85380 |
| cttttaagcg | ataggttccg | ggttcgagtc | ccgggcggtc | taccacatta | tgggacttca | 85440 |
| gctaatcggc | taagcatcat | agatagcggg | gaatcccggt | ctgtgagggg | agtaacacgt | 85500 |
| agtctcccaa | gttccaccaa | acatcagagc | agcgtgatgt | actgcaaaga | cccaaagacc | 85560 |
| ggggtggact | tcttgattca | aaggagcagg | cacgaattac | gcaactgtag | ctcagcgagg | 85620 |
| tgagagcact | ggtttgaaag | tccaggggtc | gttcgttcaa | atcgaaccgg | ttgcaccaaa | 85680 |
| ttaatagtat | caatagctta | tggagctgaa | tagtcctaaa | gctcacggta | aagcagctgg | 85740 |
| ccgttagtga | gcagacttgg | aaacgtctgg | tgatctctag | gttagccggt | gcgttggttc | 85800 |
| gaatccaact | gatacttcca | aatcccaagt | agcccgttac | aggctctctg | attaaactca | 85860 |
| gacaagcagg | taatgggtga | caggataaaa | taagccactg | atttccggcc | gtttgacgtg | 85920 |
| gtaaagtcct | ccagtcaaga | agaatttctg | cgtgcagaaa | tcactgaaag | caatggggca | 85980 |
| gacaacttga | gatagattgc | ctataacgtc | tcaagtagtg | gcattgactt | agggtggcat | 86040 |

FIG. 15UU sequence.txt

```
tttcccgaaa gttcgaaaaa ttcatttgct aaacgctctt atttataata taatatttat     86100
ataaattaat gagagggctt acctaatgaa tcaaaaaatt cttatgcgat ataatccacg     86160
agctttatgg ttccgctggg aagtgattgt atcgtaccag atacgagtgc gtaacggtga     86220
tcctgagaac aacattatcg tgctggagac attctctaat agagatgcgg cagttaagtt     86280
cctgaacacc atcgacaata ctttaatcaa ggtatattaa taatggatat ctttactact     86340
cctgctatca acttggtcgg tgtcggccta ttccaggcaa cggtctatcg tattgatgat     86400
agcactgacg ttgtaacgtt cattgtaccg gagttcttcc ttgagaagtt ctttgaagag     86460
tttgagcaat ccgtgaaga gcatgatgct tactccaata tggaagatct agcagcgatg      86520
ttcccaactg tatacggcta catctttgaa ggcaatgatc tgcttttgga taagtcagag     86580
ctggtggaac tcaactgggg cattagcttt gaagtgggct ctccgttccc gcggtatttc     86640
caaggtctgg agattcgata atgggcggct actctaattt catcgagaat tacattaatt     86700
ccgtagattc ctggaatcag gaaactctag tggtagtgct taaagagaga ttcaatatct     86760
ctactctgga agccctagag gctatagaag cctacttgga taacgattaa cacccacttg     86820
gtccaatctg gtagaggcat gaggcttaag acttcagggt tcccggttcg agtccgggag     86880
tgggtaccaa attatggggc acgactgatg gggaagtcgg cctggctagg gttgagatac     86940
ggttcgattc cgtaggcaaa tggtctcgta attccgcaca ggtgatgaa ggttcgagtc       87000
cttctcccat aactatacaa attcccctta gctcagtctg gcagagcggg cgctttggga     87060
gcgtcaggtc aagtgttcaa atcacttagg ggagaccaat cttgcctcaa tagctcagcc     87120
gggagagcaa ccgccttgta agcggtaggt cgtgggttcg attcctactt ggggcaccat     87180
tttcgctggt tatggttaca gtgtgattaa gtttacattg tcattaaatt ccggttcaat     87240
tccggaagcc agcaacccta aaaggtaagc atatgaggat tctttccata gaagatgtta     87300
tgtgtgacag atgctacggc tccatattct ctggtggctg tagttgtaag taatctatct     87360
aatgaccttc tgtagatgta aaataaatat gaagggtcga tgctcgcggc taccgacaga     87420
tcgtaatgat caagtagtag tctgaggtga agagactagc ccattaattc cgcgactaac     87480
tgtacgggtt acagcgtccg ccttccaagc ggtactgagt ggggttcgat tcccctagt      87540
cgctccaaat tcggtaaaat gaccgtcccc tgacgttacg gggaattaaa caaggaactg     87600
ggagccggta aggccatttt atcgatacta cttgagaggt acaacaatga aagcctttga     87660
tgcagaacta gtgttctcac tcttagctga gatggaagcc tgcgtagatc gtgtacgtgc     87720
gctgcgtctt agtatgttta gctcttaaat tatttgctgt tctagagcca atgtagtccg     87780
gggtgccgac gtctgcctgg aactcgactc taggatagtc aggacgtcac ttaacagcca     87840
gagatggcaa actataggag aagcaaatgt taacagttaa ggtaatgtca cctaacggtg     87900
gcgaagaaat tcacgatggt tcaagcgttg ggtttaatcc taagcagaag agcatctcta    87960
```

FIG. 15VV sequence.txt

| | | | | | |
|---|---|---|---|---|---|
| ttgctggtct | tgatcagcat | atcttcctga | aagaagatga | ggtagcctac | gttatgaatc | 88020 |
| agaatggtaa | gacagtatcc | gtctaccacg | gtagctaatt | ttattccccg | agtgttactg | 88080 |
| gacagcacgc | cggtctccaa | aaccgtgcag | taggagttcg | agtctcctgg | ggtttgccag | 88140 |
| tttaaaggag | tgatcatgat | cacttatagc | accaatttta | tggggccagt | ctccaacaat | 88200 |
| tggtacatcc | gtatgggtat | tccgtatacg | gaagtaaccg | agccgaatcg | ttttgcagat | 88260 |
| ggcgggcaac | taactcgaaa | agtatttgcc | aaacgatatg | ccggtggtcg | cattgacgtt | 88320 |
| cgtggtactg | atgactattt | cggccaggaa | atcggtgttc | cgattatgga | ggccgagtct | 88380 |
| tggaatgaac | tacagcagtt | tctctggaca | ttctcgtccg | ataaggttct | gacattggag | 88440 |
| caaattgtac | aggctctaga | ggacgagaca | ggttttcgca | ttgtttggtt | taaggagcca | 88500 |
| gcatgtacat | agatcgtaac | caactgttca | agttcctaga | gcttgacctt | cgttggcctc | 88560 |
| tatcagtcaa | tccgggacga | gctactggca | agacgttcga | ggctattaat | acagcctatg | 88620 |
| agtttgcagt | atttaaaggt | attcaagcag | tatacgtagc | atccggtgtc | cgtgaaatgg | 88680 |
| cacgcctaga | gaagaagtat | aacgagcttc | aacctcatgt | taaaattaca | acgtatagca | 88740 |
| tgttagaacc | ctaccgtata | ggtcgtcgat | tcagctgcat | catgtttgac | gaacctagct | 88800 |
| tggctattaa | gtacggcgta | aacgcttacg | tggttcgtat | agccagagaa | aaccagtgtc | 88860 |
| ctgtaattat | ttttggagag | taaagtggaa | caagaatttc | aagtcttcgt | agacgcctct | 88920 |
| aagagagttt | tattcataca | agccaccgat | gaaggtcatg | gcctgcaact | ttccttcgac | 88980 |
| tctctggagc | aaataaacca | gattgttctg | agggcacaaa | aatcattaga | aaagaacact | 89040 |
| gaggcacctc | ctgacctcta | aacaaaagcc | ccttgtctct | ttgagcgagg | ggcttttttct | 89100 |
| ttataaattc | acttgcaaaa | atgccaattt | tgccgtataa | tagatttata | aattgatgag | 89160 |
| agagatttcc | aagatgaaag | taacaatgga | aaacacagaa | gagtttattg | ctatctgtac | 89220 |
| tgcgtatgca | gatacgcttc | cacctgaggg | tatggacgac | catacaatgc | agttagtggc | 89280 |
| ggatatctac | agattagcag | agttagctaa | agaacaacac | aacaggctgg | tgtacgtcaa | 89340 |
| agaacgcctc | gaaatgatgg | ataaggagta | atcaatgaac | gaactcaatg | aactgaatga | 89400 |
| attgcattac | gctgaacgtg | ctattgacga | gctggatttc | gctggtggtt | attatacccg | 89460 |
| acacgtcaac | gcaatgaccg | ccgaagggct | taatagtaag | tctgcgattg | ctgcggagtt | 89520 |
| agcagttcgg | gactttgtta | ttgatagtct | ccagaagact | attagcaact | tgagcgaaaa | 89580 |
| caacaaagct | gctctggaag | ccctggataa | gctgtccaac | catcttctcg | cattggggat | 89640 |
| caaataatga | ataagcaatc | tctacgtggt | atccgagtat | ttcgctctag | ccttgttgat | 89700 |
| tccttctata | tctggggcaa | ggcaactcga | cgcactgttg | agcaagcact | agacggtacg | 89760 |
| ttctatgatt | ggcgagaaaa | agagcgaaac | cccgtattca | gccgcccagg | gctgtatcac | 89820 |

FIG. 15WW sequence.txt

```
gatcgtgtat ctaagacagc gtggtacgaa attgaagtaa ctcctggcgt tatcagagcg    89880
ttctatacgg attgggagca cgaaaagtgg gtttgggaca atcagattgc tcccggtgat    89940
cgtattatga actatgccga atataaagaa atgaagcgca tgttcgagct atacgatgtt    90000
cctaggctgt ctcgcccggc tatcttcatt gctagccaag agtactggca tactgttcgt    90060
atgaagcgtg attttaacaa gcatcacctg cgctatgaga aagaacacgg cacactgcgg    90120
gaacgtgtgg ccaagagaaa agccgaactg cgtgaaaaac gcctggagaa gaaatatggt    90180
gaaagctagt ctcttacgct tcactcctgg agttggcctc cagtataaaa ttgttggggg    90240
ccacaagttc caatacttca ccccgggtaa gctctacttc gtcgagctac acgatagtag    90300
agcaggctac aaattacgaa gcgacgcaaa tgagggcatt tgggtgagct tcacacaagt    90360
taaacgctgg tttacagttg aaggatataa tgattatgag taaagttgta tatttcgtaa    90420
aatgctgccg tgacaccttta gagttggtcg accacaaaat gcagacctgt aaatgtggtg    90480
cttcctccat agatggtgta gccggagcct acgtccgttt tctaggcgac aaaagtaact    90540
tcatgcgtct gaatgagttc cagctcgaag ttgaaaagaa tcgaccggct ctagaggcag    90600
aggctgagcg tctcaaagat ttcgatggga acatcgtagc atataacatg gtaagcggta    90660
aagacttctg gtctgaactg gctgaaaaac ttaacatgcc gcggcaggcg gctaaggctt    90720
tatatcatgg cttcaactac tcgccacgtt ggaattaagt tttccaacag taacagaact    90780
tacgtttacc gagtacctag ttattggaaa tactccccgg agataggtga tgtagtagtc    90840
ataccgggga atgttatgtt taataatcct cgtcgcgcca aagtagtaga agtgcatggt    90900
atgtatggta agccagagta taaagaaaga aagaacatct cttatgtaga gctgcatgat    90960
tacttaccga aggaggaacg taatggacga taaaattgct cgggaagcaa tagaacttgt    91020
tcgtaaacga ctggaagaac gtaatgtcga ggtgccgaaa ataatgctta ttggctacgg    91080
cggcatcggc ggatttccca gcttcactga cctagaaaga atggaacgag agtcccaagc    91140
cagcttttcta gagttagaat cctacgctcg ggaaatggaa cacgaacatc cgattggtaa    91200
taactttatg ccacgtagct cccgccagga ggttactcac ggcaagacta attcctggcc    91260
cactccgaaa cgcagaggta gaaaatgatt actacaggat ttggatattc tcacgaagaa    91320
ttgtgcaaaa tggttgaaag cgctccgttt attaagaagt tagtcgaaga gcaacgaccg    91380
gtgtgtttac atgctgcctg taccaagtgt cacggtactg gtgttgataa aaacggcaag    91440
atgtgcgtac atgcactgtc ctgcccgtgt cctaaatgta gctggagctg ttaatatgga    91500
tctaggatat tgtgtagtac atgaattcat ggagcagggg ttgccggatc gtatttgcgt    91560
tgtaacctct cgtaatctgg aagcagccca atcactagtg gagcgactct ctggctacta    91620
tcgtgaccat gaacgttacc agcagaaagt atttgacctg acaaaactgt accatcaaaa    91680
agctctggat atgccaactc cacagctgga cgatctcaag cagtttagtc ctgaggcctg    91740
```

FIG. 15XX sequence.txt

```
gtatagcgtc aaagacgcca gtccggtaga ctataccgta caggtattct cgcattatgg    91800
tactcgtcac tggataaacc gtaaatggga ttccatggtt gactacctta attcggaact    91860
cgaaaagggg gctgccgaat acaaaagaaa gcgtgccgaa gccaaagtat tgaaaaattc    91920
agttgcattg taggcgattt ttcgatataa tagttacata aattgatagg gagagcttca    91980
tgagcaaact aagtattgaa agcattatcc gcccgttaat gcacgggtat gtacaaggtt    92040
cctgtgtaag cgaaactgaa gctctcaatg ttatcgaaga agagctggtg gctaacgggt    92100
ataatcttca cgaaggtgtt atcgaggatc tcttctggca gaccgcggaa gatatggaga    92160
tctttcggtg cgtgaattgc gggtggtggt gtcctgcttt tgaaagggcg gagaaccaaa    92220
tagaggaaat ctgccgggac tgcgagccag acctcgaagg tgaagtggat gaacaagata    92280
acgaaggtga agactatgag taagcgttca attgcagcaa tcatcgcatt cagtatgatg    92340
tactctggag tatctctggc cgcagagcgt aacaaagtag agatctctga taacgggcgg    92400
gttcgtgtaa caacgaatgg gattactaaa ggagctggta agtttcgtaa atctgaaacc    92460
cgttttgggg aaactaagat ctacacgaac aaaacctatg gcaagcccgc tgtgacactg    92520
gaccgctatg gtcgtcaggt agaagacgag gatgatagcg atgagtaatc ttcaccccaa    92580
acttcaagag accctagact ggattaatga agagtgtgct tttgaggaag ctccttactg    92640
tgtctgggca agagctggtg cagcccctc ggagtggtgt actgtgtttg ataatcgcta    92700
ccggataaca gttgaactaa gcctaaaaga ggacaaagta tacgctaaag cctctatgac    92760
cgcgctagga ttatccgggt tcgtggagat gcaagagctc tgtatgccta acactcacct    92820
tcgggttcag atcgagcagt tggcaacaat tcgtttgatg ttgccggaag ataacatcaa    92880
tgaccatttc cataaggtta ttgaaaatga atacaaacta cggcggcaac gtcgcaaagc    92940
acgacgggaa gtagagaaga ctcggatgat gtgtaacatg aatccacacg tataacggta    93000
gggccgttat aggagtcacc ttcctgttcc tatccggagt cgtgcccgcg atgaacgaag    93060
tggtgagttg gtcgccgacc actaactaat tcaaagacaa actgaggaag caaaatgttt    93120
actttattta tactggcagt atcggcgtgg atggcagttg gtatcaatca tggtctggac    93180
tctgctaagc tgctgtcagc taaagccttc gagttcctgg ctaagtttgc cacccgtaaa    93240
gatatcgagg ccatcatcgc aaaaggcggt gccaaagatg catcgagtgt cctgaagtcc    93300
ttcgataaga tcctagagct tcgtaacggt aagcatgccg cagagctacg ctgtatgagt    93360
cgcaagacca taggcagact gtgtaaggcc atcttcatcg tacaggggc gttgaaaggc    93420
ccattcgcta agtataaacc ggatagtatc aagcgagcca agatctttaa cgattactgt    93480
gtggaacacc acccgttaaa tcgctaacta cccaagccca gcatcgaaag gtgttgggct    93540
tttctttttt aaaaattact tgcgctctcg cttaaaatgt tgtataatag ttttataaat    93600
```

FIG. 15YY sequence.txt

| | | | | | | |
|---|---|---|---|---|---|---|
| gagaggagaa | ctaacatgcg | tattatctct | aaattaaagg | acgtatatga | tctacaaggt | 93660 |
| actatgtatg | atgcagaaag | agcatggtat | cgcgaagaag | tgaaagaggt | tgtaaacgta | 93720 |
| tccgctgatt | tcgaacaaat | tattttctac | gctgaaatct | tgcgtaaccg | cacttcctct | 93780 |
| ggatatgggg | gtgttaatat | gggaactctg | gaagttcgtc | cagtattgat | ttgtggtaca | 93840 |
| ctacgctggc | tgtacggtta | tcacactggc | ctaggagcag | atgctgtgca | tatccagact | 93900 |
| ttcgatccag | ttaaggtaaa | agaggtactg | gaagaacaag | gatactacct | gcggatgggt | 93960 |
| tgggacatga | atacgattga | gaagatcgac | gctcatgttc | gtaacgcaac | cgccacggct | 94020 |
| tctgcgttcc | tggagacttt | caacaagccc | attgcgatgg | catgggatgc | cgcaaagtct | 94080 |
| aagacagacc | caacggttaa | tattaccgtt | aaaactgatt | tcaacttcca | tgcggaagat | 94140 |
| ttcccgtggc | aggaaattga | tccaaacctg | tatcgctggc | accagacctt | agaatcatat | 94200 |
| atcttcggtg | tgctgggtca | aggggaacca | aagaccgagt | ctacgtctga | tcgtgatcgg | 94260 |
| ttaattgcta | agggcttcga | tgctaaagtt | tctttcagga | atatggagcg | gtaagactgg | 94320 |
| agcaattctg | tttctggcaa | ttgcagcagg | caccttcggg | ggtgcctact | acattaccaa | 94380 |
| taagctaaca | gatatgtcca | gttctttaca | gtccctatca | aaccgtaatg | aacaactaga | 94440 |
| aaagacagtt | ggtaatctcc | aaacagagat | tcgaaatcga | gatcgcaata | ccactaccta | 94500 |
| cataaccaac | ctagctaaga | accaggaaga | tctggatggg | cgtattaata | aactggatgc | 94560 |
| agctagagcc | aaagagggcg | tggttgccgc | taaacctaaa | cttgctacca | aagtggcaaa | 94620 |
| agacaaagtt | aatgagttcc | aggagagact | ttcatgcgta | actggaaata | tggactcctg | 94680 |
| ctctcggctg | caattatcgc | atccgggtgt | gcagaacggc | cagacccaag | tagcacagta | 94740 |
| acggggttg | agccacagca | cctaccgtgg | ccagcaagcc | tacagacttg | cccgtttaat | 94800 |
| tttgagttca | taaacgaaga | agggaaagtg | tatgttcgca | taccttacca | agattggatc | 94860 |
| acgatgggca | agtgtaatga | gcaggtctac | acctacattg | ccaatctgac | tgcattaacg | 94920 |
| tgtacctatc | gcgtgtcact | taatgaatat | cgttgcaaac | cgttcaataa | ggaaacaaaa | 94980 |
| tgaaatacgt | tttaggatta | attggtgatg | ccggcgcagg | caaagacacc | tttgctgaca | 95040 |
| tggctaaggt | ttgggcctgg | gaagtcctcg | gtccggagta | ttctatcagt | aaatttagtt | 95100 |
| ttgcagctcc | agtttacgaa | ctcgcggctg | taatccttgg | agtcacgcca | gaaaagctgg | 95160 |
| cagagcgcag | gacaaaagag | attaagcagt | ggttttgggt | gactcaggaa | gcccttgagc | 95220 |
| gtactgctaa | cgtctggaag | cgttttggga | tcgacaagta | cgccgatttc | tcttacgttt | 95280 |
| ggcctcagtt | tgaagcgtca | gcactatatc | cgttgattgc | taagactgcc | ccagactttt | 95340 |
| atcaaggtcg | tgagaccccg | ttgtacccat | tatacacgtc | ccctcgtaaa | atgctagaat | 95400 |
| tgttggcac | ggagttagga | cgcgctctgg | tggatgagaa | cttgtggttg | aatattgtgg | 95460 |
| tagatcgtat | cactgctacc | aaagctgaca | ttagtattat | ttctgatgtt | cgttttgata | 95520 |

FIG. 15ZZ sequence.txt

| | | | | | |
|---|---|---|---|---|---|
| atgaagccgc | gctagttcgg | aacttccccg | gtgcgcagaa | ctctagtatt | cttaaagttc | 95580 |
| acgcccctaa | caacatccac | gctatccaat | ctactcatgc | ctccgctaga | ggtgttgcac | 95640 |
| ctgagtttat | tgatgatgtg | gtaacaaata | actttgacgg | actggaaaat | ttccgtaaaa | 95700 |
| atgtaaacgc | attttgcgac | gagaggattc | tctttatata | aggtaacaat | atgggacaaa | 95760 |
| ttaataacgt | agagcagaaa | ggtggcaata | agactcctaa | ttacttcgcc | tccctagtgg | 95820 |
| cgactaaggc | agagtataat | atttaccact | atcatctcga | tgggccgata | gtcgatgtag | 95880 |
| actactaccg | cgacctatca | gtcactctgg | caactatgca | agagggagac | actcttaatc | 95940 |
| tttatattaa | tagtcccggc | gggtacgttg | atacagcagt | tcagttgtgc | aaccttatca | 96000 |
| tgaactgcca | gggaaccgta | attgggcacc | tggttgggcc | atcagcatca | gctgcctgct | 96060 |
| caatcttcct | agcatgtcat | ggttggctgg | tgcacccctta | cgttatgttg | atgggtcata | 96120 |
| cctatcgtgg | tgcgcactat | ggtaagggca | aaaatgagat | ccagcactat | gctgatcagt | 96180 |
| ttaactcgtt | cttcgaggat | atgatgctag | acctgtacta | cccgttcttc | tctctagaag | 96240 |
| agatcactga | gatgatagaa | ggtggtaagg | atatttggct | gacctccaaa | gaaatcaacg | 96300 |
| aacgtgtaga | tcgtatggct | gcgcaccgag | aacaagaagc | tcgtaaggct | gcgggtcaat | 96360 |
| aaaactaagt | aggccagggc | tttttagctc | tggcctttt | ctttatctaa | attctacttg | 96420 |
| acatttgtct | caaagtatga | tccgagcaat | aactataaat | ttttattgca | acttcctcca | 96480 |
| ataaagggta | taattataaa | tggttagagg | aggttcttaa | tggataaatt | tatacagttg | 96540 |
| atatcgctgt | tactacaaga | agcgaaggat | ccagcttctc | ttcttaaacg | tttgctaacc | 96600 |
| ttactggttg | gtctagttat | ctacctcttt | atagctaata | cgagtgaagt | catgtcgtac | 96660 |
| ttaaagactt | tctctacttc | ggcggtccta | caagatgtta | aagtacaacg | cacactagag | 96720 |
| tttccaaatg | tggcacgaga | gaaggcaatg | atcctattct | cacagactcg | agctgatgcc | 96780 |
| gtcttcgtgg | ttaaatacaa | gcctgaggct | ataaatgatt | accaaactat | catagcttgg | 96840 |
| gaaagcaacg | ttcagttgga | taaatccgat | gtatccgaca | aagcagttga | caagacgtct | 96900 |
| atgctctacc | gagcgcattt | agacggtctg | aactttgcaa | ttgatgcaag | ggaaaaacga | 96960 |
| ggtttatcga | agtggtctgg | aacgggtttg | ccaccgttca | agagtgcaaa | tttcgagtat | 97020 |
| gtgtacacgt | gcccatattt | taaccttaat | aacatctact | ctggatatgt | tgccgtcgcg | 97080 |
| tgggagaagt | atcccctaca | agacgaagac | atgggtatgt | ttaatgacta | tatggcaaaa | 97140 |
| atctgcgcat | cgccgcagag | atcattaggg | agatcaatat | gagtttcaga | tttggaaacc | 97200 |
| gtagtctcca | gcagctcgat | actgtagatc | ctaaactcaa | ggctctagct | attcgtgctc | 97260 |
| tggaactctc | accgcacgat | tttaccatca | ttcagggcaa | acgtaccgta | caacagagtg | 97320 |
| cccagaacat | tgctaatggt | acttcatttt | tgaaagaccc | tagcaagtct | aaacacgtta | 97380 |

FIG. 15AAA sequence.txt

```
cgggcaaagc cattgacttc gccccatata tcaatggtaa gattgactgg aatgacttag    97440
aagcattctg ggctatcgtc ggtgcattta aaaaggccgc aaatgagatg aacattgccg    97500
ttcgtttcgg agcggattgg aataactctg gcgactaccg tgatgaaatc caacgtggta    97560
cttatgacgg cggacacgta gagttactgt aacattaagg ggagctttta ggctcccctt    97620
ctttgtatgg agcaagcaaa taggaggtgg ttatgtttgc aagtttagta actataatgc    97680
tactcaagat atttcaattc ggtatagtat tcttttccgc aacatggatt ttaatacgcg    97740
gtgccattta ttttcgcaga acacgcttag ctagggttgc tagatggctt ctacacttcg    97800
tatttggtat tttcggtgtg ttccgctgcc catgtgagaa aaagagggga acagggttct    97860
gctggctctg gttaggtcta gagaattgct tctcattgtc cttagcgcta ctatttggta    97920
tgatagtcct agctataacg ctagcattta taccactaat gtacgcaggt ggggtgacgt    97980
ctatcctaac ccttacttct cctgtgttga tgtactcagt atccccatt acactatttt      98040
tcgtaagacg aggcaagcac tgcaattaat gaaaaattca attgactttc cgctcgattt    98100
agcgtataat atatttataa attcgagaga ggagatacaa aatgtcagac agattctaca    98160
ctcaaatgtg cgagcatttt aaagtatctc cctacgagtt aaatatagct ttgtgggatc    98220
gtgaatcacc ggagtttaag aaaattgcta agaaatcgga gggtgttatg tccaacggta    98280
agaaaatgac ccgaattgac cttaacaatg cgctaaccaa actgctcggc gttaacattg    98340
agggccagaa gctctctatg ccaactttga ctactatttt ggagaaagtc aaggctggag    98400
atgttaaaaa agtagcagtg cctgagggtc gtctgaaaaa gccgtatcag gaggctataa    98460
ttgaggcttt cggagaaaag ctagacctgg ataccgcaac cgtaaaaaca atgaaagcac    98520
tactggagag tattaataat gtctaagaaa attgtattcc ttaaaggttc tagctgcgtt    98580
ccttgcaagc aatttgaacc agtttttgat aaactcaccg ctgagttcaa cctgcccgtt    98640
gaaaaacgca cggacgacgt agattcccta cgtaagttcg gccttcgcac tgtacccgca    98700
gtagtcctgg tggatgtgga gaacggacgt gaagaagcac atcacattct tagtggtgcc    98760
acgcttcgct ctgcagtagt tagtaaagct atccaagact ttatcgacta cgtagaagaa    98820
taatacctaa ccccggctca atacgagacc ggggtttttt attatttgct aaacgcttaa    98880
aattttgata taatatttat attgaattga gagaggatta cacaatgact aagcaagcat    98940
atcttatcct gaataatggt tttgcagttg gtactacctt cgttgatctg gggtatacaa    99000
aagaagagtg gcaagctctc gatgctgccc agaagaatca gcttgttaat gaagccgcct    99060
gggagtatgc agaggcttac gtggaggcgg tagatgacga gttagttatt gtcgtttccc    99120
ttggtgccgt aggttgtgat gctcatgtac atacagactt ccagagcgaa gaagagtggg    99180
atgagttaga tctaacccac caaaatgctc tgattaacga agcgttctgg gaagttgtag    99240
actgctacgt tgcgttctgt aaggacgatg atgaagctaa cacctgcact aactatggct    99300
```

FIG. 15BBB sequence.txt

| | | | | | |
|---|---|---|---|---|---|
| atgaacacga | cgatgtggag | tgtgcataat | gcaaaaattc | tctagagact | ggtcttctga | 99360 |
| tatggcccgt | aaaaatcgag | ctgctgccta | ctataataag | aaaatacagc | tcgataagtt | 99420 |
| aataaagggt | atcacctaca | atgtagagag | gggcttttct | ggtataaaag | tagatgctag | 99480 |
| gagcctggac | tactcgtgca | tactgtgggc | taagcagaat | gggtacgcgt | ttaaacgaat | 99540 |
| aggcaatgag | atactgattg | cctgggaacc | cgaaggtcta | gtgcaatacg | taatatacga | 99600 |
| cccttatcga | ggggaatatg | taagagatca | caggcagcag | cccacagact | tctcgctgcc | 99660 |
| aaaacgttac | tatttagaga | cgaggtatta | atgaacgtac | atgaaacagt | taccgtgccc | 99720 |
| gacaatgcta | atatcttctt | cattggggat | attcatggcg | agtacgacat | gatgatgggt | 99780 |
| gccctgaaac | ttgcagggta | cgaggaaggt | cgtgactacg | tgttctgtgt | agggatctt | 99840 |
| atcgaccgtg | gcccgaaaaa | cttacaggtt | ctagcgaagt | tcctgtacaa | cccgaaattc | 99900 |
| cgctctgttc | gcgggaatca | tgacgaattc | atgatccaag | acgactacgc | taactggatg | 99960 |
| tataatggcg | gtagctggac | tatcacggaa | ggtttcgata | cggataccat | gaaaggtatc | 100020 |
| gcggaagaca | tggacagcaa | gatgccatac | attatgaccg | ttgaacaccg | tggcaagcgt | 100080 |
| tacggggtag | ttcatgctgg | tatccctctg | cgctaccagg | ctcaaggtat | gggtgtaact | 100140 |
| gtaccggtgt | gggacgacat | tgtgcacgaa | cacgaatcta | caccagattt | acgtcgtttg | 100200 |
| ggtgtactgc | tgtgggatcg | tgatgtaatc | caagaagttg | ggtttaatct | gtatcgtagt | 100260 |
| ggggagaagc | atccgtactt | cgatcgctac | gccagcttct | ccgaggagtg | cgcagtcgat | 100320 |
| gtgcctgaaa | tcgtgggagt | agactacacg | tttcatggcc | atactggtgt | cccgttcccc | 100380 |
| attcgctgga | agaaccgtgt | ctatttggac | acaggtggca | cctttaacgg | tcgtatgacc | 100440 |
| gtggcgtcgc | cggttctagg | tcaattatac | acattcacca | cagatcgtga | tgatccttgt | 100500 |
| ggttccgctg | acattattta | ataggtgaaa | catgaaactt | ttcaaagatc | tggaagaagg | 100560 |
| tgaagtattc | gtagttgctg | gtggcttcga | gttgcagaaa | tgtgtagcaa | tgctggacaa | 100620 |
| cggaaactcc | gtgtttacag | acgacgcgaa | tatctcggtt | actattgccc | cggacactga | 100680 |
| aacctggaaa | cccaaagaat | tctgggagat | ccataaagat | cgtccattgg | acgacctact | 100740 |
| ggacgacatt | ctattcacag | cctgaggtaa | atcatgaaac | tcgaatctcg | ttatattgta | 100800 |
| tttaagcagt | cagatgccgc | taagtatcta | accagcactg | ctattcggga | gataaacgac | 100860 |
| agcttatccc | tgatctataa | aggccgagag | gctgacggca | aggtaggatt | cccgaactat | 100920 |
| atcgttctag | aagaggattg | gccggagtat | cctatcgcta | agaagctct | agaaggacgt | 100980 |
| atcgtgctgg | aagagtttaa | taaagggcg | gagaagaaac | gtggggctaa | ggctgcagaa | 101040 |
| gatcactata | agcagcacca | gtctacggaa | ctactccggg | gtatttctcc | attctgtgca | 101100 |
| gggtggaacg | actacatgag | aagactggta | atcgaggagt | aaccatgtat | actggaatgg | 101160 |

FIG. 15CCC sequence.txt

```
gaaatgatat ggccaagatg tttattggcc tcttaatcct ggctgcgtta gtcggtgcag    101220
caattgtagg cggaatctgg gcgctcgtag catttgtatt ttaaattcag ttgcttccga    101280
gccaattttt ctgtataata gctgtataaa ttgatgagga agcaaatatg aaaaacgcaa    101340
tgatcgaact gaatgcaaat atggaatccc ttcgccacgc agttaacacc gcccgtgctt    101400
cttttaacct gctgatgcgc gatgagagca taccgctgtc cgctcgtgtc aaggcatttg    101460
aggagttcgc cgatgagctt cttcatatgg gagactatct cagcgactcc ccgtttaatg    101520
aagatcgccg ggattatcaa cacgcctact gcaatcgtgg ggaaatagtt tacctgaccg    101580
atgttctgga gagtgtgctg gagtatgcga actctttcat gcgaactcct gacgaatggg    101640
aagacgcttc gaacgactat gttctagacg agattcaaaa gaactggcca gaaattaaga    101700
aactggtaga agaacacatt cattctgaag tttacgctta ccggatcgat tggtaaaaag    101760
tttaaaaatt cacttgctaa gtagttagaa tttcggtata atatacgcat aaattaacga    101820
aacggacgga aatcattatg ctaagaaca ctatctctta caccactggt aaaactgctg    101880
acgaacaagc taacaccctg accaaagacg aaatggttgc ggtactggta atcctgctgg    101940
atatgagtgg gttcgaaggt cagcttgcta aactgtctct cccggcactt cgtgctctgt    102000
acgaaggcac taacaaaaat gctgcggcct acaacctcgc taaaaatgaa gcgcgctggg    102060
ccaaggaaca ccagcaggtt gctgaacgtc gtgctgagag tttcgaacgt gacctgaaac    102120
gtgaaaaggc gaagaaaaag taatggtact agaaattctc tccgggctgt taatagcagc    102180
cctagtaact ggaacgggtc tggcggtttg ggtatcgata ctgcgggaaa ataaccggag    102240
aatgagatta accaacaacg ggctacacga gaagttgatg gatcaagtac aagatgctga    102300
tgaattctct gctgcggctg agcgactttt agttcgcctg gcgaagattg aagagattat    102360
cggccaagat tccacaatgt cgaagacaac caaaatgcgg ttgatcacgg agattaagaa    102420
atgatctcac caattgtagc ggcactttac ttagtagttg ttggctacct gtccgggaag    102480
taccacggct tcggtttaaa aggtactatt aaggcagcaa tgctggttcc tctgtatcct    102540
ctggcaattc tgttaaccgg gtactacgcc tgtgttttaa gaatctttgg ccggggcaaa    102600
gttaactacg ataactgcac agcgttgctg gacgatattg aaaacaccat taagaaggaa    102660
gaaaaatgaa ccttaactcc aaagaacgcc aagtgttagt agatgctctg cgtcaggtag    102720
tagaccacga tttgctttgt gatgaagata tcgttgagtc aattgcccta atcgccaaga    102780
ttgagcttgc tgagaaggac tcatggcgtc ctttgagtga gcttcctcct ctaggcttgg    102840
caatcgtagt acaacgtgct gatggcgctc cgtttaacac tgtgatggtt cgcagagatc    102900
tggcaaagtc ctactccccg gatatcatca cgttgcacac taagatcacc aacgaacctt    102960
tcgagtttaa tactcgtcac tattactgga gactgaccaa tgcttaatca gcttcgaatc    103020
tataatttcc tggattgcaa cttccaggtc tggcgagaac tccccagccg tttcctaggc    103080
```

FIG. 15DDD sequence.txt

```
tgggcattat tcctctccat ggtggtttca gtcttccata acgtcccagc gacgttctat    103140
atggaagcaa ttcaaccagt cactgtattc atttacgaga tgtacctcgt agcaattaac    103200
gggtggaaag atggccgcat caactgaagt tttaaatcaa tattttaatc gtgagcacca    103260
agagttcagc gatctgttca tccagatgtt cgtcaacgct aataacgctc tggactatcg    103320
tttcttcaac gagttccatg agaccacgtt cagccatcag gatattaact ccgctctgaa    103380
agaactcatt ggctctaaag tgataccatt ccgacagact gcaaatgcag agacactaga    103440
gcttagtgtc gtttggggct tgttcaagaa agcatatgag tttggcaagt atcagaacgc    103500
acgtcactgg atttacgagg tgtatctaaa cactgaagtc attctacctc gccaaatgat    103560
gttgggctgg attgcaaaac aacgtcctga acgcaatgca aaatcattcg caccaattaa    103620
cgacgggaac ttataccatg caagtgaaaa atttgatgct ccaaaatccg tggcttgatc    103680
gcctggcgca agtagagaag atgcttctgg ttgaaggtct gaccgaagaa gacatttgtc    103740
tgaactcctt ctacaactgc aaaactcatg taatgcaggc gctagacgaa gaacgtgttg    103800
aactgagtaa gtttatggtg aacatcgcca cagctcaagt tcactggcaa acccagggct    103860
tatccgccga cgatatcctg aaacataccc tgaacgctat tgcagagtat gggaaagctc    103920
gtggtgaagc tctcttggct tcaaagaaag agtttgataa atcggagtca atgctgaaaa    103980
tggcaatcga tatccatatg gaaggcatcg acggtactat tcactaagag ggtgacaaat    104040
ggctaagaaa cgcgttgtgg taaacttcct agaggaagat tctggggact gcgagtacgg    104100
ttgctggaat actggctacg gtgttgaggt tatggtggat ggcaaatgcg tccaccgtca    104160
ggaagcctgg gcaagctgca ctaacaacag cagcgtagac tttgacgtat tggcccatgt    104220
tcttcagggc atcaagacga agaaggcta cccggtcaaa gcagatcaca tcgactttgg    104280
agatccttcc gattatccag aggagtttct ggatctgttc acctaacaaa gaggccaggg    104340
ctaattgctc tggcctttcg tggtttaagg atattaaatg aaatctatag acaactattt    104400
gcgcggggaa aaccctgtag atcaagcagc agttactgtt gaaaaggtca ggaaagagtg    104460
ttttatactt actcaacgtg gaggtggtaa tcggcctaat cgagtgtatc ttaattggac    104520
tcagtccaaa gacctgtatg agaggttgaa aagggaattt gagtagtgga agaattaaga    104580
cagaagataa atcaagagct agtatgggaa gctaaatcct tccccattaa tcaattcctt    104640
aaacgtgacg gttcgatcaa ccataataag ataaagcaac ttaggccaga tttcaggcaa    104700
gatgctaaga acctcatctt tattaaccgt gctctagacg ctcatggagt attcttcgga    104760
tatgagaagc tagtgttcca cagcctaaat cagctggtgg aaatatggtg tcccgaccat    104820
caagattact ttatgcaaac tgctagaagc caccttgagg gtaacggttg ccaaaaatgc    104880
aggcaccgca tggttaccag agttacggat tatggaagtt acaccgtgcc agcatactat    104940
```

FIG. 15EEE sequence.txt

```
cacaaatttt caattgacgg agactccatt atttggtata ataactccag taaattgata    105000
aaacctttgg aggttaaaga tgaaatacga ttccctgaat aatccgagca ccaactatct    105060
gactgaccag tcagtttctg agatcaagtt ccatccgaac tactccccgg actctagcaa    105120
gccgagtgta gcagctatct ccttccgctt ccgcaatctg cgctttacgt tcgttggaga    105180
ggaagacaag atgatctcta taattgacaa ggttaaagca gtaagcgagc tgtccggtag    105240
cgataccgtt aagttcgaag cattaacctc gttgctgctg actagtgggg ctaccgttgg    105300
taagttcgaa cttattcagc cgcatgtttc tgcactgacc aataccagaa acttctggga    105360
tcaagccaat gtcgagagtc tcataaaatg ggatagtgct actgagttct acaacaagta    105420
agagggctag gatatgttat tctgtacagt tgattttgaa gaagctaacg aaacgtatat    105480
tgtctacggt atgtctgaaa gcaaagtacg tatcctctgg aatcagttcc aattagaagt    105540
accggacgac atatccaaga ctccgaaaga cttctttcat ttaatagata ttaaggcagt    105600
aaaagctcgt aagaagctaa ctccttatgt gttcccaggt gcagtattcg tccatgagtt    105660
aacagcgtat actaacgtgg ttctcaaaaa gtctcgacag cacccaggct atctcacgat    105720
gttgacgtac aaagttggag ctattcacga cggtgagctg gtggttcggg tagatgcacg    105780
cttgcagcaa gaagtcgaag aaatgattag gcagtgccaa aataaagcag aattaaaaca    105840
aagagcacgc ctattcgaca tggcagcacc tagcgaggca gttgccgcat atcacggctt    105900
ttataaagaa atagctgaat ccgatgaaga tttctttatg taagaggata acacaatgaa    105960
cgagaaatat gaagtatgga ctccggttgg ggagaattgt agctatcttc ttcgtaccct    106020
gtgtactcgg gaagatggca catctttctc agaatacttg agtgaatgcc acgctaaggc    106080
ccagcaggac aacccgctat ttaagatcag aggagaggat atcctcaaag ttaacggcgt    106140
gccgtacacg ccagtggaca gtttcgccgc tcttcaggtg tttaaggaac acagagagcg    106200
ggagcaccgg aggatgattg aacgcttgac aggtagagag ccgttttcac atcctaggtg    106260
gaatgaggag acataatgag cagagttgaa aagctacaac atatctataa cctggttaag    106320
aaagctgacc aaaagaaact ctcagagctg agtgaagaag agtatcaagc agtcctcttc    106380
tgttgttcgg caatgccagc gaagctcgat ggagtactgg caaagtcaga catccacaac    106440
ggtaaggaaa caactttcca gccgccgtat aaatggctag cgtccaacat ccagcaaatg    106500
gtgggtaaag ttacgggatt ctcaaataga aagacgccta acatctttat tgacattact    106560
cctagaaccc ctgagtttac gaaggactgg agagacgcat tggattcatt tccgtcatgg    106620
aaagtctttt ataaacctga cgatgaaacg tatgcacatc ttcccttttt gaagcaccca    106680
ggctacacag ttgaagaccc aagttctggg gttaatttca aagacttcaa gtgtactgac    106740
gagaacattg cttacggact catgagaaca tccgtgagga ttgcaatgga tcatgaacta    106800
gacaaacaag atctagcagt cattgcactt tgtaaggatc gttatattaa agttaagagg    106860
```

FIG. 15FFF sequence.txt

| | | | | | |
|---|---|---|---|---|---|
| atcgcagaga | aactttccgt | actttcttgc | tttgaaacaa | tccgagattg | tgaaccagag | 106920 |
| ggtgaatatc | ctaaaggttc | cctctactgg | aaagatgtta | aacatctagg | actatcagaa | 106980 |
| gaagccgtat | tcctaggctt | agtagttacg | ggaagattcc | tgaggctaca | ggagaaataa | 107040 |
| tttgtacttc | gtctatattt | tcgctaatga | agatcagcgg | cttatccta | ggcggaccaa | 107100 |
| ggtgggttac | tcgcgtgacc | cattttatcg | tctaaattcg | cttcaacttc | acagactacc | 107160 |
| tcatcgtgga | ttacaggata | tcgttattca | ttctgtctat | ataatagatg | acgccagcga | 107220 |
| gttctcagca | aagttgctag | agaaggccgc | gcataaaaag | tttaagccta | tgcgagttaa | 107280 |
| tttcggtgac | aagtttgatg | ggcatacaga | atggtttgat | gttgaacctc | acgttattga | 107340 |
| gaagttcttc | ctgtcagttg | gggcaaaaca | agtacctatt | gacaaactca | tagcccaaga | 107400 |
| acaaaagatt | cgtaaatcca | cgaaaaagta | gttgaaaaaa | aataaaacgc | atgttataat | 107460 |
| aatctcatag | attacataca | atttgaaaaa | tttatgaagc | taggcggatt | atgaaccaga | 107520 |
| atcctggact | cggggcgacc | aagcctacga | tgtcacagag | actttctggt | ctcacataat | 107580 |
| ccgcatgcct | agcgcttcgt | aatctcacat | gaacgatgga | gaacctataa | ctataataaa | 107640 |
| actaaggaga | aaatagggaa | acgtgggaat | gaactcacga | ttactcacgt | ttaaaagtag | 107700 |
| gtaatcctta | cacaccatcg | tttcgcggct | ctagggttga | actctagtca | tctttctata | 107760 |
| cagggcggtt | ctttctacac | acctaagggg | agggcggtta | ttttccaacc | ctaaaaatcc | 107820 |
| ataaccattt | tctggaattg | cacaaatttt | cacaccgtct | cacatatccc | acgaagccct | 107880 |
| cacacatctc | acgcaatccc | tctagtacgc | ccaagttcta | agcgtcactc | cacaaagtcc | 107940 |
| tcacgaagtc | cccacacaaa | cccacgtcat | tcacccaagt | tctaagcgtc | aaacattatc | 108000 |
| ggatttgcac | attgctccta | gatattaaag | aagccaagca | tttctagatt | tctagcaatt | 108060 |
| gtcggatttg | cacatgacaa | aacgattgtc | ggaaatgcac | attaactctg | aatccaaaaa | 108120 |
| cacggtcgaa | tttgcacata | taaaaactac | tatcggattt | gcacatactc | aaacgcttgt | 108180 |
| cggaaatgca | cattattact | gaagtacggt | agctgtggat | caaaatcttc | gattctgcga | 108240 |
| atataaaata | tctcctgaaa | tttcaagcct | ttttacacgg | tgtgtcaccg | tgagttcgct | 108300 |
| tgtttttag | agccacagga | atttttctg | tgtcaacccc | tttaccccca | tttaactcat | 108360 |
| aatatttcc | cttatctgcc | ccctgccccc | atcatccccg | aattgcccca | attaccccc | 108420 |
| tttatccctc | ccccaaaaat | acccatcgga | tttgcacata | ctcacccaaa | ctcgcgccca | 108480 |
| ccgctgcgct | gcagcaaact | gcgcgccttc | ccctaaaaa | ttattatcgg | ttttgcacat | 108540 |
| attagtatcg | gatttgcaca | tgcccctagg | gcggtaaaaa | taaattttca | tcggatttgc | 108600 |
| acataccta | gcagcctcac | gtaatatttt | gcttgacaca | ttgtcggatt | cgcacataag | 108660 |
| cgcaggaagg | gccgggggtc | ggaaatgcaa | atacgaatga | gagtgattcg | catttgagaa | 108720 |

FIG. 15GGG sequence.txt

| | | | | | | |
|---|---|---|---|---|---|---|
| gttgaatgcg | aatgataatt | attctcgttt | gataagctga | atacgaatga | gaatgattcg | 108780 |
| cattccggaa | aggaagtgag | aaacactatc | atttaagtta | tcaccagagt | tatacaaaat | 108840 |
| tgtaaattag | cttgacgctt | gagaaggtcg | cagacgagtt | atccacagac | ttattaacag | 108900 |
| gttatcctac | tggttattta | tacagtagtt | cccggcaaca | ctttctgcta | atgtcgattt | 108960 |
| taagcgccct | aggaagcgtt | ctaagcgatt | taaatttcgt | gggggtattt | tagtaagggg | 109020 |
| tcacgcggtg | gaggagggcg | gcgacactct | tacatatcgc | cgtggaaaca | ctcaggccaa | 109080 |
| aagtgattta | caactgaaac | tattagcagg | gtaatgattg | cgctaataac | tatcatgccc | 109140 |
| aaaaacatta | ggccgctcat | tattggcagc | tctgcaaaaa | gactagggtc | ataataataa | 109200 |
| ccatgatgac | acgaaaaccc | cactcaccgc | cgccaccgtc | accgcctttc | ttctgaccgt | 109260 |
| cacgaataac | gttcaattgg | taagtattgt | ggctacggct | tttgggacta | ccaccgcgta | 109320 |
| aagttcgcat | taaaaagcct | ccttattaaa | caaggtatca | tagagggcat | agccgcaaaa | 109380 |
| agcgataaaa | cccaaaacca | tcatagaacc | aactaaaccg | agcgccaaca | ttgaaaaagc | 109440 |
| cattttcga | tctcctatat | gggtgagtca | taataataac | ataactctag | cgggaagcaa | 109500 |
| ctactatttt | tagtagtaga | caagcaaatc | cgatttccct | atagtttgat | ctcccggcaa | 109560 |
| gcatagaaaa | attttgcttg | ctaaaaagcg | gagaatcttg | ctataatga | ttctcagcca | 109620 |
| aacaaaggag | taacagaaga | tgttacagaa | atttaccccc | gttgcaaatt | tgcctatggt | 109680 |
| tcgcggtggc | gctcgcaacc | tgttagatgg | tagtaaatgc | gcctctatcg | gtcatatttt | 109740 |
| aggcgtttac | cgctcgaata | tggaaagtag | aaccagccgc | gcttttgaac | atagccgcga | 109800 |
| ctacgttcta | gccaaccccg | gcgctgcgat | tgttattttt | cacgacgatc | aatatttagt | 109860 |
| tgacagccag | cctattgatc | tgatagtatc | taccactacg | gacgcttatt | tgtataaggc | 109920 |
| atccgaaggt | aagcaagcgt | caagacgttt | ttgctaccat | gaaagcgaac | tgctcgcttt | 109980 |
| caccgatgcc | cgcgcatgga | ttaaaaacct | gtgcgatcat | ctggaactac | caccagcacg | 110040 |
| aatttctagc | gaaatgatga | ttttttgtgct | tgacaaagac | ggaagcatcc | tgctaccatg | 110100 |
| tgacccttac | gatattgata | tcgaagaagg | ggcaaggact | ggaaattatc | gttatgatgg | 110160 |
| cgagctagaa | gaagtcgccc | cggctgttac | tgaaaatgta | gttaacccta | ataattttga | 110220 |
| gactggagca | ttacaaatga | atactatcaa | atctaccgct | accgctatcg | ttgccgctaa | 110280 |
| caaaaacgct | gctgtaaacg | ctgctaaact | ggaagccggt | tctatcgtcc | tgaaaaaagt | 110340 |
| ttccggcatc | gccgccagca | aagcgccgtt | tatggttcgc | ggttatgttg | acacggcggt | 110400 |
| aggtcgtgtg | gtaattgcta | acctgctgaa | tttcgcggtt | agccagtatg | cgccgaacaa | 110460 |
| ccgcaaagcg | gtgattgcgg | ctgacgctgc | aatgcaagcc | gccatgttgg | aactggtaca | 110520 |
| aagtttcaat | gtaggcgaaa | tgattgacga | agtattgaaa | ggcgtcaatc | tttctagcct | 110580 |
| gattgaaagc | gacgtagcag | aataattata | tctagcgcct | ctataatggg | gcgctataat | 110640 |

FIG. 15HHH sequence.txt

| | | | | | | |
|---|---|---|---|---|---|---|
| aattaccctg | ctaactaact | ggagacaaaa | aatggaacgg | ctaaccgcta | ctttcgaagg | 110700 |
| cgaaaagatg | acgatcgcta | atgtatggca | gcgcctgcgc | cagaatggcg | atcgtggcaa | 110760 |
| ttttgctatt | ttcatcgagc | caaaaaactt | ggataatctg | gctcgccaga | ttgaccgccg | 110820 |
| ggactgctac | ccggatacag | atgatatgct | gggaatcccc | ttgcggatta | tcggggtata | 110880 |
| tggttacggc | tttgatatct | gtattggtga | tagtagcttt | gaaatcgact | gcgaatccgg | 110940 |
| cgctaccgaa | atcgaagtat | tcctaattaa | tttaggctcg | ctaacgtttt | tggatacgcc | 111000 |
| accagcggaa | ccggaaccgg | aaaagctgga | ggtgaaaacg | tccgttattg | ttagttcgct | 111060 |
| aactatggat | gagctggcgg | atatcgtgtc | aacgtatgac | gaaattcacg | ccgacgcgat | 111120 |
| taaagagcta | aacaaccggc | ttgatacttt | ccgcgataag | ctgtaaaatc | cctcccggcg | 111180 |
| gctaaatctc | tagccgcccc | cattattgga | gaaaaccatg | tttcatgtga | aatcttgcgt | 111240 |
| accgggcatt | aattatacgg | tagaagcgga | agaaggttta | tatttagagg | gcgggcgaat | 111300 |
| tgagtctcag | gaagtcgccg | ccgtcctcaa | atgtgacact | aacgtttgcg | gtacgtcctg | 111360 |
| gactgacctt | cattttttag | gtcgtggaat | tgacgtcgat | tccctttcct | gggaaaaggc | 111420 |
| ttgcgaacat | gctgaaagta | tgctaaacga | ggatgattgg | gatgatgacg | acagcgacga | 111480 |
| aaaatacgcg | aatgctgggg | tagaagggtc | gttttatatg | tactggcccg | gtcattcctg | 111540 |
| caacctcgtt | aatggtggtt | cgcccctcca | ttccgttcta | gagcgggcaa | tctatttggg | 111600 |
| ctatatccag | atagttgacg | gaaaggcagt | cattaatctg | cgcgaattga | aaacgtttat | 111660 |
| ctatatcccg | gatgctgaaa | ctatccttca | tattgaggaa | ggtttaaaat | ccggttggaa | 111720 |
| ggttagcggg | gtcgtatacc | tatgatttac | atctatgtca | acaaatattt | tctggcgcac | 111780 |
| tataaaacga | tggaatctgt | gatccagtac | gttagccgcc | agaatgcaag | gcatattgat | 111840 |
| gaagtggcta | ccctcaaaat | cggattgcgg | ggcgatgcta | tcaatattag | ctggcctttg | 111900 |
| ctaattctga | tttgccgtga | tcttgtagcg | ggtaaacctg | tttccgtttc | cgcgctgggg | 111960 |
| gaatcttacc | cgctttccga | tgatctggat | ctctatgatc | tgctaaccaa | atataaaact | 112020 |
| gaacgcctgt | tttatcgtgg | cgggtcggta | tgctctagcg | gcgaaacaat | agaaacggta | 112080 |
| ttccgctaat | agttagctaa | ctaatgataa | gcctgcttat | aatgagcggg | cttttttattt | 112140 |
| ttctgcgccc | ctctagcaat | ggcctttaat | atggcctcta | aatttaaagc | gcttagaatg | 112200 |
| cgttatagag | cgttctagag | gcatattaga | gtattaccgc | tgccggaata | tactgtataa | 112260 |
| atatacagta | ggataacctg | tggataagtc | tggggatatc | tcgttatacc | gcttctcagc | 112320 |
| ttgtcaagtc | aaaacgtgct | gtggataact | tgcccggaaa | acaggagtgc | agcataaaat | 112380 |
| aaacgcaagc | attattttgc | gttttcataa | aaataatcgt | ttgtctagtg | gataactaat | 112440 |
| taaatttcat | ttttgctttt | tgtataagtt | attaacaggg | tctaaaacgc | cctagaatcg | 112500 |

FIG. 15III

```
                                   sequence.txt
attctaagcg gttttagata aaagccgatg aatcataccg ggtatgaggc gatctcctca    112560
cctcgtgtga aatagatttt gtcaacccct tttgaagaaa aatagtaaaa atattcgttg    112620
actttcttta aatattgtgt cacgtgcgcg cgcttcctat ctatcgtggg cctgttttct    112680
ctttacgctt ctttacaatt ctccgcttgc ggctaaacgc cattgtgtta ttatttatct    112740
cgtagggcgg caagacgaaa cggaaacacg aaagcgtttc actagtagtt aggtatctgg    112800
aggcggcaac attgccccga ctaccgcgaa aggaaaggcc gaaacgatat agtctgcccc    112860
cgccctacac tgctctttaa aaatttggga ttctataaaa agcgttatcg gctttctta    112920
cttaataagg gaaccgaaaa catgttaaaa gaaaacgtaa tgagtagcga gattgtaaac    112980
gagtttacag tagcagacgc cgaacatttt atagagactt atttaaatgt gtacgacgta    113040
gatttagcct tcattcataa agacggccaa atc                                 113073
```

FIG. 16A sequence.txt

```
<210> 2
<211> 31078
<212> DNA
<213> Unknown

<220>
<223> Description of Unknown: Bacteriophage F394/08

<400> 2
aaacccggag caaggccaag cagcagccgc agaaagtacg ccagcagatc cggcggctaa        60
tgtttcacgt gaaacgaagc ccgaagattt aataaaaaac gacgtggccc cggctgaatt       120
aaccccggct ttttatgtgg tggctgaagg tcgcgcgatt acgtcaaaac gtggcatttt       180
ggccgctggt gaagcagtag aggcccgcga ctttgtaggc ggtgaagaaa cgctaaacag       240
cctttttagag cgtggtttag ttgaatgaat atccgagatt tagcggccca agatttcctt      300
aatatcgtga atgataaaaa tagcggtttt ggcgttcccg tggtgttaat tgccccggat       360
ggtaacgcgc agccgttaag cggattaacc acggatatat cgagctatat tgatccggaa       420
acgggcgttt tagttgcggg ccgtgttgca tcggtcacat tcgcaaacaa ggcaatccgt       480
gccgctggat tcgcagaaat gcccgtagcg gtggccgatt caaataaacg cccgtgggtg       540
gtgtgctttc gtgatcctga aggcatcccg tatttgttca aagtggttaa ggctatgccg       600
gatcgcgcga ttagtggcat agttttagaa ttggaagttt ataagcgttc tatttacttc       660
aatggggctt ataaatttga tgggacgacg ttatacgatg gagttttaga cttgttatga       720
atatagaagg ctttaaaaaa ctgcaaagcc cgattaacaa gctagatagt tttgaaatag       780
tccgcgacca gatcgcggct attttatttc ttgagcttga aaatcaaaaa gccattgctg       840
ggcgcgcgca gattgacccc gctagatttg atatgaaagt ttataaagag cgttctaatc       900
cgtgggatct attcgacgat ggcgaaaata agcccattat taacgtgtgg tttagtaata       960
gcgatttcga ttacaccaat agcagcacag tcgataagca gaaaaccacg gctattttta      1020
atattgattg catagcgacg gctataagcc aagaaacagc gaccgggcaa acgctgggcg      1080
atgaaatggc atctttagag gtgcagcgcg tggctaaagt gatccgaaat attttaatgt      1140
cagatacaaa tacatatttg caattgcgcg ggcttgtttg gtcgcgccgt gtgctgtcat      1200
taaacatatt tcagcccagc gcagaaaatg gaatgatgca aaatctatgc gcggcccggc      1260
ttgtacttca ggcgacgttt agcgagtttt cgccgcagta tgaaccccaa gagctagaga      1320
ttttgtccgt aactgtccat aattgcgatg gacaaatttt atttaacaag gagattgcta      1380
agaatggcaa ttagtaccgc tgttgatata agcgcggtgg cccgcgtttt aggtatcaaa      1440
acaaatttta aaaatttgcg ggatggtcgt gtggtgattt tgccgcagcg gatcgcctta      1500
```

FIG. 16B sequence.txt

| | | | | | | |
|---|---|---|---|---|---|---|
| attggtcaag | gttccacggg | gatggtgttt | gcaacgtcaa | aacgacaagt | aacaagcgcc | 1560 |
| aatgaggtgg | gttcgctata | tggttatggt | tcaccgcttc | acttagcagc | taaacaacta | 1620 |
| tttccgaata | atggcgacgg | agtggggacg | atcccggtaa | cggtttaccc | gttaagtgat | 1680 |
| gcggacggat | cgcaagcggc | gaccggatca | attgagcttc | tagggacgca | attagaatcc | 1740 |
| ggggcttata | gagttgttgt | gaacggtatc | cgttcggaac | aattttcaat | tttgattaat | 1800 |
| gaggccgggc | aaactgttct | aaatcgagtt | gcggcggcta | ttaactccgt | tttagatatg | 1860 |
| ccagtacgtg | cgacggcaga | ttcggaactt | caaaaagtaa | cgcttgtttc | aaaatggaag | 1920 |
| ggtttaagcg | ctaatgctat | ttctgtccaa | gttgatgggg | atttagggca | aggtatcgaa | 1980 |
| tttgcagtaa | cgcagccagc | gggcgggctt | attaatccga | gtgtttccgg | tgcgctttcg | 2040 |
| cagtttggca | acgtatggga | aacaatggtt | ttaaactgtc | ttaatattca | ggataccgaa | 2100 |
| gcattaagcg | cttattctga | ttttggggaa | gggcgctggg | gtgcgttggt | gcgtaaaccg | 2160 |
| cttattgtat | ttacggggaa | tactgaagcc | gacgtaaata | gcgccgtttc | agtcccggac | 2220 |
| gcgcgaaaac | gtgatcggac | aaatgttcaa | cttgtggccc | cggattctat | cgatttgccg | 2280 |
| ttcgttgttg | cgtcccgtca | attggcccgt | attgtaaaaa | ttgcaaacga | aaacccggct | 2340 |
| tgtgattacg | gcagccaagt | agccgacggc | attaaccccg | gcgaagatgg | gaaacaatgg | 2400 |
| ctttataacg | tgcgtgatat | ggccgttaaa | aaaggcagtt | caactattga | aattcgggac | 2460 |
| aatcaagtat | ttatcgggga | cgttgtaacc | ttctatcatc | ctgaaggtga | agaaaatccg | 2520 |
| ccgtatcgtt | acgtttgcga | tattgtgaag | ctgcaaaaca | ttatttttaa | cttaaatcta | 2580 |
| atttttgccg | tgccggaatg | ggacggagcg | ccgttaattc | caaacgatca | gccgaccaca | 2640 |
| aacccacgcg | ccaaaaagcc | ttctatggcc | gttgccgcta | ttgccagcct | tgtggatagc | 2700 |
| ttgggcctaa | atgccattat | tagcgatgcg | gcatttacca | agaaaaacac | gtttgcacaa | 2760 |
| attaatgaac | aaaatccgaa | gcgtttagac | gtttcgacga | ctgtaaaact | tagcggaaat | 2820 |
| acaaacattt | taagtgtgga | tcttaatttt | ggtttctatt | tcggtaattc | ggtaattgtg | 2880 |
| gggtaaataa | cttatgtcag | ttggtggcag | cattgagagc | ttaactttag | acggccgaac | 2940 |
| cttcagcgta | gcagcggacg | cggattcaac | gcgcaatttta | ggcggcacgg | ataacgaagt | 3000 |
| agaaatgaac | ggggatggta | cttatcgaat | tgtaaaaacg | cgcgtaccgt | caaaactaga | 3060 |
| cggtatcacg | gttgcaattg | atgacgtgcg | cggggatgca | gaatacttgc | aagagctaaa | 3120 |
| agatcgaaaa | gagggctttc | cctattcgat | tacatacgcc | agcggtgtga | tttatcaagg | 3180 |
| tacggggaca | atcgtaggag | aaacgggaat | ttctagccaa | aacgcgaccg | cttcgattac | 3240 |
| tatttcggga | tcggctttaa | ctaagcagta | atttacagcg | cggccataag | attggccgcc | 3300 |
| ctttcttaat | catttagggg | gtttcacgtg | gaacatatcg | aaaatactga | aaatcaaact | 3360 |
| ttgtggggct | tgcctgttaa | ggttgcgcgt | gaagttgcgg | aggctgaatt | tatccgcttt | 3420 |

FIG. 16C sequence.txt

| | | | | | |
|---|---|---|---|---|---|
| tgtgatgcta | tggacgtgga | ttacaacacg | gatcgaatga | cggacgaaga | tgcaaaagac | 3480 |
| tttaacgaaa | gtaaagggct | tttgcttgat | gcgctgcaaa | ttggcgtttt | ggaaattgat | 3540 |
| agcgacggca | tggccgttgt | ttacccgaaa | aaaggcgata | ttaagcaaat | taaatttaat | 3600 |
| gagctttgcg | gggcggatta | cgtggcaatg | gacaataaaa | aggatacgca | aagtttcgct | 3660 |
| aaaatgttcg | caatgatggg | atctattacc | aagttaccgc | ccgcgacttt | ctcaaaactt | 3720 |
| aaaaagtttg | atgcaaaagt | ttgtttgtcg | attgctaaac | ttttttggt | ctagtcgata | 3780 |
| ccgttttaat | cataaagggg | ggcgaggttc | gcctatcccc | ttcgagagat | tcggatggta | 3840 |
| tcgagcgcgg | gaataatacg | agatttcaag | tttattcaac | gatgcttatg | cagatcctaa | 3900 |
| gagattataa | cttgccgaat | tttagaacct | taacaagttc | agaaattcgg | tttttatga | 3960 |
| cggattgcgg | gccgagttga | aagaaacaac | aaaaccgagg | aattaatgag | ccgttacagc | 4020 |
| gtagaaacaa | tatttagggc | cgtggatcgc | atgacggccc | ccatatcccg | gatgcaatcg | 4080 |
| ggaattagtc | gatttactcg | ccgggctgaa | agcggactta | ggcgcgtttc | agatatgacg | 4140 |
| tggaatatat | ccaaagtatc | aggcgcagca | gccgcggcca | ttggtggcgc | atttatggcg | 4200 |
| gccgctggtg | gtattgccct | ctttgtcgca | gaaacaaacc | gggccaattc | agaaataaat | 4260 |
| gaaatgtcca | aagctatggg | ggtttccgcg | ttatccgcaa | gggccgcaga | ttccttgctt | 4320 |
| acaccgcttg | ggatgaattg | ggaaaattac | acggatctta | ttgaagaatt | gggaaataag | 4380 |
| atgggtgaat | taaaaacac | ggggggaaatg | aaaacatttc | aagaggctat | tggacttact | 4440 |
| aatattaaaa | tgaaggaatt | aaaagcctta | agccggagc | agcaatttac | aagaattatg | 4500 |
| gattctttgg | caaaaatgga | ggatcagcaa | aaagcccaat | ttattgcaga | tgaaattttc | 4560 |
| gggggtgagg | gtaataaatt | cgtttcagcg | ttaaaggcgc | gcggcttgac | tatgacgagc | 4620 |
| ttgattgaaa | attataaaaa | gtacaatttt | tataatgagc | aaggcgaaaa | agcaacggcc | 4680 |
| gctttaatg | cagctttaac | cccgctaacc | acgacggcaa | attcggcaaa | atcgcagatc | 4740 |
| gcggccttaa | ctggtggcgc | gatggttcca | tatattcaaa | aggcgacgga | atgggctgcg | 4800 |
| gcaaataagg | aattaattaa | tagcaaaatc | gaagtattcg | ccaaaggctt | ggcggattcg | 4860 |
| cttgtttggg | tggtggttaa | ttttccgag | attgtgacgt | gggttaaacg | tgtcgctatt | 4920 |
| ggtatcggca | tattcttagc | gcttacagcc | gtttaaaaa | ctttcgtttt | gattatgacg | 4980 |
| gccgttaatt | tagtaatgat | gatgaacccg | atagggctaa | tcattatcgc | cgtggtcgcg | 5040 |
| cttattgctg | tcattgcgta | tctgattaat | aagtttttg | ggttgcaagg | tgtcattgcc | 5100 |
| gcggctaatg | gtgtgcttat | ggggattggg | gccgctattt | tggtggcgat | ggggccaata | 5160 |
| ggctggctaa | ttggggccgc | tgtcttgatt | tggaaaaatt | ggggcgtttt | aagtggtttc | 5220 |
| tttagtggtt | tatgggcggg | tatcgtttca | gtttttcagg | gcgcgcaaaa | tattattatg | 5280 |

FIG. 16D

```
                                    sequence.txt
gggatcatta acgggattat gggcgcaatt gataacgtga ttaataaagc ggtttcgatg         5340
ggttcggctg ttaagggctt ttttagcttt ggcggcggtg gtggtgatca aaagcaagca         5400
gcagcagcgg gcggacgtgt ggcaagccca caagagcgaa ccgcaaaaag cgtaacggaa         5460
aataatagcc attcaacggt aacgatccaa gacaaaaccg gacgcgcgaa aatgtcaggt         5520
aaaccggggga atggggttcg attggttaaa acggggacta tgtaaacaat gagttgggaa        5580
gatcgtttaa aggaggcggc ttacaccgcc cccggaggta cacgggccac gttcttagtt         5640
gaggacgttt cccgtagttt tgataaaaaa acaaatggtt tcacgttccc ggatgcgtcc         5700
gggacttatg ttcaagattc aggcgtaagc gggtttaaat atccgctgac tatctatttt         5760
agtgggccgg attgcgatgt ggaggccgaa gcgtttgaag cgcttttgag agaaacggga         5820
atagggcgtt tagagcatcc gctttatggc gttattaacg tggttccgtt cggtacgatt         5880
acccgtaccg atgcaattaa aaccgaggca aaccaaacaa aaatagagct ggaattttgg         5940
gaaacaaacc ttttaattta cccattaccg caagccgacc aattaagcgc cgtatttgag         6000
gctatttccg acgttaaggc ggctttaagc ggtgatgtgc tagatagtat cgacgtaacc         6060
gacgcgagcg ccctagcgcg atttaaaaac aaaataacgg gggctttaag caaggtaaaa         6120
accgctttag ggaaaattaa gaatttagcg gacttgccgg ggcaattaat ggacaaggta         6180
aacggcttaa tttcgcccgg ccttgagttt atttccgatg ttaaagccca gcttggcgat         6240
gtggttaatt cattttttga gcttgccacg ttgcccgaac aaattgtcga ttcattcaaa         6300
gagaaaatag cggtctataa ggatctcttt agcgaattaa cttcattcga gggcatattc         6360
cccagcaatg aagaatacga ggcagcttgt accggggtaa cggtgacttt atccggctta         6420
gtagtggatt tggttgaatc tgaatttaat acacaaagcg aagcattgga ggcggccgag         6480
gatctattag ccatttttga tgatgtaacg ggatggattg aagaaaaggc gcaaggcttg         6540
ggccgtaccg attcaaacgc ggtttatcag cgcttacata gcgccgtgat gaccgcggcc         6600
agctattttgg ttcagcaatc ttttacctta aaaaaagagc gtaaattggt tttaaaccgt         6660
agccgtacaa ttattgattt atgcgcggag ttatacgggg aagtcgatag cgctttagat         6720
ttctttatta cgtcgaatga tttaagcggg gctgaaatat tggaaattcc gaaagggcgc         6780
gaggttttttt attatgtctg acgtttctat gatgatccac gggacgcgct ttcatttttg         6840
gagtggtgta aggatctctt taaatattga cgcggtggca acgattagtt ttaacgcccc         6900
gtttgaccat gaggcccccg gatttaagcg caatttcgcg ccgtttggat tttccccggt         6960
tgctatcgac gtggacgatc agcgcttatt taccggaacc atgttggacg tttccccggt         7020
gattagtgaa gatggtaaaa aagagatttc cgtaaatgct tatgcaaaat gcggagtgct         7080
tcaggattgc accgccccgc ctgaatccat gccattagag ttcaataaat taaacctgtt         7140
ggatattgct agaaaaatgg cctcttattt tggggtgggt gtggtattta atgcagatcc         7200
```

FIG. 16E sequence.txt

| | | | | | |
|---|---|---|---|---|---|
| gggaccggct | tttgatcgcg | tggcgtgtga | cccggataag | aaagttttag | aattttttagc | 7260 |
| ggatctcgca | aaacaacgcg | gctttgtgat | cggtagcgat | gaaaacggca | atttactttt | 7320 |
| ttctaaaagt | tcaatcggcg | gcattgttgc | taagttggag | caaggcgtat | ccccgctttt | 7380 |
| aagtgtatcc | cctacttttta | acccgcagga | atattattcg | catattacgg | ggctatcccc | 7440 |
| tgtcgaagtg | gcaaagcccg | cggccaaaag | cacggccaaa | gtaaaaaagg | acgctgcaac | 7500 |
| gcctgaaaaa | gcagggcagg | ggagcgaaaa | ggcgaccgat | aaggcgggcc | aagccgaaat | 7560 |
| taaaaaggaa | ccaaaaaaag | aggaaaaaac | caaaaaggaa | aagcaaaaac | caaagcccac | 7620 |
| gacttataaa | aagtttacag | ctatcgacga | ggcccccgta | tatcggccat | tggttttttaa | 7680 |
| aattgatgat | gcagaaggcg | cgaccgatgt | agaaacggcc | acaaaagcaa | aaatggcccg | 7740 |
| aatgcttggc | aatatgtgta | cttatgcaat | tacggtttcg | acgtggttcg | atgcgtccgg | 7800 |
| ggatttatgg | cggcccaata | ctaaaattaa | actcaaggcc | ccggattcaa | tgatttatga | 7860 |
| tttttttcgag | tttgatatta | aaagcgtgga | attgtcggcc | gatgaaaaca | gccaacaagc | 7920 |
| aaatttaact | ttatgtttac | cgggttcgtt | tacgggcgaa | ccccccggaga | ttttcccgtg | 7980 |
| ggaattgtag | cgactgtatt | aagtaatgat | ggtaaggatt | taaaagtaga | tcggggcaac | 8040 |
| ggggacaacg | taacggccca | gcagttcggc | ccgtccggtg | atgatgctcc | cccgcttaaa | 8100 |
| aatgattatt | cggttttagg | atcggccaaa | ggttcaggca | atgccagcgc | cgtggcctat | 8160 |
| cgtgaccaaa | aggccgaaaa | ctacatagcc | aaagcagggg | aaaaacggat | ttattcgcgg | 8220 |
| gatgaatcgg | gggcggtaaa | agctgaagtt | tatttaaaag | cggacggaac | cgcggagatt | 8280 |
| aaaaacgcca | gcgggctttt | tgttatggag | ccgggcggtg | atgtggtaat | aaatgggggtt | 8340 |
| agaattacta | aagccggagt | tattcaaacg | ccgggcgggg | cttcaatgag | ttctgatttc | 8400 |
| acaaacgcgg | gcggaataac | tttgggcgac | catgcggccg | atacaagttt | acataagcca | 8460 |
| taaggggggaa | tagtttttaa | tgtctttttt | tgatgtgcat | ttatttgatt | cagtcgatgg | 8520 |
| cggcaatgta | acggatgatt | tagaaacgcg | ggacggccta | gaaacggctg | tttatctaag | 8580 |
| tcttttttggc | ggtaatgcct | tagatgatgg | aaggccccaa | aaccttttcga | cgtggtgggg | 8640 |
| gaatattggg | gagaatgaag | cggcaaagca | atataaaagc | gaagccgctt | ttttgcttcg | 8700 |
| cacggttccg | ccgaatacag | ccaatttaaa | gcgaatcgaa | gcggctgcat | cgcgggatct | 8760 |
| tgcttggttg | attcctgaat | atgtgaataa | gattcaagtt | aaggcgttta | tgcctaaatt | 8820 |
| gaatgcggtt | aatttaacgg | tttctttgga | tggtttagat | ccgttgcaat | tccgtacaaa | 8880 |
| ttggggcgaa | aaggttaaag | agcctgttta | tagactattg | ccgcctaaag | tttcccgaaa | 8940 |
| taatgggggtt | aatttagaag | gcacagcaga | aacaaaaact | aaactaattc | ttatccgtgc | 9000 |
| cgatggatca | agattaagta | cgctggttga | tggttcaggg | aattggaaat | ttgattttta | 9060 |

FIG. 16F sequence.txt

| | | | | | |
|---|---|---|---|---|---|
| ccctttatat | ggtggtgaac | gtgcccggat | gtatgttgag | ggtgtagggg | gtaaaatatc | 9120
| cgctattgtt | acagttatcg | gggttttacc | gcttcgctat | gatgggatgg | caatttatga | 9180
| cggtacgcac | aaatataacg | gagttagatt | aaattaatga | gtacgccaac | gactaaagaa | 9240
| atatcgaacc | gtattttatc | caagttagaa | acgacattcg | ggcaaagttt | gcctaagtct | 9300
| tttacacgtg | ttttatccac | ggttttgggg | ggtgtgtttg | taattttata | taaatacggt | 9360
| ggttttattg | ctttgcaaat | gtttgtttca | acggccagcg | ctaaagatac | ggactttaac | 9420
| ggcaaaacaa | ttaacccatt | acgcgaatgg | ggccgcctca | ttggggcggg | tgatcctaat | 9480
| ccagccgtta | atgccattat | tttaacgcgg | attgtagtag | aaaagccggg | cgagatattg | 9540
| cccgcaggga | cgcagctagt | aaacagcggc | aacggtgtta | catacattac | caagaagat | 9600
| attgagctag | tcgaagggc | gcaagatatt | gaagttttag | cggcttcgga | tacttcggga | 9660
| aattcaggcg | caggcaaagc | gggcaattta | aatgcggggg | atgttttgac | ttttgcgaac | 9720
| ccgcttggat | cggttggccg | ttattcgact | gtggtaacta | caattcggga | aggcctggac | 9780
| gctgaagcta | tcgaaacata | tcgcgcccgt | gttgtttcac | gtttccaatt | gcgcgctcaa | 9840
| ggcggggcaa | tggtggatta | taagatttgg | ggcgaatctg | tttccggggt | tagtcgaatt | 9900
| tatccttata | cgtccgattt | gccgggccaa | gtggatattt | atgtagatgt | tttgggaggc | 9960
| gtagcaagtc | aagcgatttt | aaatcaggtt | aaaaacgccg | tcgaatttga | tgcaaataac | 10020
| gggcttgcac | aaaaccgccc | tttaaatgcg | ctggtaaatt | atttaccgat | ggagtttgta | 10080
| gaatttaacg | taacgattag | cggtttaagt | gttgagggcg | cgctatctgt | tagggctgaa | 10140
| attagagcag | ctttagaaca | ttattttaat | atccgtgcgc | cgtatattgt | gggccttcct | 10200
| actgattcgc | gcgcggaccg | aatcacattg | gcggccgcgt | ccggtgttgt | ggacgatgtt | 10260
| gttaataaag | ctgggggcat | ttttaacgat | atgcagttat | taaggggca | aacgccaatt | 10320
| tcttttttata | tgttggggat | tggtgaaaag | gcgactttgg | taaacgtcga | gtatctataa | 10380
| tatgaatatg | tttaagcact | tgttacccag | cggccgcgct | tggaacctaa | ccgcggaaaa | 10440
| gccactaaag | gcttttttcc | gttgcttgga | tgttttgaga | acggacgcag | taaattattt | 10500
| taatttgctt | tttttagata | taaacccaaa | acaacgcgc | ttacttgatc | aatgggagca | 10560
| gcaattcggc | attaaccgag | gattttaac | cgaggccag | cgccgggaac | gtgtcgcggc | 10620
| cgcttggcgt | gatgtgggcg | gacaatcccc | ggcctacatt | caagaagttt | taagaaataa | 10680
| tggctttgat | gtttatattc | acgaatggtt | cgatccggca | gatcgcgggg | aagtaggtga | 10740
| aaaacagcct | ataacgccac | gtaacccgct | gtcgattatg | tcggcccaat | atgccgaggt | 10800
| tttgcccgtt | gtggattgtg | gcgaaccgct | ggcgctatgt | ggtgaagaat | ttgcacatgc | 10860
| cggaaattat | ttgggccttg | ttgggtatcc | gcttgttaat | aagttcgttt | atgacgcgga | 10920
| taaatacggc | tacactgtcc | ccgttgatcc | ggcttattgg | tatcactttt | tttatgtttg | 10980

FIG. 16G sequence.txt

```
tggccctaat tttggcgatg tggcccaagt tgaagcaacg cgacgcgctg aatttgaagc    11040
gctaattttg agaattaaac ccgcgcactt atgggcgggc gttattgtga gatacgttta    11100
atatgtcttt agtgtttaat gagaaatttc ccggaaaaac ggcaggggct acacaaaatt    11160
acccgtatgg cgaagcgcgt aacgtatcag gccccggaaa tggtgacggt acgccgtggg    11220
atgcggccct agtgaatgat attttggat tacttcaagg gcttttagtt cgtgccaata     11280
ttcagccgaa cggccagtcg gacacggctt taaactcgca atatttacaa gccttgcttg    11340
ccctgtttat gccgaaacaa acgccaattt ccggaaagtt agagcaaaac ggatatttaa    11400
ctatcccttt ccctgttgta ataaacggcc aaacggtaga gcgtgaattt acaattcaat    11460
ggggttctaa ggattggtct agttatccgg gtgaaattca agattctatt gttttgaaa    11520
agcctttaa aacagcctgt tttggtgttt ttccaatccg aaaaatgtcg cagcattccg      11580
cttatggtga tggtggtgtt aagcctattt ctgtttctaa aaccgggttt acagtttctt    11640
tgcaagccta cgggggttct gtgggccact tgttgggtta ttattggttc gctgttggtg    11700
tttaagttag ttctgatttt atggggtaaa tgatgaatct atttatacaa ggcatttatt    11760
tactatggaa ccaatttcaa cgggtggcac agccgctttt ttaaaggttt atggggtgtg    11820
gttggcggtt gttaccgctt tggtgtttgt tgctactgtc gttttaatga tgcgtttacc    11880
acgtagccca caagagttcc ttgtgggcat tattacgact gtcgtttcaa gtctaatggg    11940
cggatctttt ttaattcttt attttgattt acagatttgg gccaattcag cttatggcct    12000
tatggtaatt ggtgggcttt actttgtggc gggtattccc ggctgggctt tggttcgctg    12060
ggtgtttaat tttattgatg cgcgggaagg ttccacacta ttggacattt tccgcgaatt    12120
taatgaagaa tttagaggcg ggaaaaaatg agtaaaatta ttgcgatttg cgcggggcat    12180
agtgataaag atccgggcgc ggtaaatggt aaacgtaccg aggcggccat tgttttagat    12240
atgcgtaaga tggttgccag ttatttggaa aaagcgggcg tgaaatattt aacagacggc    12300
aaaggcgggg ttaatcagcc attggccgaa gctatcaaag tggcaaaaca agccagtatt    12360
gctgttgaat tcactgtaa tgccgctaca tcgaaaaaag cgaccggggt ggaggtttta    12420
tccgctgaaa aaaataaggc cctagcgaag caaatagcgg ccaaaattaa cggggtttta    12480
aatattccgt tacgtgggga agtggttgg aagtctgaag gatcagggca gcatagccgc      12540
ttaggtttta ttagttccgg gggcggttta attgttgaat tgttctttat ttccaatgat    12600
gacgatttag cgaaatggga cgcgaaaaaa tggcttgttg ccaaagaagt ggcggccgta    12660
ttgattgaac aagtaaaaaa ggcggaggcg gcataaatgg cagcattaac gatatttaac    12720
gcgatttcag aagttacaag ttttgcaggg gtggcccgtg agattttcga cacagcagcc    12780
aatgcaatgg acgcggccca aaatgagaaa aaaggcggag gaaataaaaa agtttgggta    12840
```

FIG. 16H sequence.txt

| | | | | | |
|---|---|---|---|---|---|
| atggcttaca | tggaatcatt | tattaatgat | ttgggcgaaa | attgggaacg | atgggccaaa | 12900
| gctattttt | cttttattga | ttttgccaag | tcgattttta | atagtaagcg | ctaataaaaa | 12960
| agccccgtat | taattcgggg | ctttttatg | gttccacgtg | gaacggttta | gcttttcttt | 13020
| ttgcttgccg | ggtttcttaa | taaacgatct | tttttgatct | cgcttacaat | cccgtcgatt | 13080
| aaaaattcca | tgcttgttcc | tttggttggt | gggttggttc | agatgattta | attcgagttc | 13140
| ttagggccgc | ttttacaatc | ttatccgcca | tgcgccctat | ttgcgccttg | tggcagttat | 13200
| tacacgcgca | tccggcctta | tatccccgaa | cggttccgca | gcctttaacg | ggcttatatg | 13260
| cgtcccctgt | cgtttcttca | ataaaatcta | tggttgattt | gtccgccgtg | tttcgcatcc | 13320
| tttacccta | agccgcagcg | ggagcaacgg | ccatttttaa | ataaggtgaa | tgtttggcaa | 13380
| ataaaacaaa | agttagtcat | ttttgccgtt | tgccttagcg | attcgcatta | cattaagggc | 13440
| cttttgcttt | agatccgcgt | atagctcatt | agtaaggtaa | ctttgtgcta | catcgtgaaa | 13500
| agtagataaa | aaatgcgtgt | cttgttttac | cttgctttgt | ttaagttccg | cttggtttac | 13560
| ctgaattaag | ccaatagctt | tgtttgcctt | tttgattaag | ttattcacgt | cgcttaattg | 13620
| cgcgtttatt | ttggcctctt | tttcgccttt | tatgtgtgct | ggggccttat | ccatcaaaag | 13680
| ggcttcacgt | tggccgttta | ggtgggtttt | taggcccgtt | aattcctcta | ttgagaattg | 13740
| ccccgccact | tgcaaagtgg | ttaatgctga | aaattcaatg | attgcggttt | taagttctgt | 13800
| tttagtcatg | ggtagcactt | catttaaaaa | gtattaagcc | cagcagcagc | cgggcaatgg | 13860
| tgggttagat | ttcggttaag | ccgtgttttt | tcattttctt | aataacggtt | aatcggttaa | 13920
| tgcctaatat | tcgggatact | tcggcaatat | tatatttga | atatttaagc | gctttttcca | 13980
| aaacgcactt | ttcaatagga | tctaatgcag | ccgctagagc | ttggccggaa | ttttcataaa | 14040
| aaaaattcgc | gtccaaagca | tccgggttaa | ataaattagt | ggtttcgctc | attcggatat | 14100
| tccttaaatt | gcgcgttata | ttcagcgaca | aattccgctt | gtttgtcgat | ttcatcggct | 14160
| tgtttgataa | tgaacatata | agacaaagcc | gcaagcataa | aacagaaaaa | caacgtgctt | 14220
| aaaatctctt | ttattttgc | gccgtggttc | gctgtttctt | gtgaaaaatt | gcttaattgt | 14280
| tgacgctgaa | taactggctg | tttcataata | atcggactcc | atgaaattag | aaaaaagccc | 14340
| cgtagccgtc | caaagttccg | gggcttttg | ctgtctatgt | gttgcataat | atacaatata | 14400
| aataaaagt | aaatagagaa | attatagata | ataaataaaa | taataaaat | agataaaaag | 14460
| tattagtttt | aattgtggca | tgaatatttg | ataagtgtta | aaatttgttc | taagcaatca | 14520
| tgctgaaaat | aaaaaacccg | ccggacgggg | cgggttttag | tttgtcttga | gggtataaga | 14580
| cgtgaaaaag | tttaacacga | aatttaagca | aaatcttgat | gatgcaaata | acaacgcatt | 14640
| tattccgaac | agctttcaaa | ttacaaatgc | tttcgttgat | aacatcatgg | ataaaatttc | 14700
| ggatgcagca | gtaaagatct | atttaattac | agtgcgtaaa | acaacgggct | ggggtaagca | 14760

FIG. 16I sequence.txt

```
gatagattcg atttctttaa gccaatatga agcgtatagc ggcaagtcgc gccctactgt    14820
tgttaagtgt ttaaaagagt tggttaaggt gggtttattg gtagagcata ccgggacacg    14880
gtacggtaat tcgtattcgg tggcgcttgt aaatagcatc ggtttcgagc ttttatctgc    14940
tagtaaaaaa attttactag taaaaagttt taactacact agtaaaaaat ctttactgcc    15000
actagttaaa attttttaaca cacaaaaaca actatcaaaa aacactaatc aaaaacaaat    15060
aaataagcgc gattggtttt ctttaaaaac tttaaaagat gaattgttta aaaccgggtt    15120
gcaaattgag gctgaagatc taacagcggc taaatggttc gatagagaga aaacagcctt    15180
tgaaaactat gcacctaatc aaaaccttc agatccgcaa aaaatgtatt acttcgttga    15240
ttggctttta aaagcaaagc gcaagtacga cgcagcagag cgccagcaag cagctaaggc    15300
aaaagcggaa ggcaaaaacc aaaatcaaaa ccctgaagat acaaaaacag aaaacgaccc    15360
ttttaaactt tctactaaac aaatttcatt ctttgctagt cagttagccc atttaccatc    15420
atttgcaaaa tattgcactg gtaacaaagg ctttaaagaa tttgaaatgt ggattgcttc    15480
aatgttgaac aatcctgaaa atgttaaaaa gtggaataaa tatttaaatg aattgggtta    15540
tttgatcggg taatcagggg gattaaaaac aatgaagatt tcaaactttc attttcaaat    15600
gcaaatttta cttttgattt ctaaaaacac ggttttagat tttgagggat taaaagagaa    15660
gttagcgccg tcgattacag acaacgcatt aacggaatgt ttagaagaat tattgatgtg    15720
gggatgggta caagtacaaa agggccttta catggtttca ggcgttgctt atcagatcat    15780
ggggatatt tgccaatgct gatagacaaa tatttctatt aatcggcttc gatacggatg    15840
caatggaaaa atacaagtat tcagaatcaa acgccgtatt aagcccgcat ttaaattgcg    15900
gcctaacttc agttagtcgc gttggatctt caggccaagc aaagcataaa ccgcataagc    15960
gaagtgaaat agcagatcag gcagaaaaag agatttgcaa gaattgggcg ttaagacaac    16020
aagcattttt aaataacagc gtaagcaacg cggtactagg gggctaatat gaacaagttt    16080
attcacattg agggcaaacc aacggcccag caagtacgcg aagcgctggc aatgtatgca    16140
aaagacatta acgcccgga attttcttta attgttcagc gtgagcttat cgaatcattc    16200
cgcaacgata cggcccacgc ccttaaatcc gcagttgcct tttattttaa aaatcgtgtg    16260
atccaacgcc ccggccttgt gttggcaagt ggtaaagatc aagcgcttat tgttgagagt    16320
tgcgaaaata aggcattaaa gcgccacttg gtcgcggtgt cggggtattc atcgcaattt    16380
ctgcaaatgg tgatagatca taaacgcca ctttcagccg ttgccgcgcg ggatctaaag    16440
caggcattac caaaagcgga aaaactctat aaggccgaat gcaaggaaaa agatgcaaaa    16500
ttaaaaaaga atatttgcgg ttttgtcgct tgctatagaa atggctgtca ttgcacaaaa    16560
tgcaccacgg catataagaa atatcgctaa aagcaagcct atcttttaaa gagaaaaagc    16620
```

FIG. 16J

```
                                sequence.txt
gcagttcgcg ccgtggccgc ttagtgtttc acgtggaacc aaacaacgcc ccggattaaa    16680
cgtccgggga tctaaaaaag agtaaggaaa aggaataaaa atgggtgttt cgattattaa    16740
tttagtttta ttggttggtg tttgcttatt gctaacaaat atcgccttaa attgtttgtt    16800
tcataccgaa aataaaacat atctagtcta tgcgtgtggt tttagtgcgg cttcggtggc    16860
gggtgccatt gctggcgtta ttggttgttt ggcttatggg gtaacagtgt aatgaaaaat    16920
aaatcaattc ttatgggcct attcgttgcg gccgctggtg tggtgtttta tatggggggcg    16980
gatagtgctt gcaatcaaaa ggctgttata gatccgggcg cgcttatgtc gcttggtggt    17040
atcactgttg aaaataaaaa agcctcattg gttcgcgtat gtgatacgcc agtaaaagaa    17100
aaccttgtga gctttgtttt gattaaagac ggcttgcgcg tgggtggtgt ggtcgataaa    17160
agccatgttg cgctcatagg tgaataaatg agtttaggaa acgccccgc aggtgcgacg    17220
catatagaga gcgacggcac atattggaaa aatgaggacg cggattggta tttttggcgt    17280
gacttgtggg gctggtgtca atatgtcggg ccaaagaata gaaattttt aaataagttt    17340
tcggtgttgg ggtgatggat ttatatattg gtcagattgt cgggcatagt tcgcccactt    17400
gggttgttca gggaaaattg aagataacca aaattaacga gggtaagcga agcggtttaa    17460
agattattac ggctacagat gaatcgggta aggaatttac cgcagtttat ggcgtgtttt    17520
ttagtgttga tagatattaa ttaaaatttt ggggtaatac gtgagaaacg aaaactttga    17580
agattattta aaacaaacgg atgattacgc cgtattactg aataattacg gatctagtct    17640
atttatccat gaaaatggcg tttatcgcgc tttgcctgtc cgggtggctt atgccgcttg    17700
ggtatcgggc ggggatcgct ggggagaggt gcagcacttg aaaggcaaaa ttaagaaaat    17760
ggccgaacgt gcagcagaaa cagcggattt ttaccatacc aaaatagaaa aattggaaag    17820
tagcacggtt aaaaaggcgg gtttattgga tatggccgaa caatgggacg gtttagagtt    17880
gcgcggacgt gatttggaat taaaccgggt gcaagaatca atttataagc gttgtgctta    17940
tttgttgcgg gtggctgtta atgggtaatc ggtggacgtt aagcggaaag gtaaagggt    18000
taaagatttt gcccgaaagt ataaccgcgg cacaattcag ggaaatgata gaacgggggc    18060
aagtcaaaaa cacgccacaa gccccaaaaa agcgccgtag cggaaaagta agtagtccgg    18120
gggaggctac attagcccaa gccttaaaag cgcttaaaat cgaatttgtg caagagtatc    18180
gcttttgtga atatcgcaaa tggcgcgcag atttccatat accggggaca aacctttaa    18240
ttgaggtaga aggggcgta agatccggcg gccgccacgt gcgaccacaa ggctatataa    18300
acgacacgga aaaatataat gaggcggcta agttgggctt tgttgtattg cgctttgata    18360
cggaaacggt ttcacgtgga accgcaataa acgaaataga agttatttta gaaaggcgcg    18420
gatatttcca aaataagggg cttacttgtg aagaaagtta aaagtttaa atacgattgg    18480
cgcgccgtgc cggatcatat taattggctt gcaacgtatg aaggcgggga aatggcctgg    18540
```

FIG. 16K sequence.txt

```
gggtatgtga ataaaccata tagaaaagaa aacgcgggga tatggtacga aacgggcgga    18600
gagtggcggc atcgtgtacc tgttgcccca tatcgcggcc attggacgca atcattagaa    18660
aaacgaccta gcaaggccca gctagtcgag tgggttttaa atggggctgt agtggtttaa    18720
tattcacgaa ccctcataga gtgttttata acattctgtt ttacaagcct cattgcctat    18780
agtgaggctt tttttgctt tgcggtttga ttggatttt aattgttctg tgaattttgg     18840
gctaatatta gaaaaccgca taggcggcaa cgattgataa attagagagt aaataatggc    18900
tgaaaatagt tttattcaac caattgcaag aaaggacgcg attgcccta ttggccgtga     18960
tgagcttgtg aaggtgggc cggaagggc agcgaataaa caagcaattg cacttgcaaa     19020
taatattaag tatttaatgg gcttaattcc tgaaaattgg ggggtggaaa aaaccgaata    19080
tggtttagat gaagttgtaa ggctttcaaa tggtgacgtt gttaaatctg ttattgatga    19140
aaatatcaat aatccgaacg agaatttgtc gggttggtct tttgttacaa gtaattcagt    19200
aaatactatt tctgatttat taagtattaa aaatccgaaa aatggaatga agtttatgt     19260
tcttggatac cataaaccgg ataatttgc tcttttaagc ccgtatgaag ggggcgggct     19320
tttcatatat agcgggaata aggcagcgga aaatgatggc ggcgtggttt aaatggctg     19380
gattcgtcaa tatgttggcg atgtggatat ttcttggttc ggagcaaaac aaggtcaaga    19440
cgcttcgccg tttattgaag cagctttaaa agtgaaaatg tcaattgtga ttcgtggaga    19500
atacaagtta gaaacaattt gcggcatacc aagacaaaat aactatgcgg caaaagttat    19560
tagaattaag ggggaaaatc aggcttcgct tactgtaaat tgcccggatg gtgctgtttt    19620
tacttcgtta gatgcaaaag caaaccctac aagtttatcc aatattttta ccgcaaaaat    19680
tgacgtattc gggattaact ttgtaggtac aacggttgca aattctgttc tgtttaatgg    19740
tgatcgttta tacaatatta atattcatca caataatttc aaaacaaata ttacaattgt    19800
taaagcgtat ttaaagcgcg aggcatcaag acaatatacg caaagcgttt ctattaatca    19860
taatcactta gcggaaattc accgggttat tgagtcggac aagtcttata acttcgattt    19920
tgcatacaat atgtgtgaag cgtgtaaagg tggcatgtat atcggtgttg atgcgcctta    19980
tgatccttca ggtatttcta taacaattca tcgaaattta tgggaagcca gcggggtttt    20040
attaaaaaca aatggcggga ttattgctgg tagtgtttca aaaaactatt ttgaagctaa    20100
cgtatatcaa gatgcagcaa ttgataaatg cttaatatat atcaaccgaa gcggaacggg    20160
ggcgggttat tccggtggtt aactttga aaataattta ttttcaggga cttcgtcgat     20220
tccggattat gttgatgtgc gcgttttggg tcaaagtaca gaaacatcgg gaaattcaaa    20280
atctgctact acgcgaccgc ctgtatttat tggtaactgg tcaaatagtt acatgctaac    20340
aaatatggcc caagctattt tgatcggtaa taagtgttct aaccgcgaaa aaatgctgaa    20400
```

FIG. 16L sequence.txt

```
tgcttacagc ccgcaagaag cgcgcgttac ttactattcc ggctattta ctaagcaatt    20460
ggctaatatt ttaaccgata aaaagttaaa tttattaaag gtgaatactt cagcagttca    20520
tgctattggt tcctctcaag ctaactttaa aactacatta gacgttattg tattctttaa    20580
aacatccggc gcagttggaa cagcaatggc gacttttaaa ttagatttat ttgtttacga    20640
atcagtcgga cttggcgctg gcaatgttcc aaaagcaaac ttaaaagccg tgatgtataa    20700
tttatgcaa tccaccgcag acgacaaaat tacaccaacg gttaatatgt tttcggctat    20760
ttctgatccg ttaattaatg ttgttgataa ctcagacgga acgtatagca ttgagctttc    20820
gagttttact aataaatcat cgccaaactg ggggtttgtt tctgaattgc atattgaata    20880
cacggcccaa gcgacgctta tagcttcgca tacatccagt tattcagcgg ctaacttatt    20940
aaccatttca taaacttaat taatagctaa ctaaggggga gcgccaattt tgtttttaag    21000
attggcgctt tttttattgg ggttttatgt ttgatataga tacaaagcaa ttgcacggcc    21060
tggagaggcg tttagagcga ttaaaccgcc gtggcttgcc ttatgccact aggcaaacaa    21120
tgaacgatct agcgtttgaa tctcgcgccg tggcccgtgc cgagttacca acgcgcatgg    21180
ttttaagaaa taaacacgcg attaatagca ttcaagtaac taaagcaaca tcgctaaaca    21240
tttcccagca agccgcgcat gttggatcta cagccgacta tatggcaacg caagaaacgg    21300
gaggcattaa aaccaaacaa ggcggggccg ccgtgtctat tccgaccacg acggcagcag    21360
ggcagggcag aaacgcaaag ccccgaaccc gttaccacg tgcagcgctc aaaatgggcg    21420
ctattcacct aaagcgtata gcggcaagcc gtaacgctaa gaatcgtaaa caacgcaatg    21480
ccattgctat ggctacatcg gataaatatg tatttctcga tttgggccgc cgtaaaggta    21540
tttttagaaa ggacaagggg ggaggggtaa caatgttgca tgatcttaca cgcgcatcgg    21600
tgcagatccc taagaatgaa tggctgaagc ccgcgaccga ggcagccgaa cggaagttac    21660
cgggattcta tggccgtgct ttagagttcc aattaaggcg cttttaatta accaaaaact    21720
taacttcggg cggttcgggc gggtagccgc ccgcggttaa gttaaagaat ttttcgcaca    21780
aaaagccacg gttcgcgccg tggttttat ttgtctttat cattcacgtg atgaatggat    21840
ttatttttaa aatcaatagt ctgaaataaa aaaaggtact gtgccgaccc cccacccct    21900
tgccgttttg attgcgacgc gcgggccgcg cacaaattca gaattttaa cttgtcttaa    21960
cttcgggcgg gttaaatgtt aaatttcgca tcatggttaa aaagttaatt tctcgcagcg    22020
attttgctgc taaggcgggg gttagcgggg cggcaatcag taaggcatgt aaagggccgt    22080
tattagatgc tgttgagggt aaattcatcg acttaaacca taagtcggct atcgcttact    22140
tagaatcaaa gaaaacggc aagacaacgc cagcacttga ggggattgat tcgctatatg    22200
aggaagcatt agaagtttgc agagaagcgg gccgatgctc gcaaacattg ttgcgtgaca    22260
aattaatgat aggcagcgac cgggctagaa agttggtcgc tttaattcaa aacgcaaata    22320
```

FIG. 16M sequence.txt

| | | | | | | |
|---|---|---|---|---|---|---|
| tccaagattt | tgaaaaacca | gcagccgaaa | aggtaaaaag | agaggagaaa | gcgcgcccgc | 22380 |
| atacccgcgg | gacggctgca | aaaaaacagc | aagcaattca | agaggacgac | gaagaattat | 22440 |
| ttgagctgtt | agatcggaac | gtagcgcaat | atgcagatat | gacgctaagg | gacattgtta | 22500 |
| ggaaattcgg | gacggcaacg | cgatttgcgg | aatatcttag | agcaatgaaa | gaaatatcaa | 22560 |
| tgattgaaga | tcgggaaatt | aaaatagccc | aaacaaaggg | cgagctagtc | catagggatc | 22620 |
| tagttagtca | attgatcatt | gagccgatag | attcggccca | tgtaaaactt | atgcgggacg | 22680 |
| gatctaaaac | aatagccgtg | cgaatggcag | caatgcacgg | cagcggggcg | gacattaacg | 22740 |
| aaatgcagtt | agtcacatca | gaattaattg | caagtttcat | taaacccgta | aaagccaaag | 22800 |
| taaataaaat | cgcaacggaa | ttaaaacgag | gggctgaagc | gtgaatatga | attttatagg | 22860 |
| tatggattgg | ctttgcgata | aagtcgagaa | tctaaccgag | tatattaagc | acgtaacgcc | 22920 |
| cagccaattt | aatgaagaaa | atagatattt | gcccgaatct | gtgaccagta | ttccgggctt | 22980 |
| tatccgttac | gacgtaaacc | cgtttatgcg | tgaaattgtc | gattgctttg | atattaattc | 23040 |
| acctgtccgg | gaagtgaatt | taaaaagggg | cgtacaaatt | acatattcca | cggttttaga | 23100 |
| atccggggct | ttgtactata | tgggccacgt | taaaaccttg | cccattatgt | atatgacggc | 23160 |
| cgacaaggaa | ttagcaaagg | cccgtattga | aaacaacttt | atcccaatgc | tggcacagtc | 23220 |
| ggacatggcc | cacattgtcc | gatcaagcga | cgaaggtaac | agcagaaaaa | cgggtaaaac | 23280 |
| cgataatcat | atccaatttg | agggcggcgg | ctatttggtt | ccattcgggg | ccattaatgc | 23340 |
| aaataaaatg | cgttcgtttt | ctattgctgt | catgctcaag | gatgagattg | acgcgtggcc | 23400 |
| ggatcgcgtc | ggaaaagatg | gcgacccgga | taagttgagt | gatgaccgtt | gtagcgccta | 23460 |
| ttgggaacgt | cgaaagattt | tccgaggttc | cacgccctta | atcaaaggat | cttcaaaaat | 23520 |
| tgaaaaagca | tacttgcgcg | gggatcaaag | aaaatatcac | gtactttgta | aaaaatgcag | 23580 |
| tttcccgcag | gaattgcgat | ggagtacgcc | ggacggtgta | ggcggtttta | aatgggacac | 23640 |
| ggacgaggac | ggaattttaa | aacttgattc | ggtgcgctac | tgttgccagc | aatgcgggga | 23700 |
| gccacatttc | gagcatgaca | aagagcgcct | atttagtgag | aaattcgggg | caaaatggat | 23760 |
| accaacggcc | cgccctgttg | agccggggat | tcgttcctat | catttacccg | cgttatattc | 23820 |
| gccgtttggg | atgcaaccgt | ggtacaagtg | cgtgattgct | tatttagacg | cattcgaccc | 23880 |
| ggtagagcgc | aaagtaaaag | acatagagct | ttaccaagta | ttttataaca | acgtattggc | 23940 |
| ggaaccgttc | gagattcaag | gtgctaaggt | tcgctttgaa | acggtttcgc | atcatcgccg | 24000 |
| cacagtgtac | cgattgggcc | atattccgaa | ccgttacgcg | gttcaatatg | ctggatcgcc | 24060 |
| tatcctattt | ctaacctgtc | aagtggacgt | acataaatca | ttcttagccg | tttccgtgat | 24120 |
| gggttgggcc | aaagatgcta | aatgttttgt | tattgattat | ttgcggatcg | agggcgagga | 24180 |

FIG. 16N sequence.txt

```
cttttccgat agcgcggaac cggggttgggg taaattgcgc gagctaatcg aagaaaagca    24240
atatattgcc gatgacggta aaaaataccg cgttgctttg accttcatag attcgggtta    24300
tgctaacgat accgtcgtta aatttttgttc tgaatattcg agttcagtct atccaatttt    24360
gggccgtgac cgaccaagta aaaaccaagc aattaaagaa tttgccgact ttaaaacgca    24420
agaagggaca acgggcttta gaattattgt cgatcattat aaggatcgtt tggccccggt    24480
gttgcgtcgt gaatgggacg agatgggcgg aggtttacag cctgtttatc atttttaatgc   24540
gcctgtcgat ttgtctgata agtcattaaa agaattgacc gtagaaacgc gcaaggagaa    24600
aaccgacgca agcggcaata cttcatatttt ttggcatcgc cccggcaatg cacgaaatga   24660
gctttgggat ttgctttgct atggacatgc agccgtcgag attttcgcgt ggtcgctatg    24720
cgttaaaaat atggaacaaa aggaagtgga ttgggcttgg ttttgggaat ttttggaaac    24780
agaagcccccg tattttgagc aaggcgaacc cgtcgccagt gagtaacaaa aagcccgcta   24840
aattagcggg ctttgtttca cgtggaacct tataaaacgg ctataaaatc gaaatgcttt    24900
aggtttaagt gatccggggt aaaccaagtt ttaacccaca taatgcgatt gaaggttagc    24960
aagcggcctt tttgttcagc ctccttaaaa taggcgattc gatccccttt tactgcgacg    25020
atggtcgcgc cttcgggttt atttcccttc agcttttcta aattattttc atattgcatt    25080
ttgttagatc cttaaaaaat gtttaaacct tgattattaa aattaggcgt ttggcattgc    25140
ggcatatttt tagcgatgct gttgtaagtg ttttgcgtca tgtaaatttt accgtcaaaa    25200
gcaatcgtgt tttgatcggt gatttgcacc gggtagccgt gttgctggat cgttgcgcca   25260
gcttgtacga tttcgatttt atggccgcgc caattgttaa aagattggtt attcatgagt    25320
ttggttcctt aaattaattt gttgctggta ggttatatttt accgtttgtt tgtgggccta    25380
atttaataag attgtgattc tcattaagcc cataaggtaa atgggttcgc gggtttaatt    25440
cggttttatc agtaataaaa atacattcat gcggattcac gttgtaaaga taggcgacca   25500
tgcgcggggc tacataatgg gattgcttat catgttttga gcgaacccag ccgccgaaaa    25560
ctaaatatttt tttatctatc attttttgga aacagcctca ttttttaagt gttggttaag   25620
cagatcccgg acaagatcgc ccacgtttgg cactgtttca atgtattcga ttaaatgctt    25680
atcgcgttcc ttgagtagag aaaaattttt aattacgcgc ttttctcat aatcgctttt     25740
ttgcttttgc cttgcttcgc tttggcccat tatttacacc gttttacagc ttggttatat    25800
tgatttcttg caatgttgga gagcgttgta gttttggaat tattccgacc cgcttggcgt    25860
gatgaaccaa gcgggctttt ttttacattt cttcagccat aaacacggtt aagaagccac    25920
ccatatcatt ggcaaaaagg ccgatagatt caataatgcg ctttgcttcg tttagatttt    25980
taccttcaac cataagccaa acatcgcgtt tcactttata ttcagggcct agaattttt     26040
taagtggctt ggtcaattcg cgtggtgttt ttacttgagt gtttccgatc attaacattt    26100
```

FIG. 16O sequence.txt

| | | | | | |
|---|---|---|---|---|---|
| tgcaaaactc | ttatttatct | atttgatgtg | tcaattatgt | cgtattacga | caagcaaggc | 26160
| aatagggaat | gtataaaaaa | tatatatttt | ttaaaatggt | tccacgtgga | accgtggcgg | 26220
| gcgtttatgt | tgcgctttcg | ctttattgat | atactaaaaa | caacatagcg | ggagtattta | 26280
| aaaaattgga | tcaagcattt | ttaaaagaaa | ggatcgaagc | gacaaagcgg | caaattgtgg | 26340
| cctatgagga | tgcagtaaac | cagctttcaa | gcggtgcggt | tcaatcgtac | tcattaaaca | 26400
| cggggcagac | gacgcaaaac | gtgacgcgct | ttgatgttgc | gcgcctaaat | ggggatattg | 26460
| acgggcttta | taatcgcttg | gcgacgcttg | aggcgcgttt | aaatggttcg | ggttctactt | 26520
| tggttcgtcc | gggatggtaa | tagatgaatt | atgattttag | ccgtgggctg | gtaaaggttc | 26580
| cgacggtggg | tttaaaaacc | gagtttaaat | attcaggggc | tacaattgca | ccgccgccaa | 26640
| tgcagggcgc | aaaatccgac | gctatcgaaa | taaacgcgct | gggcggtggg | ttcaatcatt | 26700
| ccgcttttac | cggggaaaaa | tttataggcg | gtttcgggcc | tacaagttta | tttactatgg | 26760
| attattggac | gttacgcaaa | agatccgagc | agctatttag | cgaaaactta | tacgcggccg | 26820
| gattaatcga | gcgtttagta | acaaatgaaa | taaacacagg | attaaccccg | gaggcttgtc | 26880
| ccgatgaacg | gattttggga | ttaaagccgg | gtgatttaga | agattggacg | gaattagtag | 26940
| aaaaccgatt | ttctatttgg | gccaatagtt | cggaatattg | cgactttttac | ggacaaaaca | 27000
| gcttagggga | aattcagcgg | atcgcaagac | gcgaagccct | tatttgtggt | gatgtgctgg | 27060
| tggtgttacg | ccaaaaccaa | agtaccaaaa | tgccgcaagt | tcagcttgta | agcggatctt | 27120
| taatccgaac | cccgccggat | atcccgcgca | aaggccacaa | aattaaacac | ggtgtcgaat | 27180
| tagatacgca | aggccgccag | tgtgcttatt | gggttttaca | agacgatgga | acctataagc | 27240
| gtttgcccgc | gtttggtgaa | aaatcaaagc | gccgcattgc | gtggatggtg | tacggagcgc | 27300
| aaagacgttt | aggcgaattg | cgcggccagc | cgcttttaag | tatcgttttg | cagagcttaa | 27360
| aagaaattga | ccgataccgc | gacgcggccc | agcgtaaagc | cgttgtaaat | tctatttttgg | 27420
| caatgtttat | tgaaaaaacg | caggataaaa | tgtccacgtt | gccaattacc | ggggcgcaa | 27480
| tccgacgtga | taaggttacg | gataattcaa | acaccgcggc | ccgcgtagc | tttgaaatag | 27540
| cttcgcaagt | tccgggcgtg | gtattgcaag | aattacaagc | gggagaaaag | cccgtaggtt | 27600
| tccatagtca | aggcacagat | attaactttc | ccgcgtttga | ggaggccgtg | attagtgcgg | 27660
| ttgcttggtg | caagcagatc | ccgccggaga | ttctaaaact | gtcgtttagt | tctaattatt | 27720
| cggcaagtca | ggcagccatt | aacgaattta | aaatttattt | aaatatggtc | tggaatgaat | 27780
| ggggcgctaa | cttttgccag | ccgatctata | ccgagttttt | aattagtgag | gcgcttttag | 27840
| ggaaaattga | cgcgccgggc | ttttttggacg | catggcgcga | cccggtaaaa | atggatattt | 27900
| ttgggggcttg | gttgtggtgc | gactggttcg | gcagtattaa | accgagtaca | gacatgcgta | 27960

FIG. 16P sequence.txt

| | | | | | | |
|---|---|---|---|---|---|---|
| aaatggggca | aggcttggcg | cttgccgtgg | aacaaggttg | gacgaccaac | gcccaagcat | 28020 |
| cgcggcaaat | gttcgggact | aagttcacta | aaaacattgc | aagacaacgc | cgcgaacgtg | 28080 |
| aattacaagc | cagccttta | aggccaatgc | ttgagctgca | aaaagaatac | ggcataagcg | 28140 |
| cggagcattt | agtaaatgta | gcccatgcga | ttggcgggac | aatttcggca | caaactgaag | 28200 |
| aaacagagga | aatttaatgg | attggttttt | aacgcctgaa | gccctaaaag | aaattcagga | 28260 |
| attacacgcc | cgcggcttgg | ttttgaccgc | ggagcaaatg | acggaattta | acgcgcttta | 28320 |
| ttcggatgat | ttccccggat | cgcgtatttt | tcaaaaagtg | gggacggttg | cacaagtaaa | 28380 |
| cattgccgga | gttctaacaa | aggaacctaa | ttggatgtat | cgctattacg | gtggcggtaa | 28440 |
| tacagcatat | agcgaaatta | tttccgcgat | taatgaggcg | gagcgcgacc | cagccattaa | 28500 |
| agaaattatt | ttggcgattg | atagccccgg | cggacaaaca | aacgggcttt | gttcagcgat | 28560 |
| ggacgcaatt | aaaaacacga | aaaaaaccgt | tttggccgtg | gtggaaggtc | aggcagcaag | 28620 |
| cgccgcttat | ggccttgcat | cgcaagcaaa | taagattatt | gccgcggatc | gcggttgcat | 28680 |
| ggtcggaagt | gtaggcgcgg | ccgcttcgat | tgttgttagc | gaaaatgttg | tcgatattgc | 28740 |
| cagtaccaac | gcgccaaaga | aacgcccgga | cgtgaccaca | gacgcgggta | aagcggtaat | 28800 |
| acgtgaaaca | ttagatcaaa | ttgaaagtat | ttttattgct | gatattgccg | ccgggcgcaa | 28860 |
| ggtaacggcc | gataaagtta | aacttgagtt | tggtcagggt | ggtatgtatg | ttgcggccca | 28920 |
| tgcccttgag | cgtggtatga | ttgacgaaat | taaaacggct | gattctagcg | ctacaacaaa | 28980 |
| cgcgaaaagt | tcagcaactt | acacagcaag | cgaggaaaat | tcaacaatgg | atgcagcaac | 29040 |
| tttaaaggcg | caattcccag | cagtttacac | agcaatttat | aacgaaggca | aaaccgcaga | 29100 |
| aaatgagcgc | gtatccgcgc | atttaacgct | gggcgaggct | tcaggcgata | tgcaaacggc | 29160 |
| tatttctgca | attaacgacg | gttcagaatt | aaccgcaagc | attcaagcca | agtatatggc | 29220 |
| ggcaaatatg | aagcgcggcc | aagttgctgg | gcgtgaaaca | gacgacacgg | ccgcggctaa | 29280 |
| tgctttggat | ggtgttaaac | cgggcgcgac | tgctacagat | gcgaatgcag | ttacaaacat | 29340 |
| ggttgctaaa | aatttgggcg | ttgcataagc | ccaaaccgta | aagacatttt | agaaataaag | 29400 |
| gggtaacagt | tgcatgatgc | aggtaacgca | gcacacaaac | agttcaatta | attggggtga | 29460 |
| agtagcttgt | caggatgaca | cgctaacttt | aggcgcaaac | gcaacgctaa | aagaaggcac | 29520 |
| aattttagcc | cgtgcagcaa | cgggaaaact | tatcccgttt | gttaagggtg | gcgcagatgg | 29580 |
| ggcggggtt | cctgttgcta | ttgctatgca | cgaaattaaa | accgtggccg | ctggtgatgt | 29640 |
| ttcagtacgt | gcgggcattt | ccggccaagt | gcgtaaaaat | aacttagtga | tccatgccga | 29700 |
| tggaaacgcg | accaatatcg | acggagcagt | aacagacgct | ttgcgtagtt | atggcattgt | 29760 |
| cgctttcaca | gtaaacagca | caaacaaacc | ggataaccaa | taaggaattt | ttgatttatg | 29820 |
| actactagca | caattgccgg | ggtatataca | caagttgcac | caaagccgct | atttttatcg | 29880 |

FIG. 16Q sequence.txt

```
ggcttttca  aagcaccgcc  acagaatcat  tttaatactg  aatctgtcga  gctggacatt   29940
gagcgcgatt cgcagcaagt ggccgcggtt gttcaatcgc ttggcagcga ctacaacaaa   30000
aacgaaacgg gtgaatttac caataagaaa tttacgccgc cagtttataa agaaggcttt   30060
tcgcttaatg cgttcgattt gcttaaacgt gaagcgggcc aaagcggttt taatacgcct   30120
agcgaacaga tccgcggcaa tttgattacc cgctttatta aaggcgcgcg aaaagttgaa   30180
gcaaagattt tacgcggtat tgagttgcaa gcatcgcaaa ttttgcaaac gggtaatttg   30240
ttgctgaagg atcaagaagg caaagacgct tttaaaattg attacaagcc aaaagcaacg   30300
cattttgtga atgttgcgaa tgtttggacg ggtgcgaatg ccgacccgat gaaagatctt   30360
gaatcattgt ccgaagtaat ccaaaccgac ggccttgtaa ttcccgatat tatcattatg   30420
ggcgcttcag cactggcagc ggctaagggt aacgagaagt ttattaaaaa ctttgattct   30480
cgcaatattt cgggcaatgt tttagctgat atgcaaatta cggcccgcgg tggtatctat   30540
caagggacgt tgcgcgtagg taatgccgtt tgtgagcttt acacttatgg cgtgggttat   30600
caggcttcat cttcagcagt tgcaacgccg ttttttaaata ccaataaagt gcttatgctt   30660
agttctgaat cgcaattaga cgcgcttttt ggtgcggttc caaacattgc ggacattttg   30720
ggcgtgagct tgcgcgaaca gcttttaccg gaattgccga cgcgctttga ttcaaacagt   30780
accgatttat ttacaaatgt gtatttgtcg gcaagtggtg agcagcttat gggcggggtt   30840
gctagtcgcc ctattcttgt cccgacggct attgattcat tcggctgttt aactgttgca   30900
taaaaattaa aatgaaccc cttcaatggg ggttttttct tttaaatttg gagatattcg   30960
acgtgactaa aaccgattta attaacgcaa ttaaagccat tgattcaaac gcgaaaacgt   31020
ccggccttga taaagacgaa ttacaagccc ttttaacaga attacaagcc aaagcgac    31078
```

FIG. 17A sequence.txt

```
<210> 3
<211> 167285
<212> DNA
<213> Unknown

<220>
<223> Description of Unknown: Bacteriophage F488/08

<400> 3
tctgaacgac ctgccatttt atccatgtct ccaccgtcaa ttattcttgc ttcttttca         60 tcttttgcta cagtgtaagg atttgctgat aaagcatatc taactaataa accgatagat       120
ggctgcaaac tttctgggtc aactacaact ttaaatgcac ctacatgttc agggtcatct       180
aagtcaagac cttctgtata cggagcatag aaaattgatc caacaatttc tttttcaccg       240
atattttcta ctacaccaac gattacataa tctaatgggc tgttagtatc gcaataaagc       300
ggtaaaccat tagctaagaa cccataggca ttttgtgaaa gatatttatc atcttctggt       360
ttatgtttta accaacctga tgcagcaaga atcgcagcag cacgagctga agcaacacag       420
aacgttgctg tataagttga ttctttttgg atatgcgaaa ccatttcaca taccattcgg       480
tataatgaac gaccagcttc aggtgcagat gcataactca aatcgatgaa tccagtatca       540
gtaattcctg taactttata gcgttttgac actgtaatca aagactgcag aatatcttta       600
ttgatttcat ctgccatttc agttgcaagc aaatcttcca agaaattagg agcatcgaat       660
ccatttgctt ctaaatcttg tgctaattca actgtgatac cagttttaag tttacgagat       720
ttaactgcgg tttgccattt attaatctgg aatctagcat ccgcaatttc actatcagag       780
ctttcaaatt tgcttgttga cgctgcgtca gaaaatagac gaacctttaa aagaacaatt       840
gcaatctgaa gagctaattc taaatcgctt tcttcaatat cagcaaatgg tgtatcttct       900
aatactttat aaacgatatt attatatttg aataaatcgc ccttattgag agttaattta       960
gactcttctg ttaattctgt gatttgttct cggtctacat atccagcttc gccggcgtaa      1020
gtagcaccag ttttaaatgt aaattcgtta tccgggttaa ggtatttgat accataaaaa      1080
gcagcaacag gttgattagt tctttgcgtt gctacaatgt cagaatatat taatttagtg      1140
gtagcgcgag tcaaagcaac gagatttggg cgaccgattg agttgctatt cgttgtggtt      1200
gattcgcgca gaagttcgtt gattttagcc attgcgcttt cctttcagtt tatatgattt      1260
atttatacca taaaaacaac taaagggacc cgaaggtccc ttaaatcgtc aaagattaga      1320 taccttaac atatacacgg cggaagtaag cgttttacc aaggctattc agaatagaag        1380
```

FIG. 17B sequence.txt

```
gcataccgct ctggatgcga gaagccggag cctgagcagc ggattctgca aatgggttga      1440
taccgatacc gtaacgagtt ttgaatccca ttaccggttg gaagttcttc ggatcagaac      1500
cacgcagcgg agtcagagct acatatggag catagtaaat accagcatcc atttcgttcg      1560
gacctttata acctacggtg aaataatcct gtttagcata ctggtcgata tatacacggt      1620
atttaccacc cagaacacca gcaaatactg acttggtagt atcagtgtta aagccagtag      1680
ccagaccttg tgcagcataa gaaatgccgg tatcaactga agccagaacg ttaactacgt      1740
tacgggaagc gataatgaag ttaccttcgc cgcgaccagt ctgacgagca atttcaactg      1800
cttctttgtc aatctggaac aacagagctt taaaggattc acctgcccag cgagcaccac      1860
gaatatcgat tgggtcctgg aagtcaaata caccagcttt agaacccgga gtcagggtca      1920
taccagattt accaacctga gcggagtagt taatccaatc aacaacttcg cggttgattt      1980
ccagcataat ttcggtagcc agaataccag acagttcagc atcagcatcc ataccgtgaa      2040
cagcgcgaag gtcttgtgct aattcaatag agtaagcagc tttcagctga cgagatttag      2100
cttcgataac ttgtttatcg atacggaagc ccatttcatt ccatgggtta tcggtagaac      2160
cgttgaaacc ttcctgaagt tcagcgatag aagtagccat accttcagcg atttctacca      2220
gtacaccagc ttccatttgt ttcttaattt cagcatctaa tttgtctgcg tcagatgcgc      2280
ctgaatcaat ttgtttagct gctgtagctt gcagatatac tgtaccagtt cctggaaga      2340
agtgagtgta aatagttccg acttcaagag tatcacttgc tttcaaagca gcgaatttct      2400
tagcagcacc ctgaccagag aacattgcat ctggaccata cattgggtgg aatgcttctt      2460
tagcgccgga agcgattgga tctttaccat atactgcgcg cagcgcgaat acctggccag      2520
tcgggctgtt cattggctga acaccacaaa tatcgaaagc aatcaggtta ggaatagcac      2580
gacgtaccat acccataaca gctgggccaa tctgagttac tgcgccagaa gtctgacctg      2640
cggcgatgtt ggtagcattg taaccgtggt caccaccgat ttcagcttct gttaagaaag      2700
aaccgaatgc ctgagcaatt ttttcgtctt tatattccgg agctgtctgg aaatcttttt      2760
cctggttttc aaagatttta gcgataatcg cttgtttgct attagcaatt tccggtaaac      2820
cttcaccttc cagtaatggc ttccatttgt tcaaaagttc agctttagtt ttgatagtca      2880
tttgtgttaa cctttaaaat tagaaacgag atgcgacttt cgcatataca cttacaatat      2940
cttctgcacc ttgtgcagat ttatcttcta cagcttcagt gacgaaattc agtccggctg      3000
cttcagtatc aggagtattt atactctcag taatagtgct ttcatcttta ttagatttct      3060
tcaccatttc tacgattgca ctcaatttac ttgagaatgc atctgaataa tccataacctt      3120
cgaccagagc agagactttt tcttttttgag actcagtcag atctttagta ctttcgctca      3180
atgccacttc acgctgcaca taattgatat atgcgtcacg cttattgagt tcttcgaaca      3240
gacgagctga ttcttcttta tgttcttgca gttcttcttc catttcagct acaacatcaa      3300
```

FIG. 17C sequence.txt

```
ctgattcttc tggaacaaca acgttgtgtt caacgaagag ctctttcaat ccaccaagca    3360
tggattcaaa cagttcggct ttgatacctt tatctactgc taatttattt tcagtgagcc    3420
attcttttgc aagatggtca aggaatttag aagcttgctc agcgattttc ttctcagctt    3480
tttcttctgc ttcttcttta ttttttttcta cttcttcttc tgcttttttca gcaattttag    3540
cgatatgaga ttcagctaat ttaacggcgt gctgcttgac ggtagcttcg aatacagtgc    3600
cgaaagtttc ttttgcttcc ggagaaatat taactgattc gaaaatacta tcaagagcaa    3660
cggaagcatc aattttctgc gcttcggcaa tcagttgttc tttaagcatt ttgtagtcct    3720
gttgtttaga taataatatt tataacgctt ttttcatggc ctctgcgaga gccatatagg    3780
cgtcatcggc acttgtatcg gcttccgccg tctgtgattc ggtaatttcc ttaggagtta    3840
cccatgcatc tggagcactt ggaccccata ctgcatcaac acctacagtt aatttgaatc    3900
cttcgtttac gatacgataa ccttttatttg tgtcagtcaa tgaacctaat ccacgagaag    3960
aaactcctgg aatccatccg gcacgaatat tagctgctaa tttatctcca ggaccgtggt    4020
caccttcaat aacacgagct cgtccgtata cgtcatttcc tttccaccac atatcttcta    4080
taatgatagc ggcttgcatc gggtcaacat tagcgcgtgg aggatgattt aattctccga    4140
gagcttgttt agttaaaact tgctcattaa tatagtcttt taccgctttt tctaatatac    4200
gttttggata aagacgttta tttctattga cgacttccgc ttgcatgaat attccttcga    4260
tgtataaacc cggttttaaa cctaagtctt ttccatcatg agattcaagc attggtacgc    4320
catcaataat ttcgccaggt tgaccccaag tttcaattag taattggggt tcattcatta    4380
gcttaatcct aatgctttac ggcgtttaag agctttttta cgcttacgct gagcacgaga    4440
ttgacctgct ggattggcaa tcttcgtttt ggtagcttta cgagcaattt gtctacgttt    4500
tgctttagac aacccggtag tttgaaatgc attacgttcg cgggttttgc gatctttagt    4560
gcgagtaatt tcaccacggg cagaaacatg tttaacgata aattcatttta acggcatatt    4620
ttcattaata gaagctaatg caaccgctaa atcagtttca tcatcaagca tattctcgac    4680
aattgtattt atatcgtctt tatttaaagc agaagacaat tcgtcaaagc gaccctgtgc    4740
ttcaggaata agtgcttcga cattctcgag aactaattca tgagtttcag ggatcagaag    4800
cattattcat catcctcgtc ttcgtcagag tctttgtctt ttttgtcgtc tttatcatca    4860
ctatcttcgt cttcgtcatc atcctcgtca tcaggttctt caccttcgat taagaaatta    4920
cgagcgatag cgattttttc ttctttaatt aaatcagtcg ttcttgcagc catggcttca    4980
gcaaataatt tacgagcggc tacgaggtcg tttgatttaa tagcttcaat taaaccttcc    5040
attaaaaatc ctcttgttct tggtcggggt cttggaaacg agcctcttta gactcttctt    5100
caatttgctt ggcttcttgt tctatttctt catcagtcat ctgcaaaata tctttcatag    5160
```

FIG. 17D

```
                                    sequence.txt
cagttctgtg agaaatatat ttaccaataa atggttctgc catggttagc atattaattc    5220
ttcgttccaa aatttctgct tctttgagct cagcaaagta gctatcccga tgaaattcta    5280
tcttaatatt atttatttca tcattccact catcttctgt gattatacct ttaagcaaaa    5340
gatttgtttt aagtggatct aggaaaactt cttcaaactt gtgctgtaac tcacgaataa    5400
atttagcaaa cgttaattca tcacgtgtaa tgctagttcc agaatcaaac atcacaccgc    5460
cttgttggtc ttgtggaatg cgtgaaagag gaacacgtaa tgccatgtaa agagcttgtc    5520
taaaccaacg aatatcttcc atattgccag tattatcagc accaggaaga gtatcaactt    5580
ctgtcacagc tttaccatca cggcgctgca accaatagtc ttcggtcata gacatattat    5640
gttgttgatt ttttatttta cctgttgatg catcatatac tacacggttt ttcatcgtgt    5700
tcataacatg ttgcatgtgc tcagcagctt tacgagcagg catattacct gtgtctacat    5760
accaaacacg acggtcagga gcacgagtaa tgcgataaat gactacagca tcttctaata    5820
attttaattg gttagcaggt ttaacagcac gatgtaaata cccgatgata tttttgccac    5880
agcaatcgac taatccagaa tgggcataaa caacagcagc ttttggaatt tttatttttg    5940
tgccagcttc atacattcta ccatcacatg catatgactc atgggcagta tcatatataa    6000
aatattcttt gtaacccttta actattttg tgccagcttc agtttctgtt ataatttcgc    6060
gaacatactg aacttggcga gggtctaatc tacgtaattc ttttatgcct tcttttggac    6120
gttttggatc aatgatttta tgaaagaaaa ttcttgaatc aacataccaa cgtctaaaat    6180
gatcagaacc ttttcgttga aacgatagat gatttaatac atcactaaat tcatctaaca    6240
tcatattttt aattttttgga ctaaatttag atttatccaa atttaacgct acgacttcag    6300
tatcatcttc gtagacgata gcatctgaaa cgatttctga aactgcatta tctacttcat    6360
agttattcat gagattacga tatgtatcaa taagctcacg agtagttttc attcctggtt    6420
catatgaacc aaaaattgtt tggaatgcag cattataagg agaagcagct tcattcgagc    6480
ttacttcaaa ttctcttgct ccatcatcaa gctttggggc tgtaatggaa acaagatctt    6540
ctttttcttg gtctttaaaa tttcgttcgt ccatttagc ccatggagca aacaaactta    6600
atacattaaa tttcattgta ttctccaaat gggaattata gttatattta taatggactt    6660
ctctgcttta agcaggatgg ggatttctcc ccattcattt tattcccaat aatcgagagc    6720
aagagttact tcaaaggttt ggatttcatt gtttgaatcc caatctaatt gaagttcacc    6780
cacgttagta ggccacagac ctttaatttc aatttctttt gttactgttt tagcatcacg    6840
agcatattga cgaacaatag cgctcttttt atactctgca ggttttccac cagtaatttc    6900
gtttccttga ccagcagcaa tgctttgcca atcaacaaac ttctggcgag catcatgagc    6960
ttcatcgttc attactgtaa cagtccagtc atcgaatgta cgatcgcctg ctacgttaat    7020
tttacggttc ataaatccga ctggaattt ttctacaata ccagctggta aagcagtggc    7080
```

FIG. 17E sequence.txt

```
tttacattgg aatgtaaaat tttgtccaag ataagaaatt tctacttgga ataagttagg      7140
tcgagcaaaa tcaccagatt caaacgctcg tgttacatca tctacaaaca tattagcctc      7200
tgtagtattt atatccctat gtttaaccta gggcatatag aattaaagaa ttaaggatat      7260
agtgtattta tatggcctgc cgaaacaggc ctttagaatg caccgtatta accagcaaga      7320
ccagttaact catcgaaatc tgcaccagta gcagttgcta cgaagttcaa ggtaatgtag      7380
ttaatgcttc tagccggttg aatgtagaat gttgcaacaa actcatttct atcaattact      7440
gacggagtgt tatttgttgt atcgcaaact acacgatatt cataaattcc accgagagct      7500
ttaattccct gtaagtattg ggcagtttct gtgcggaatg atgaacgagt aaacgcgttg      7560
tttaattcga acaaacgata ttttgaacta cgtccgatat tcgttttcaa catattaaac      7620
agacgacgaa cgttaatacg atcaaatgga gaaggaacag aagtagctgt tttatcacca      7680
tacaatacgt aaccatcgcc acctgtacca gttactggat taatagcttc ttggtataaa      7740
cggtcgcgct gagcttggcg agtttcaata gcaagtttaa taacgttaag aatctggcca      7800
cgattataac cagctggaga catccaagtc tgagatacgt tatcagttct tgcgcataaa      7860
ccagcaatat cagctgctaa tggaacccaa cgattcacat cattatattt gtcatactga      7920
tatttgtagt taccatcaat tgctgcgtag gttgaactga tattaaagtt attatcagtg      7980
tatgaacctg ctgcagttct ccagttaact aaattatcta ctgcacgagt tacaggaatt      8040
ccaactacag tttcacgcgg aggtgagcac aatactaagc aatcttgacg agcatcacca      8100
attgaaacaa catgtttttg gacagtagat gctgtttcaa gagattcacc ggcacaagaa      8160
cccgcaataa acaactgaac gtcaacagat tcgcggtcag caaagaagtc ccaagcttcc      8220
atcaaatctc ctgctgttac ttcagcattt gatgataatc caccagacag agttaaaatt      8280
ccagagaagc cttctggcca gttttgcgca gttgcgaaaa tatattctga accacctttt      8340
gcgaaaaagt catcaatata gatgttacta tcgtaaatat cttttcacc acgcttagtt      8400
gaaagaacaa cgctttgaac aatagcatca tttcgacgaa ctataatagc gtactgtgag      8460
tcagtctgcg gcccatatcc aaatactgcc ttggcagtag atgcacgagt accaccacct      8520
ggataaattg gcagtaatgc agaagcgcct ttcgcatagt cagctttaga tacgatttca      8580
atttcaattt tatcgcctaa ttcgcctgga tagagagcta ctactcctgg aattccatat      8640
ttttcaagat ttgcctgaaa atcaactgct gtcatagcag tttcagcgct ctcgatttca      8700
gctaataaaa taccggaatc agtaataatt tttccaagag ttattactgc agctaaaccg      8760
gaagaagatg aagaaatttc tgcagtccag ttagaaccta atgttgggta ttcgccaact      8820
tctttagctt tagcaataat ttttgcagta ggaatattaa ttttcttaat ttttccatca      8880
gcatctactt cggtaatttt accttctgtt tcaacatctt ctgaaacata tttgaccgtg      8940
```

FIG. 17F sequence.txt

| | | | | | |
|---|---|---|---|---|---|
| attttatctc | caaccgcgta | gttactacct | ggggtagaaa | ttgtgtattc | aatattacca | 9000 |
| gcaatcggag | atgagttttt | agcggtatct | ctatcgacag | cgcgcacaac | tcgcaaatca | 9060 |
| tttccatatt | gtaagaaatt | cattgcagac | ataaaatagt | cagcagtttc | agctgtaggt | 9120 |
| tgaccaaaag | tattaactaa | atctacttcg | tttgtaacct | gtttaatctg | aaaagcagga | 9180 |
| ccccactgga | atttaccggc | caaagctgct | gtaccagtag | agttattaac | cacggtgctt | 9240 |
| tgaaccgtag | tttctttgag | ctcaatgccc | ggagataata | aagtcatttt | taatcctctt | 9300 |
| taatatgctt | taatatattt | ataccattga | cataccatga | gatactggaa | catactcagc | 9360 |
| agaatgaacc | gaatcaacaa | atataactgg | agcgtattca | tcccccatat | cttgaagctc | 9420 |
| ttttgaaaac | acttcagatg | ctaatcgcat | gtcatctttg | tcggcataat | caataaattt | 9480 |
| tgattgtgtt | gataaccatc | caaaaattac | taaagacatt | actaaatcgt | catgataacc | 9540 |
| ttcttcagcc | gcccaagaca | cgcctttttc | actaaacgtt | ctaaattctt | gaatagttgc | 9600 |
| acggtgatga | ataataagct | tatcttttc | aataaggtct | tttaatgtag | agcatcctac | 9660 |
| tgctttcgtt | cgtttagttt | gcttcattcc | taaatcagta | tatgaatcgc | aaataacgcc | 9720 |
| ttcgtattct | aaatccatgt | aaagtgattt | cgcaactgac | acaccagtac | tatttaattc | 9780 |
| aatataaact | gggcattcat | tatattctac | taaataacgc | ataacgatgt | caggcagaat | 9840 |
| taaatgagaa | atggtatttg | aatgtaaaac | accaacctgt | tcccacacat | catcggtaac | 9900 |
| atcaataata | tgtaaagcgt | ggtaatcttg | cccacgacct | tctgaacagt | ctaaagttgc | 9960 |
| aatgtatttt | ctatctggtt | caggtccttt | aaatcgatga | aaccatgat | catctggagt | 10020 |
| tacttcaatg | aaatccataa | cagccaattt | cattcctgaa | attaatgtac | cagaagtccc | 10080 |
| ttcaaacgct | gcggtatgtt | cttgacggaa | ttgtgctaaa | gtagaaccat | taatggtttg | 10140 |
| tatgctccat | tgccatccat | cgtcaaaaat | atcttcatca | ttataaagac | gttctttaac | 10200 |
| tgaattccaa | atagcagtgt | atggttcaaa | tcctgattta | ccttcaacag | cagcagtcca | 10260 |
| aatatcataa | aaatgattta | atccattagg | agtcgtagta | ataataattt | ttgaacgacg | 10320 |
| accagatgaa | attactggtt | gaatagcaag | ccaggaatca | tggaagtttg | gaataaatgc | 10380 |
| acattcgtca | atataaatca | ttgcgaatga | gttaccacga | actgcgtcag | gagaggaagc | 10440 |
| ataagcgcca | attgaagaac | cattatctag | ttcaatagac | cctttattcc | attcaactat | 10500 |
| accaggctgt | aaaaagtcag | gaagcagttc | aattgcttgc | ttagtacggt | ctaaaacttc | 10560 |
| cgcagacatt | gagcctttgt | gcgcaagaat | acctacagct | ttatccttgt | taaaacatac | 10620 |
| aaagtgtgca | agaaaaatag | ctactacagt | tgttttacca | agctgacgtg | atagattaca | 10680 |
| aacagtcata | cgtttagatg | acattatttt | gagcatatca | cgctgatagt | cacgtaattg | 10740 |
| aacctttatg | acaccatagt | cgatatgagt | aatggcgcag | tatgtttctg | caaaatatac | 10800 |
| aatatcatct | cggcattttt | tccattcctc | aaccatttca | cgagtccatt | gtgttttaat | 10860 |

FIG. 17G sequence.txt

| | | | | | | |
|---|---|---|---|---|---|---|
| attagctcgt | tttaagttag | gaagacccat | ataccgagat | cttttattat | tcttatcttt | 10920 |
| ataagtttga | aataattcag | gcttatcaga | attatttggg | atttttacta | ttttgtgtaa | 10980 |
| acgaagataa | tcactgaatt | tttcaggata | ccatttttcca | tcccactgtg | attttatcca | 11040 |
| atgaattcca | tcttcatctt | ttctttctgc | taagcttggg | tgttttatta | aaattttttcc | 11100 |
| agcttcattt | aatggatgga | aatcatttaa | tgcattaatc | ggttgttcca | tttatcacct | 11160 |
| tctcacgagc | ttcttgagcc | tcgtaagcat | caccaatttc | gtccattaat | tctgttggtg | 11220 |
| aacccatgaa | tactgtcgcg | ttctgaatat | tcatttgacc | tgtaggaaca | gcgcctttag | 11280 |
| tgccaacctg | ctcagatgta | atatctttca | tatctttatg | aagcttcagt | atttctctgt | 11340 |
| tcgtcgtagt | catttgcccc | ataagagttg | caaatacttc | catgtgacga | ggagaatcag | 11400 |
| cattctttgc | cgtctcaaga | aaaatcttgg | ctgcgtccat | tagcatttgt | tgttgaaaat | 11460 |
| gcatatttcg | acgaactact | ccataatcat | cttctaagtc | aggagtacgg | ttttgaggat | 11520 |
| tgcttttaac | ttctactaat | tgtagaggtt | catatacttt | aatttcctcc | ccgtcgattc | 11580 |
| cggggaggtc | agaaatatct | aaaagtttgt | ttatatcaag | accttccata | ataacctcta | 11640 |
| tgttcttggg | ccaggaggtt | ctggcggtgt | tggtctattt | acattgctag | tgaaagtttg | 11700 |
| ttttactgtt | ccatcccagt | cctctgggtt | aatatctcga | ggaacaactt | cgctatcaac | 11760 |
| agattcaaaa | acaccttcgc | catcaggcaa | atctcttgta | ttggcgtgaa | aatctgtata | 11820 |
| agtagtacga | attaatcctt | ctgcatcatc | tactggagga | tacatccatc | cgtttacttc | 11880 |
| aaatgttagt | gaccattcga | ttctacgacg | agataaatta | tctccatcta | tagcttcatc | 11940 |
| tatagcagca | gacatcagta | caattttaat | atcccttttta | aatggaatat | catttccaaa | 12000 |
| ctgttcgtac | atagttgtat | taaaatgagg | ttgaaaatat | ggaagaatct | gttcaactat | 12060 |
| ttgaaacata | tcgtcttcgt | aacgagtaaa | gatactcaat | tcataaatca | ttttaatagg | 12120 |
| agatggatta | tactgcgata | ctacagaagt | tgtaccttt | tgcagtaaat | tctgatttaa | 12180 |
| aatgtttgtt | ttaaatggag | cgttatagct | aaaatcaact | aaatgcaaat | ttatacgagg | 12240 |
| tagaatagtt | tcaaccttgg | ccacatcttc | ttgtgaattt | atcgatgtcc | atttattcaa | 12300 |
| tttcatcata | aagtgttcct | ttgatgcata | cgtaatagga | acacgtataa | acttatcacc | 12360 |
| agattctaac | tgacgtttga | tttggatatt | tgaaaacaaa | tcgcccatca | aggtagcata | 12420 |
| tcgtctaaaa | gacgaattat | aaaaataacc | aaacatgatt | tctcctaatc | tgggctttaa | 12480 |
| ttagtttata | atatttatta | atccatgaaa | tcattatcaa | atgggctaga | ttcaaaagat | 12540 |
| ttgcctctgt | tattgacaac | aacataaggt | tcaacatatt | ctttagcttc | agaattaatt | 12600 |
| tgatctactt | cagcatattg | atcaatatta | atatcatgaa | taccgttaag | attgcgaaca | 12660 |
| ggatttagtt | ctaattcact | aaattctgga | atgttaattc | cttcattttt | ctgtagaact | 12720 |

FIG. 17H

```
                                       sequence.txt
ggattaattt cttctccaga ataaatgaat ttacctgctg taattttacg aatagcgttt      12780
tgacctaatt gataaaatgg atcatatggt tcaacccagt taatttcaaa taagctgtta      12840
tccataggaa aatatatcaa atcgccttct ttcggttctt ttccattaac ttggtgttta      12900
aacaagtttg gattaatgga caaagtaact tcatcctgta cttgcatacc aaagttacta      12960
aagaacgatt tagctccttc atatccttca aatgaattta aatatgcagc gaatttccaa      13020
gctttagtaa atttattttt taagtcttcg ccaaatatca atcagggga aacatactct       13080 cttggaacat aatagcattc tacacctcgc atttgaatgc tttcagctac taatacatca      13140
gctaatattt gactgttttt ataatgattg aaatttacat aaggatttag tatttcagtt      13200
tcattggtct gagaataacc agtgcggttt tccaatttag caaaaagatt tttatcataa      13260
gtagccatat taacctacca aaattccaaa tggaggatcg agcaagtata attcttcacg      13320
taatgcttct ttttctaatc gagcttcttc tattaagcgt tgtccatcaa tcgtaacacc      13380
gccaggaagc atcatacctt ggtggcgtgc taaaatttga ccattcaatt ctttagctaa      13440
agcagtagca tagtctttca cccaacgatt attataagca ccctgtttaa catttgggtc      13500
ttgaccaaca acacgaccaa ctaaattgtg gtctgggtta ttatatcgtt cagataatga      13560
ccagctatct tgtggaccga ctgttccata tcctactgta tttccaacca ttttattagt      13620
atcaatgtat gatttagtcc agctttctac gataattaaa tcatatttt ggaagtttcc       13680 catgactttg agctgttcat ttgctgaatt aaaccaaaag tctggaatag gagagagcat      13740
atcttgcatc attcccatgt aactggtaag ctgggtaaaa tatcctaaat cagctccaaa      13800
ggcatttggt ccataaaatc tattacaaga agtccccata ccgccattaa taccagccat      13860
tcctaaaaga aaatcagtaa accatggata tgtagcgttt ccgtccattg acgttattga      13920
tccaatattt gttcgcaaaa tgcgagttac tgcgaataca tttgaacctc ttaaatcgaa      13980
gactccagtt ttatatttt cttcgtcatc tcctacataa aatacatgaa aaccctttgtt      14040 aagtccatca aaatggtatt caccgtataa ttctagggca cgctggatac aatcataaat      14100
ttgatcgggt gttaactcaa cattaataat tggagcccct aaacgtctta gaatgacatc      14160
tttgagttcc tttggattct gagaattata tcctgacatt taaaatcctt tggggccttg      14220
cggccccatg ttatgctggt gataaaaagg tagaaagtag tacccattcg ccgtctttac      14280
gaacgtaagc ttggccatct tttggagctt caggaatata acccgcttct tgtagagctt      14340
gaacgctgct ctgtaaagag gatatattgt ctttagctgt atttacttca tgcgtgactg      14400
ccgcaatgtt agtttcattc gttttatag aattagttaa tcctcgttct tcaacagttg       14460
atccgtcagg attatttcca tttataagtg aagtaagttc aataacttga cctttaattc      14520
ctgttctatt atttcctatt tcaacttgta tattttgaac attattgttt aaaactgaaa      14580
cttctccttc aagcactgaa actttattta atagagatcc agaaggagac ggttgtcctc      14640
```

FIG. 17I sequence.txt

| | | | | | |
|---|---|---|---|---|---|
| cgctggagtc | agttccaaca | atttgattta | accacgaaac | attcgctctt | aaaccagacg | 14700 |
| aagtgttttc | accaacaatt | ccgtttaaag | actcaataga | agttgtgtga | tttttaattt | 14760 |
| ttcctttaat | actagaagga | atatcatctg | aacctataga | agtttcaata | gccgttaagc | 14820 |
| gctgtttaac | accttcactc | tgatttaatt | cattattaat | agattcaatg | ctacttttgt | 14880 |
| tattattaat | ttctgttatt | atagaaacat | tttctgggta | tccaatagaa | gatttaattt | 14940 |
| ctgctatatc | agaatttatt | aaagtttgtt | tatcatctat | agtgtttaat | ctattataaa | 15000 |
| tatttggtcc | aaaatctact | ggtttattac | caagttcatc | gcgtaattta | ccaacttcaa | 15060 |
| ccgtcaatga | tcctacgtca | gattcagtaa | atttattttc | taattcactt | aaacgaatgc | 15120 |
| cttgtgaaga | taataatgta | ctatttgtta | ttattctatg | tttcattcct | gtgctagcat | 15180 |
| taccaacaac | aggaagaccg | ttaatgtctt | ggccagaata | ttgccctagt | tcttgtttaa | 15240 |
| tccacaataa | atcatttcta | attgttctat | aaacagagtt | ttccttcatca | ttaaatggac | 15300 |
| ctatatcagc | aataattttg | tcaactgtat | tattagttcc | agtaatata | tcagtgtgtt | 15360 |
| cattagtaag | tgtctttaaa | tttgatatgt | cattttatt | aacactgatc | tgcgatagtg | 15420 |
| cttctatatc | tcctgataca | tctaaaactc | cttgaattgt | tttaatatct | ttctgcgatg | 15480 |
| tttcaatggc | agttttaaga | attcctatat | tttcgtcaag | aacctcaaca | tttttaaaca | 15540 |
| cggaaacaat | tggtctattc | attgatccat | cgtttccata | cttagtgcta | gctcctagta | 15600 |
| tttcttcacc | atttttaatc | catgaaatac | gttcctgacc | ttcatcagga | acgctatcaa | 15660 |
| caaaaggtaa | atctttaat | tcaatcattt | gtaatcctta | gtaatgaact | ttaataatat | 15720 |
| agtttaatga | tatattccat | ggtctagttt | cataaccaat | taatccttca | cgattaagtg | 15780 |
| taccaagggc | atctctcggt | ccgcctaatt | caaatccatc | attagtgaag | tatgaagcat | 15840 |
| tatcccagtc | ggcatatttt | ctagttccaa | gatatccttg | ataaacagac | gcgccaaatg | 15900 |
| ggccttcact | tctgttatat | tcccccaac | caccggcgtg | tttatggtat | gacatttgtt | 15960 |
| gtgcttgaac | accaccaaca | tgcattccgt | cacatcctac | gccaagtcta | tcctttccat | 16020 |
| aaccatcttg | tcctcgttga | tttaaaatat | gaccgcctgt | gccagctcct | ctgacgaaaa | 16080 |
| gaccccgcat | atcaggaacg | ccaggattat | tccaatcgcc | accaaatctt | gttccaacta | 16140 |
| cgtttctata | atcaggaaat | tggtcacctg | acacggttcc | accatgacac | ataatccaac | 16200 |
| ctggaggtgc | tgaatcaccc | gcaaacatca | taatagttcc | aaccggaact | cgttcggacg | 16260 |
| catatctttc | agtggcaaca | ggttgatcgc | cattttttcca | cattccaccg | cgtgaccaaa | 16320 |
| ttccatttgc | tgtaagatgg | tctaaattta | aagaaccatt | aatagtttgt | ccaccacgcg | 16380 |
| tattaattac | atctgcgttc | cacgctaatg | ctccagaact | atccacttca | ggggcaatac | 16440 |
| cggcttgcgt | cgttaattta | actactccac | gcatagaacc | agtagctcct | cgaccattta | 16500 |

FIG. 17J sequence.txt

| | | | | | |
|---|---|---|---|---|---|
| gtgtttcacc | tgttactgca | acatctccta | aattactgtt | aatttccgat | tgtgttccta | 16560 |
| aacgtataac | acccttatat | tcttgtgttg | caacagaatt | cataaaggta | tacggagaaa | 16620 |
| ttgcatatcc | ttcgcggaga | gttccttgac | gagtttgcgc | aacagttgat | aattgaacca | 16680 |
| cacctctcac | agattctgat | gcagtatctt | cggaaggagc | tatttgtgaa | attaatttta | 16740 |
| ttgcgagttt | ttgggttttt | agcggagtca | tcgccgtagt | atcatcaaca | ccagccaaag | 16800 |
| ccgcaggcgt | agatgatatt | ttaataaccc | cgtttgatga | ctcagatgaa | tatctatttc | 16860 |
| ggaacacatc | atcagtatgg | tatttcagtt | tttgcggcgt | tattgatgaa | ttattatctg | 16920 |
| agccttctaa | tgtttcttca | tttgttgaat | agcgcgttaa | accatattta | gtttcagtag | 16980 |
| catttggata | caataatctt | gttgctaatg | tagctggtgt | aacgatttta | gaattatttg | 17040 |
| ttccatctaa | aacctcttgc | tctgatgcaa | tcattgctat | tcctttaact | tccatagttg | 17100 |
| catcaggaat | accatttacg | ccgatattac | ttattttga | taatgcagac | tgtactgtcg | 17160 |
| taacagtgcc | aggaaaattc | gatcctactg | gatcgaattt | aacatatttt | gattcatttg | 17220 |
| atacgtgctg | atatgtattg | ttactcatgc | tattctctca | aaataataaa | atactgtagg | 17280 |
| ttgtgtgtga | ctatctagcg | taacagtttg | cgcacctaat | aattgccaag | ttccataccc | 17340 |
| gggtttagaa | ggagaaatta | tttcttgttt | gaaagtaatt | cctttatcag | agtattgttc | 17400 |
| taagatatgt | tcttggttat | ctaaatactt | aacttgtatt | ttattcccta | tggtaggatg | 17460 |
| gtcttcaaat | gaatcaattg | caataaattt | tacaaccatt | tcctgtagag | ctgttctaac | 17520 |
| agcactagta | aattcaattg | aagtcattcc | attagtagct | ttaactggaa | taccaaacat | 17580 |
| gttaacaata | actgggtcac | ctggtttggc | tgaagtatca | gtaacagttc | cttcaaatga | 17640 |
| ccaatagtcg | gtttgttgca | cgccagtagg | agatacgccg | cttatattaa | ttaatacagc | 17700 |
| tccaacctgt | tgctctgcca | tatttctaac | atcattgata | gcagattcta | catttgagtc | 17760 |
| ataaaaacct | tttgctattt | gtgaaattgt | tacagcgcct | accggctgat | tattcataac | 17820 |
| cgaaatatca | tttttcttag | ttctaaaacc | aagaaaatct | gctaagcggg | aaataactcc | 17880 |
| cgcttttatta | ttaagtaaac | tcattatgca | atccttatcc | aacggtatac | agtaatagac | 17940 |
| ggttgaatat | tactaatatt | agtaggagga | gtatgtgaag | agtttgttgt | tgcgtagtct | 18000 |
| tcacgatatt | ttgtatatat | aggaccagtt | tcgtctgggt | catattgaca | tcctccaata | 18060 |
| ataactgatc | cattttcgtc | ttcaattaaa | actctttcat | cagtttagt | cgcaggaaga | 18120 |
| tttgcgtttt | caagcgttac | tgatgttgta | ccaactgttc | caccggcagt | atgtgaagga | 18180 |
| tttccgctag | aatctaaatc | attattgttt | aaagcaaagt | ttggatccgt | aacatcatca | 18240 |
| ttccatccta | ctaaaacttg | tcctttacca | aataatttcc | atgaaccaaa | tcccatataa | 18300 |
| gtcaccggat | tatttgggtt | tatagcattt | tcataaattg | aaccaacagg | ataaatgctg | 18360 |
| tcgaaaatag | atgatattga | attatacgtt | ctagtataag | aatcaacttt | ttcaacatttt | 18420 |

FIG. 17K sequence.txt

| | | | | | | |
|---|---|---|---|---|---|---|
| ggccaaccga | ttttatcaaa | atctgttaag | gctacatccc | cagtaacttc | agtagatgat | 18480 |
| cctttactaa | cataacggtc | atcagttaat | tcaataatgt | catcttttc | taaaagagtt | 18540 |
| cctaaatcat | tattaaacca | tgttataacg | attatatcac | ctgattcaaa | ttttctatca | 18600 |
| aataaaagac | tgacaggttt | tccatcttca | tattctatag | aataatctgt | gtttgattct | 18660 |
| ttccattcgc | caccaagaga | tatacatcct | tcttgcgtat | ctgaattagc | gccttcgcac | 18720 |
| aaaaacagag | gatacccagc | tgttccagcc | tgttgctgta | aaattccatt | aaaacgaacc | 18780 |
| tcaagagaat | taggattaat | gggttcgcca | ggaattaatc | caaaagctga | aaatggaatt | 18840 |
| gatttcatcg | ccgataaatc | agtaacataa | atgcttcctt | ctaaagaagt | ctttgatgtt | 18900 |
| agttttgaat | ctagcacttt | tatttggcgt | cttgtatatg | aacttctcca | ttgtgataca | 18960 |
| ccatccataa | acgtttcaat | ttgaacagtg | tcgccaatat | tacaaggctg | tcttaaccta | 19020 |
| atattaaatc | catcaagagg | aattaattct | ccttcatttt | ccccggaga | gccaaagtca | 19080 |
| ctgttttcac | taaatacatc | gccgtaatat | aattcgttac | cgcggtgttt | tactctgatg | 19140 |
| ttattgacat | tataactagt | tccatggaaa | acatctaaaa | agtcagtttg | tccttgaact | 19200 |
| tctactaaaa | attctttgcg | agctacatta | ctaatatctg | aactaataat | tttatcaatt | 19260 |
| tgtttgtttt | tgacatattc | ccaacgtcct | ggagcacaat | aaactaactc | taaatcgcta | 19320 |
| aattgaacat | taatttcaac | tgatgacgat | gatcctttaa | tagtatcacc | agaagcggct | 19380 |
| actagagtaa | ctggattaac | attccatgtt | gcaaatacat | ccctagcttt | aattacttta | 19440 |
| ttataatcat | taacggttcc | tttaggaagt | tgtagagtta | ctcttccaga | tgaagtgtta | 19500 |
| atagcatatg | attttcccca | ttctgctgtt | aatgtttgtc | ctgatgaagc | attataagtt | 19560 |
| ttccaggcac | cggctgaata | tggaacatct | ccatcaccaa | gctcgtaata | aagctcatca | 19620 |
| aagttttcat | ttattttat | accacccttta | cgcaggtagt | caccggtacc | atcatctaca | 19680 |
| acattaccga | tattaatatt | ttgtttcatt | attgagccac | cccgattttc | tgcgtagcga | 19740 |
| taactttaac | tgctgctctc | ataccgacag | ttgaagaact | tatagtcgct | gttacataat | 19800 |
| ttgttttaat | actaaatgca | atattagcga | tttcgtcttc | ttcagtttca | ttcccaactc | 19860 |
| gcatgacagc | atattcagaa | gaaatgactt | ctgaattaac | agcatctaca | agaatattta | 19920 |
| tttctgccgt | tttaattttt | cttccatcta | ccgattggca | cgtaactaac | aatttagcca | 19980 |
| tattgtattc | agtgcgatga | aatagtggaa | tatcaactga | tccggatgta | gaaatattcc | 20040 |
| atgtaccttc | agctggtgat | tcctttttgtc | caaacatact | ttcaatagaa | taattccaaa | 20100 |
| ccgatgtaga | attatcagat | gaaatacagc | gtaaagttac | tttactatat | gggctagtta | 20160 |
| ctactaaaatt | acctgaaaca | cctttaattg | aatcaatagc | ttgaattgtt | aaaggattag | 20220 |
| taactgatat | tgatccatta | gagttaatga | attcaacaca | atcgccgagt | tcgcctcttt | 20280 |

FIG. 17L

```
                              sequence.txt
caataataac tttaacacct acagtagagg tatcaatatc atgtctagtg ccaactttca    20340
ctggagttgc gtactctgta atagagtgtt tttgataata cccagtagca tggataattt    20400
gaccatctgc tccagtgcca tttgctactg ccattttacg ctgatcgcca aacgcattat    20460
aaattgcgtt aaaatcacta ttaattttat taccaccgtc gaataagata tcaccagtag    20520
aagcgttacc aatttcgccg gtatcaatca atttctttgg ttcttgaatg aacatagcgg    20580
tttccttatg agtttatagt atttataaag aaaaagggag cccatgggct cccttaattt    20640
aaaatgtaaa cagaatattg atttcttctg tttgatccat tgccataata ataggtggcc    20700
tattttccat ataaatcatt tcgcccgaat gcctcattaa atcttctggg tcataataat    20760
ccttttcagc tttaacgttt gggtcatttg gatgagcttt agcttcaaga ggattcgtga    20820
ttattgatat ttgtctaaat cctttatttc ctggcaatgc agcatcagga aaataaactg    20880
aatctaaata tgctttaaaa cggatagtat ttgccttaac ccggtaaatt aatccaaaat    20940
catcttgttg ccaagtgaga ttatcttcat atccccatct agtcgggtct tcttttaatt    21000
cctcaggcca aggaaccaca atatattcat tcgtgcatct atttatagat acatcgggtg    21060
gaatctcaaa aagatattcc catacatacc cgtccccagg ttcaattgtt ccttcagcat    21120
ctcctcgacc ttcaggagga gtcattgacc taacagaagg tgtccatttt ccgcctaatt    21180
taaggcattc atccttatca gttaaagatg caattgaaca cattccagta tcaggaacat    21240
ctaaacaacg atatactaac cagcctgcgc ctgattcagt agcgttgtaa ggagctgagt    21300
tacacactac aatatcgtta attctaaatg tgtatggatc cggatatcta gtatctcccc    21360
aatctcgacg aggaataact gcgtcaagca ttgatggaag aacctttact gttcccatca    21420
tatgcgtcca catgtcagtt acgcctaata cagaatcggt tggataaggt ggggcaaagc    21480
ccacctcatt ttcatttgat gaccacggtt ctgatcttcc aaatgtgata aagatagtgt    21540
ttttatccgg accacttcca attgaattat aaaaattcaa cattttttct gttctaaatt    21600
ttgaagtaac tatcgcacga tagataacac ttgaatcatt catctatttt aacctgtgtt    21660
ggattttcag ggtctcttgg atttcctata ttatctttta gacgtttatt aactaaatct    21720
ctaaattgcg caaatgttgt tccagatgca tcaaataaag gactcattaa tttacgtcgt    21780
tcagacggca attgaccttg aaatattgaa ttattatttt cagcattata gtcatcagga    21840
agaggatatt ctacaccagc cattgggcca ggctcataaa ttgcttcgcc tgttactgaa    21900
tcatgctcaa tttcaccggt tggagttaat ttagctactc tatcagcata ttcagtaggc    21960
aatccagaat cccatttata gtttttatat ttattaatta ttgtctctgt gtgtttaaga    22020
gttaaaccaa cattaataaa catcgttaaa agggtaattg ctataaatcc aaatcctact    22080
ggatgaacaa aacgaataac gtcagatttc cagcgggaag aaggtaaatt ggatttaatt    22140
ttcattacat agtatgatct acttctatta atatagtcta tattgttttg aagcaaatcc    22200
```

FIG. 17M sequence.txt

| | | | | | | |
|---|---|---|---|---|---|---|
| tttccttttaa | ctccacgaat | aatttcgcct | tcaaaactag | ggagtctttc | tgctttaact | 22260 |
| tcttgaccag | caattaatct | tcccaaaaga | ttatgaatag | ttacggtcca | ttgcaattta | 22320 |
| ccattagaat | aacttctttc | tatataagta | acattacatc | ttcctgttgc | cgtataaatc | 22380 |
| gtttgtccta | ctaaatcttc | agtcaaagaa | tcagattgaa | cgattatgtc | atattcagta | 22440 |
| ccggccccag | attcaatttc | aatttcaact | tcttcattat | aaagaacttt | aaaaagaaac | 22500 |
| ttgtatgatg | cttcaattcc | tttagtagaa | taaaaatcat | agctacgtga | ttcaaagaat | 22560 |
| ctcgcaacag | catcacgttt | atcagcattt | aaataaatgt | ttcttttata | tatctctgac | 22620 |
| cacaaatatt | cccacgcatg | ctcttctcgt | ggatattggt | tacgaattaa | atttcgtaaa | 22680 |
| ttgttatact | gagttccata | tccatcagaa | agatactgaa | tatatgcttc | gcaaaatgcc | 22740 |
| tcaaaattcg | aatcctgcaa | caaataagaa | tcaggcatca | ttgtgccaat | taatggtctt | 22800 |
| aaatcaggat | cagctaatcc | atgctcttct | tctggtgacc | aaggagtctc | atgctcttgg | 22860 |
| ttttgtaaaa | atgcttttaa | aaatactcca | gtcggcttcc | aaataatttc | tactgtatct | 22920 |
| ctcacacgat | agttaaaatc | atagtaagaa | attatttcac | cagaagattt | ataaaaaagc | 22980 |
| atcccagacg | cataattttt | aaatcccgtg | aatttaacat | ttggcattac | tatcgtacaa | 23040 |
| tcaccatcat | cccagtattc | atgaactaat | ctatctggtg | atgtttccgg | aatattttct | 23100 |
| ataactttag | tgtattttaa | atcagcataa | actactacag | ctctattaga | gttgtttatc | 23160 |
| caacagcgtg | tgttagattt | tttagaccaa | ttaaagaacg | gttctgcgta | gtatttcatt | 23220 |
| ggttgaggag | taaaagtctc | ccaatcagat | ttttcatccg | ctataaatgc | catcatatga | 23280 |
| taatgcttat | cagctaacca | ttcacgggga | aattcatatt | taacagcacc | gattaactga | 23340 |
| tatttcacca | tagtttcagg | gtcattaaca | acattatcac | ttaaaaattt | aaaattactc | 23400 |
| gaagacagag | aaactaattt | accgtcagtt | gacatgtttg | cgtatccagg | ttgaatacgt | 23460 |
| cttctttctt | cttcggtatt | accgaaaact | cttttccatg | ttttttcgtc | atgatttaaa | 23520 |
| acatatattc | ctttatcagc | agaatcaatt | attttgaag | ttctcggatt | ggcatttaat | 23580 |
| gtttcaactt | caccaataat | aagagcaaaa | acttatcac | cgatagaatc | cattttatag | 23640 |
| catactgctt | taggatttcc | agttatagtc | attgtatcag | gttcaaaaag | tctttccgag | 23700 |
| tatgttggtg | ataacgggtc | agaatctata | ggtgcattac | tcgttttttat | atatctaact | 23760 |
| ttatctctgg | caacaacata | gatataatca | tccgtacaag | taatggcttc | agctatacga | 23820 |
| tatacattcg | ctggtaaagt | cgcataagta | ccaaagattt | ctacatcaaa | tcctaaatgt | 23880 |
| aactggtcgc | caagtttagc | aaatgttata | tcctgcgaac | tgaatctgac | atcatctgct | 23940 |
| gaccatctaa | cgtcagtcga | tttacggcca | tagaaaatct | tgtcgtatcc | tagaacgtat | 24000 |
| gttgtgttcg | cagattggta | atatactgtc | ttagataaag | gatatcctac | acggtcattg | 24060 |

FIG. 17N sequence.txt

```
aagagcttca cagcttttcca ggtttgtcct ttatcattag atactttaac cacgggttga      24120
taacgctcaa aaagatatag aatcccttct gattccatca aataaactcg gttaatatcc      24180
ttacatactt gctgaatgga accttgtatt tcatgatact cattttcacc aataataaaa      24240
ttactgattg atgaaacatc aacatatgat gggctgaatt ggaacgattc attcatcaat      24300
gcagccatta tagtgtcatt attaaaattg acataattag aattgttaag agtaaatttt      24360
tcctgaatga atttattggc taattgcatt tcaatcatgt tttgaaatgt gtaagcattc      24420
gtagcaaaag tttcaaactc ttccgtataa acccaatcag attgctcaaa atcttgtgca      24480
gctgtagcta ctctaatgat gtatgatgtt agtggatcag catcatcaaa aaagaaacta      24540
ttgtttgctg tatatcctaa attaatccaa cgatattgat cactcgggag attttccccc      24600
gagtctgttt ttgtctcagc gatttctaca aaatagtaga aattagcacc aacgtcatcc      24660
cagcgtactt gcacctgatt tgcggataac ttggaaattc tgagactagt gactgaaggt      24720
gcttttactg tcattgtgat ataggctcca aatcgatagt taagtattgc ggacgtaaat      24780
cattttcaaa tacaatcagt gaaccatcac gggtaaagat aacatcatcg gttgggtcag      24840
aatataattc aatagtctga acctcaaatt tttcagatgt taaattaatt ttagcgtatat      24900
tccaataaat catgtcagcc ggataattta tttcaccgat aacatagtat ttgtcgcgtc      24960
catcagaatt tgctaattta ttaaaatcat tgcctgtata tggctgaatg ttttcatttt      25020
ctgtaacatc gccagaagca aatggaccaa taataacttt accaattcct ttagaatctc      25080
ggtctgttga tactatacga acatcatata atacatcttc ttctaaacca gtatcaggat      25140
ttacaacctt tcgtccagaa ttaaatgaaa acgtattaga ttccatagaa cgatctttta      25200
tttgattatt gtatttaata cctgcttcag gtgttttata gaagttttgt acttcacgaa      25260
ccatttgaat agtcgctgat gaaccaatga cagaatgatc tgcatcatct acataagtta      25320
acatcttaga tttagcgaaa gacgagttaa aaatttctac atcttcggta taatagcgat      25380
caattttatc aattatttga ccttcaagcc actgctcgga ttcttgtagt ttatttaaag      25440
catatgtgac ttttaaatta gtcttaataa aaagataatt aggagaaata attgatggcg      25500
taataggagc taaattatag tctttgagat aatttttaat atcttcacgc tgtacagtag      25560
ttaaatacag acctgattta ggtttagcag caataaatgc atacccaggt ttagtagaat      25620
cagtgaaagt ctgaactgcc tgaataatag aaccaaatct ctctgaaacg aatgtatcgt      25680
agtcagtcgc agttacgcat cgttgctggg tttcgcgttt aatagtaccc aattcgcgaa      25740
tacgctcaat atcttctgga tcaccgcctc catctgcccc aacaaaatct gggtcaccgt      25800
ttggattttc attaatattg atgatagtta tatttgttaa tgtatctgcg tatgaaaatc      25860
cgactgctcc gttcgcgtca gcaccattag tactaatgta ctcaataaca atcgtagagt      25920
tctgagtagg tttgagacct ccgatataat tagcggtcaa agctccttca gaagcattaa      25980
```

FIG. 170 sequence.txt

```
cagaaatttc accttcacca aaatagaatt cagtgtttcc atcaatagtt tcacgcatgt      26040
agtaaattgt tgatgtagaa ccagcatgaa ccattgactt tcttgtccag ttaatccatt      26100
ccgctccatc aacgtataat ttaacctggt ttctatcaat atttttatca taaatgataa      26160
taggtgtcaa tttatcataa atgatttcag ttcttactat acgtccttgg gccaatttta      26220
atcgtggaaa atattggtta tttttatcac gaatagcaat aacatcttcg gtagatacaa      26280
agttatatgg attaacagaa gtatcttttg catatgctaa aaagcgagtt ccgcgaggaa      26340
ttgtaatgta attcctattc aatgcgtcgg tgcatgttaa cataatttcg gtctgcgcag      26400
cggattttga agtaggtaaa tatccgttat cttgtgcagc ttgaacaact gaacttcgta      26460
agttagcagt acgcataaag cttttcataca cagcagcatt accaaactgc tgaatgtaca      26520
atgtattata agccaaaagg tcacacagaa cgtttaatct tgagccttca aaatcataat      26580
ccaaaaattc attttggcca ttaagccatt caatgaggtt ttgttttatt tcagcaaacg      26640
tacccccgac gaatatctcg ggaatagcat ttgctgttct tgttaattga taatttacag      26700
gggtatttgc cattttaaat cctatttaat gaatacttta gatgatgcct gagccacagt      26760
atcaccgcat gatattggat cagccatttg aacagctttc tttccagtga catataccttt     26820
agaagttctg ggttgtgtca ctccgccatg tgtttcatat ggcttttttaa tttctgtatg     26880
ttctgtaatt ggatcacctg ctacgagaac agcaattcct ccagtgaata ctttactttg      26940
tgtggcattc acaactgttg gaggccatgc ttcatggcca gcagtaacac acttatcata      27000
acttaatcct gacatctatg acctctcata cacatagctt cttaatttat tagcccaacg      27060
actccaattt ccaactatag ttttttgtgta attttttaact agagtttttc ttactggagc    27120
aggaggatcc gtcggttcag tagtatcaga ggatgaccta gaattactgc cagaacctcc     27180
agattcactt tgttcttggt agtcatatat taatgttact tcgtaagtga atgtcttctg      27240
gaggttttga ggagctttcc ataaatacaa ctgagtatca gaatcagtag gaagttcttc     27300
ccatgaagca gcagttttaa attcatcgcc taaacgatat ttcaacgcgt catttccaaa     27360
tccaaacaca gattcatatg ttccgtataa gcgatttttct tctactaaaa ccccaggagt    27420
ttcttcgtaa ctagttatat ttatagatac taacgtttca cctgtttcta attgagcggt     27480
aaaggtgacg tcgatagaag aaccttccat ggattctcct aaatcagcgc tcattggaag     27540
tatattagcc aatgtcaatc ctcgatccat caattgtgta ttgaccagat gaaatagaac     27600
tcatagatgc cattttttct gtccaatcac caccaacgtc caatcaact gtcccagcaa      27660
ctttccaaga aagatttcca tttactgtgt tagtttgatt tccttcaact aaagtggtag     27720
catctccttt aactgtaatg tcagcattac cttcaactac aatagtaaca ttacctttaa     27780
ctaggatagt tccattgcct tcaactgtct tagtttcatc gccacgtaca aatattgtat     27840
```

FIG. 17P sequence.txt

| | | | | | |
|---|---|---|---|---|---|
| tgcttccatc | tatttggtga | agacgattat | ccatgttgta | ataaatttct | gatccaccga | 27900 |
| cgttagtctt | tttatcaccg | gctaccaaaa | aattaccatc | agcgttggtt | atatcataca | 27960 |
| aattatcgac | agtttttctt | gttcttcttc | ctgacggtga | tacttcttca | taagttccag | 28020 |
| tcggatgaac | taatctgtat | cgttcttgcc | caggagtatc | atcaaattcc | tgaatatgtc | 28080 |
| cgctttcagt | ttccattgta | tgcacataag | gatattcacc | tttatatgaa | gaaactggtt | 28140 |
| ctttgaataa | aattctcgag | tcatttggaa | taggagggtc | agccgggtca | gaagatttag | 28200 |
| ctacagtagc | agccattgct | gatagagacc | tagctggggt | tttcacttca | acaccatatg | 28260 |
| attccaaatt | ccccgtaaga | ataatcatgg | taacacggga | tgcacggcct | tttgtttgtt | 28320 |
| gataccacaa | tgaatcacga | ccggctttat | atgctttttc | ccaatctccg | gctaacatag | 28380 |
| cagttaacat | tgtgttaaat | ttagctacac | cgccaacacc | catttgaaat | gccatatttt | 28440 |
| ctaacgccat | tgacgagaa | cggttgacag | cttgccagac | tggtcctact | ttagaatgtg | 28500 |
| atttaatgtc | ccgttgcata | tcagccaaat | cacgttcaaa | taaagtcgtc | gcctcttcca | 28560 |
| tcgtaataga | acctgggttt | ccagtaattt | cacgaccaac | ttgttttgat | aaaactttat | 28620 |
| taatttgagc | catatcacga | actggctgct | tcatgataag | atgaccaata | ccaattgtcg | 28680 |
| gatatccttc | agtatcccaa | taaactttta | gtcttaatcc | ttcatcacgg | cgaagcatgt | 28740 |
| cagccattga | catatttgga | ttatcatcgg | ttggaatctc | tgatagtggt | ctatcatcgg | 28800 |
| gatttattgc | agtgtctaag | ttactatctt | ggataatgtt | agaagacgaa | tcatatccta | 28860 |
| cttctccgcc | ttggtttaat | acattagtat | catttcctaa | acgtctagga | tattgcccag | 28920 |
| ttgggtcaga | aaatccttca | agtctattcg | gttttttcgcg | aactattcca | ccatacgtgc | 28980 |
| caaggacaat | tccgttagtt | ttccatttgt | ctaaaaaatg | accataaact | ctagttcctt | 29040 |
| ctaccggtcc | agtaacagaa | cctccaattc | cagacattgc | tgcagaagtt | ataggttgaa | 29100 |
| taactgacat | ccatggtaat | ttttcagttg | gaataccat | tacatcgcct | tgtgctcttt | 29160 |
| gaggtggatg | cagaccaacc | acacgaacac | gaacacgacc | taatttaat | gggtccattc | 29220 |
| tatcttcaac | aacaccaaca | aaccaattaa | ggttattact | tatcatttcc | ataagatttc | 29280 |
| tccattatac | gtataaggtc | gttcataaat | gaattaatgt | ctgattttgc | tattattttt | 29340 |
| atttgacgaa | gtttttcatt | ttcaagaaca | gcatcttcat | acgtattaac | agcagcaagt | 29400 |
| gctccttcat | attgaggata | ttttctagct | ttatcacctt | tatcatacca | aacatatgga | 29460 |
| ttatcatcgt | atgatattaa | attataaaat | ttttcaccgt | tctcattcac | atgatatact | 29520 |
| atttggtctc | cacctacatt | tttgtatttt | tgtatagatg | cttgataagc | tgcttcttgt | 29580 |
| gaagtaatcc | atccataata | cgggtcataa | ttatcattac | acatcaataa | aacccaatac | 29640 |
| aactgtggat | ttccatatat | agtatttgct | aattcttccg | ggcgtggtga | acctttgata | 29700 |
| taataagtac | gtaagcggta | tcccgcaaga | gcgcgtttaa | aatagtcttt | atagtttcta | 29760 |

FIG. 17Q sequence.txt

| | | | | | | |
|---|---|---|---|---|---|---|
| aaaatatctg | tcataggaat | agtcggcgcg | tttttattca | ccgttttggc | cgcatattca | 29820 |
| atcggatcaa | aaaatgtaaa | gagcatgggc | cctcctgttt | ataaatatat | tatctattta | 29880 |
| taaggagaat | ccaatggcat | attctggaaa | atgggttcct | aaaaatatat | caaagtatag | 29940 |
| aggtgaccct | aaaaaaatta | cgtatagatc | aaattgggaa | aaattctttt | ttgaatggtt | 30000 |
| agataaaaat | ccagaaatta | ttgcatgggg | tagtgaaaca | gcagtaattc | cttattttg | 30060 |
| taatgcagaa | gggaaaaaac | gtagatactt | catggatatt | tggatgaaag | attcttctgg | 30120 |
| acaagaattt | tttattgaaa | taaaacctaa | aaaagaaaca | caaccaccag | ttaaaccagc | 30180 |
| acatctaaca | actgcagcga | agaaaagatt | tatgaatgaa | atttatacat | attccgttaa | 30240 |
| tactgacaaa | tggaaagcag | ctcaagcttt | agctgaaaag | cgtggaataa | aatttagaat | 30300 |
| tttaacagaa | gatggattac | gagctcttgg | ctttaagggg | gcataatggc | tatttttcaa | 30360 |
| ataattaatg | aaagcactcc | ccaagttcca | aaggttaagc | aatcattaaa | cgaaaagaaa | 30420 |
| tggattcaga | taggtcttga | atataaaaag | gccaaagcaa | aaggaatgac | cggaaagcaa | 30480 |
| tttgctgaag | aaagaggaat | caaatactct | acgtttactt | cagcaatgtc | aaaatatgct | 30540 |
| tcaggaatta | aaacggctga | aaagattcaa | aagcttgaat | caaaaccaat | gaataaactc | 30600 |
| aataagcaag | aaagacaact | gcttatgata | aattcattca | gacaaacatt | gcgcgataaa | 30660 |
| attcgtaatg | aaggcgcagc | aattaataat | aaaaccagaa | agtggtttgc | tgaaactatt | 30720 |
| aagcaagtaa | aaggacataa | agttgttcgc | ccgcagccgg | gacgaatata | tgcttttgct | 30780 |
| tatgatgcta | aacacaagga | aactcttcct | tactgggata | aatttccttt | gataatttac | 30840 |
| cttggtttag | gtaagcataa | tttaatgtac | ggattgaact | tgcactatat | tccacctaaa | 30900 |
| gctcgtcaac | agtttctaga | agagctttta | aagcaatatg | caaatacacc | tactattact | 30960 |
| aataaaacga | aattaaaaat | tgattggagt | caagtgaaag | gatttagggg | tgcagaccaa | 31020 |
| atgattaagg | catatatacc | tggtaatatt | atgggtagcc | ttgttgaaat | cgccccgaaa | 31080 |
| gactgggcga | acgttgtgtt | aatgccactt | cagcagttcg | tttcaaaagg | aaaacgtttc | 31140 |
| tctgcaaaca | aagtctggtc | aaatatctaa | ttctattatc | ttccattctt | ttctgttgtt | 31200 |
| tgttctaaat | ggaattgaat | ggaagggact | tagaccatt | ataccaccaa | cagttataaa | 31260 |
| gcattatgag | gaatatatgt | cgcaagcact | gcaacaaatt | tttaaccaag | caaatacaac | 31320 |
| taactttgta | gtatcaatac | cacatagtaa | tactacatct | gcttttactt | taaatgctca | 31380 |
| gtcagttcct | attccaggaa | ttagaatacc | tgttactgat | accgtgactg | ggccgtttgg | 31440 |
| actgggccga | gcacaacgtc | caggtgctac | atttgagtac | gatccactca | tcgtgagatt | 31500 |
| tatagttgat | gaagaactta | agtcatggat | aggaatgtat | gaatggatgc | taggaactag | 31560 |
| caactatctt | acaggtgaaa | atactgccca | aaaaacaggt | cctgaataca | ttacgcttta | 31620 |

FIG. 17R sequence.txt

```
cattttagat aatagcaaaa ctgaaatcgt gatgtcaata aatttttata agccttgggt    31680
ttctgacctg tctgaagtag aatttagcta cacagaagat tcagacccgg ctttagtatg    31740
tacagcaacg attccttata cgtattttca agtagaaaaa gatggaaaaa ttatagcgga    31800
agtttaatgc ttcagtttca tgtgttataa tcttaactaa atttgaggag aaacatatga    31860
aactaatctt tttaagcggt gtaaagcgta gtggaaaaga tactactgct gattttatca    31920
tgagcaatta ttctgcagtt aaataccaac ttgctggtcc tattaaggat gcattggctt    31980
atgcatgggg agtatttgca gcaaataccg actatccttg cttaactcgt aaagagtttg    32040
aaggaattga ctatgatcgt gagactaatt taaatctaac taaattagaa gtaatcacga    32100
ttatggaaca agcattttgc tatcttaatg gtaaaagccc aattaaaggt gtgtttgttt    32160
ttgatgacga aggacaagaa tcagttaatt ccgtagcatt taacaagatt attgacgtta    32220
taaataatat tgaagatcaa tggtcagtcc gtcgtctgat gcaagcccta ggtacggatt    32280
tgattgttaa taacttcgac cgcatgtact gggtaaaatt atttgcttta gattatcttg    32340
ataaatttaa ctcaggttat gattattata tcgttcctga tacccgtcaa gatcatgaaa    32400
tggatgcggc tagggcgatg ggtgctacag taattcatgt agttcgtcct ggtcaaaaat    32460
ccaatgatac acatattaca gaagctggat tgccaattcg tgatggcgat ttagtaatta    32520
caaacgatgg ttctcttgaa gaacttttt ctaaaattaa aaatacacta aaggtactat    32580
aatgtctgaa caaactattg aacaaaaact gtctgctgaa atcgtaactc tgaaatctcg    32640
tattcttgat acgcaggacc aagcggctcg tctgatggaa gaatccaaaa ttctgcaagg    32700
aactttggct gaaattgctc atgcagtagg tatcactggc gatactatta agttgaaga    32760
aatcgttgaa gctgtcaaga atcttactgc tgaatctgca gatgaagaat gatggaattt    32820
aaagactttt caacgggtct ttatgtagca gctaagtttt cagaattaac acttgacgcg    32880
ctggaagaac tccagcgctc tttacgtgtt cctaatccag ttcctagaga aaaaattcat    32940
tcgactatat gttattcaag agtaaatgtt ccatatgttc catcgagtgg aagttttgaa    33000
gtagcttctt ctggacattt agaagtgtgg aaaacacaag atggatcgac tcttgtactt    33060
gtgctagatt ctgaatatct gcgctgtcga cacatgtatg cgcgggcact aggtgctaca    33120
cacgattttg atgattacac accgcatata acattgtctt ataatgttgg gcccttatca    33180
tttagcggtg atgtacaaat tccggttgta cttgaccgtg aatacaaaga gcctcttaaa    33240
ctcgattggg cagatgattt aaaataattt cacaaagttg tttacatact gatgaggtag    33300
tgatactatt acctcatcaa aattaattag gaaaataaaa atgaaaactt tcaaagagtt    33360
tgctacaaaa actactatca ctgaatcttc ccacggtatg gaagtaaagc ttggaatggc    33420
tttagctgaa gctgagcgtc tttttctctcg tattaaagaa cttgctgctg cggtcgatcc    33480
ttcatctttt aaaggagacc aaactaaagt taaagcactt ttagcattat gctccgatgc    33540
```

FIG. 17S sequence.txt

| | | | | | |
|---|---|---|---|---|---|
| aggagaaatt | gctaaaaatg | gttctaagat | gaagaaacga | ttagaagatt | taaaataatt | 33600 |
| tcacaaagtt | gtttacatag | ggttttagtt | gtgatactat | taccctatca | aaacaaaacc | 33660 |
| aaatggaaat | caaaatgaaa | acttaccaag | aatttattgc | tgaaactgct | gatgtaaaag | 33720 |
| ttgagtttat | ttacactggc | aagaaagata | aaatgggtga | aatgcctcat | ggagttcttc | 33780 |
| gtgatgcatt | agataatttc | ggtcaactcg | ccgcagaaga | ttacggtgat | aaaattgttg | 33840 |
| ttactggtcc | tgctgcagtt | attgaaaaat | gggcagcaga | aaataaatca | atttttcgta | 33900 |
| aaaaataagt | ttactttag | ataggtagt | gatactatta | ccctatctac | tactgaggag | 33960 |
| aataaaatga | aacgttgtga | attaattcga | aatgttgcta | ttgcaatttc | tgcttccgct | 34020 |
| ttcagttttt | caatgtttgt | tggatttata | tgcggattat | tgactacggc | agaaaatgtt | 34080 |
| ttttcacttg | tagtagcatt | tttaattggt | ttaattgcta | ttgttatgga | taaaatttct | 34140 |
| aaaggtgaat | aatgaacgtt | gaatattatg | tatatgcgga | ttacgaaaat | aatccgtcta | 34200 |
| aagatgaaga | taatcgttta | ggtgtagatg | ctttcgattc | ccctgcggcg | gcatggcaat | 34260 |
| gggttgaaag | aaccgatatt | ccttaccgtt | atattgaagt | ggttgaccac | gcaggaaaca | 34320 |
| agtatcctaa | ggaagcatat | gttgcttccg | ggaaggtaaa | tttccttttg | tttgcaggtg | 34380 |
| ataattatta | tccccgtggt | gggtataccg | atttaattgc | taaagcattc | tctgaagatg | 34440 |
| aactccgtga | cattatcaaa | gaaaatgaaa | acaaaccgat | ggattctaat | cgcttttgatt | 34500 |
| ggtggcaaat | cgtaaatgct | aatactcaca | ctattgttga | tgaaggctga | taatgattct | 34560 |
| ttatgcgaaa | gtatcatcca | ttgaaaatgg | atataaatat | gatcaagacg | cggctaaagc | 34620 |
| tttgattgat | gattatggca | ttttaacatg | ttttgaagtt | gaaaaggttt | acattgaccg | 34680 |
| ttcatcttct | caagttaaat | tagtgaagga | agaacgtaaa | tttaatacag | taaattttga | 34740 |
| tttctttatt | gaaacagaaa | aaggtcctct | tgaatatgat | attttcaaga | atcctttggg | 34800 |
| tcttgaatgc | atcgtaaata | tgtattatta | taaatggtaa | atatgcttta | agaattattt | 34860 |
| gttattatta | actcatatcg | cactgattaa | taccctctat | catcaagggt | tcttgcttaa | 34920 |
| gagcctttgt | taataattgg | gaattagcca | agttggtaag | gcactggatt | ttgattccag | 34980 |
| gatgcaaagg | ttcgagtcct | ttattcccag | cgcgagaatg | gccaaattgg | taaaggcaca | 35040 |
| gcacttaaaa | tgctgcggaa | tgatttcctt | gtgggttcga | gtcccacttc | tcgcaccaaa | 35100 |
| tttgcggata | tcgtataatg | gtattacctc | agacttccaa | tctgatgatg | tgagttcgat | 35160 |
| tctcattatc | cgctccaatt | taatttactc | cgtgtagctc | agtttggtag | agcgtctgct | 35220 |
| ttgggagcag | aatgtcgtag | gttcaaatcc | tgccacggag | actggaggcg | tggcagagtg | 35280 |
| gtttaatgca | ccggtcttga | aaaccggcag | tcgctccggc | gactcatagg | ttcaaatcct | 35340 |
| atcgcctccg | ccagttttgc | tgatttagct | cagtaggtag | agcaactcac | ttgtaatgag | 35400 |

FIG. 17T sequence.txt

```
aaggtcggcg gttcgattcc gtcaatcagc accaaggccc tgtagctgga aggttcaagc    35460
aagcgactca taatcgccag atggtggttc aattccaccc agggccacca aattaatttg    35520
gggagttatc ccgtagaggt agcggtgtgg actgtaaatc cattgtcatt gcgactcggg    35580
tggttcgact ccaccactcc ccaccaattt ggatgtgtag ctcaatggca gagcgatcgc    35640
ctgttaagcg attggttata ggttcgaatc ctatacgtc cgccaaattt gtgacaactg    35700
tcacattaat atctacttga cgcgattata ggggttgaac tgatcactct tctcttaatt    35760
tcgtgtgaag acatcttgat tgttggagta ggtattaatg tggccgtagt tcagttggta    35820
gaactcgaga ttgtgattct cgtagtcatg ggttcgactc ccatcggtca ccccaattac    35880
ggggcatagc tcagaaggaa gagcaaggac cttctaagtc ctaggtcgta ggttcgatcc    35940
ctactgcctc gaccaattat aagtgaggaa aatatgaaag gtaatgttta tttagtagtt    36000
catgatttaa cattctattt taatcataat gatactgtta tttctgaacg tgtaattaat    36060
ttgctttatc agcatgcaga ttatgtttat gtcgaaaacg aatatggtca ttggcaattt    36120
ctcaaaaatc gttcatttgg tttagatggt tacgaatatt ttgatcgtaa agacctttta    36180
gatacaattc cgttatctac acaatatcaa aatcataagt ctttacataa atgccggcta    36240
attcgaaatg ctgaatccgc gtatgaagca attgatttgt ggcgtaaacg ccgtgaatat    36300
attgattctt taaaagaata ttaagaaacc gggtcgctac cggtaagtcg tcggactgat    36360
gttccctgga gtatagtttc ctcccacagt tttactgtgt tctggctctt tactatcaca    36420
gcagaaacgg cgcaccgaat tatcgattcg aggaaatatc tttgccgtaa gccgagtagc    36480
gtttttgacg gaacgttcgg atatggtcga gatatggcct ttttaaaaata ttgagtagcg    36540
tcaactactt aataaccggg ttcgaatccc ggcgtttcgt acaaacactt gccttagcag    36600
gtggaacccc gacaaggttg ccgcaaggct tagccccgac cgaaaggttg gggctttttg    36660
gtataaatat tagtatatta aatctacaaa ttaaaacagg aaataagatg aaatcatata    36720
ctcaattttt aaatgaagcg gtgttaaatg aagcatctag caccgaaatt caagctgttg    36780
caaaagctgc cattgccgcg ggtaaatatt cctataaaga tgcttctgat gaatcgcgat    36840
tccagtttgc acgcgacatg aaagcggaag gatttacggg aaatgcagtt agtatggcct    36900
ggaaaagttt agttgctact ggcgctgctt ttgcaaaggc ttcgggtaaa cctgctccta    36960
aagcagatcc taaagcggca caagaaaaaa atatcgttaa aggaattatc gctaaatatg    37020
aagctatcct taaagagctt ttagtaatca aaaccgaagg ccaaaagtta gcccgtgctt    37080
atagtttcaa agataatcca catgttcact ctcttgagta tgttgaagac atccaaaaaa    37140
ttattaaaga ccgcatttgg tctgctaaac aaatcaaatg acattcttag ccccgaccga    37200
aaggttgggg cttttagtt tgaatcactc ggataacgct gttacggata gtaacaaagt    37260
aataaataat taataaccaa ccgataaatt atttcaagga ttttaaatga aacctatgc    37320
```

FIG. 17U sequence.txt

| | | | | | |
|---|---|---|---|---|---|
| cgaattttta | accgaagcag | caaaattacc | atctgaagca | gatcttacta | aagtattctt | 37380 |
| ccaattggac | ccaaaagacc | gcggcgattt | tcttaagtgg | aaagctaaag | ctattgaaat | 37440 |
| gtacaacatc | gataatagtt | cttttacaat | gagtcaagaa | aataaattca | ataaagcatt | 37500 |
| tttcaaaatt | tctaagaaat | tggcatctgg | cgctcaggtt | cctaaatctg | tgttagctac | 37560 |
| tcctgaacgc | gcacctgtta | aaatttctaa | gaatatgttc | gacactaaaa | aatacgttaa | 37620 |
| tgctttgaat | aaagctcttg | atgcattgga | tgatgcaaag | aaggcagccc | gcgatcttca | 37680 |
| agacgtgtac | accgattttg | accgcaaaac | taaaggttct | atttcaaata | gcgaacgcaa | 37740 |
| tagtgtaagt | gtttattctg | atagccttga | tgttcttggc | gatgcgtata | ctgaaattaa | 37800 |
| aaatcgtatt | aacactgcat | ctaagctaaa | agctgctgca | gaagctataa | taagtaaact | 37860 |
| aggtaaataa | ttttaaatcc | ctatctaaat | gatagggctt | tttggtatct | aggcctttct | 37920 |
| ggacctctct | aggcatcatt | tagtttatac | cctttataat | atattatcct | atcctttaat | 37980 |
| tgcccatccc | tgccctagaa | ttccctaaaa | attttttcac | aaaactgttt | acatctctgt | 38040 |
| tcttccatgg | tactatacaa | ctatcaacta | ctgatacaga | aaacaacttg | gagaatgaaa | 38100 |
| tggataatta | cggcgaactg | ttcaacttct | ttatgaaatg | cgtttcagaa | gatttcggtc | 38160 |
| gtacagtgaa | tgatattaaa | gttatcggtc | ctgatcatcc | gatgtttgaa | acttacgcag | 38220 |
| taatgggtaa | tgaagacggt | cagtggtata | ctgtaaaagt | tgtgattaat | atgttcacag | 38280 |
| cagaaggtta | tgttaaactg | tcttctaaag | tttaccatga | taacgacgaa | atcgcggaag | 38340 |
| aatatttcaa | taatatgaaa | taagtttacg | caggctcatg | attgagatat | tatgagccta | 38400 |
| taatttgacg | atagagtatt | atactcctac | ggattttaaa | tctcaattaa | cctaaggaaa | 38460 |
| tactatgaac | acactgaaga | aaattgttga | gtttattcgc | actaaacttg | gttctgctat | 38520 |
| ggctaaaaat | ctatctgtcg | aagaacagta | tactgctgca | gcagcaaaac | tacttgataa | 38580 |
| aattaaagat | ctaaaaactg | cttctgttaa | atctattaac | gaagaaaaac | gtattcgtga | 38640 |
| acttgttatc | gaaaagaatc | gacaggccga | atcaaaagag | cgtgaaattc | gtaaacttct | 38700 |
| ttccgaaggc | caagatgtaa | caatgcatgc | taaactcggt | ttactatatc | gtcgaacagc | 38760 |
| tgagcagttg | actactaagg | ctgacggtta | tgctgaaatg | cgaattgaaa | tcgccaagaa | 38820 |
| agtagttgag | ttagatgatg | ctcgtcaaga | acttgcggtt | aaattggaat | atatccgtga | 38880 |
| aactcgtgca | gcaaatgccc | ttggaattag | tactgctgat | gatgtagttg | aaattgcagc | 38940 |
| actgactaag | gttgatattg | aagataccct | tgctcgagtt | gaaaccttta | acggtaatat | 39000 |
| ttctggggtt | gaaactacct | ctgccgatgt | tcaggaatac | attaattctc | tgaaataatg | 39060 |
| ataagggggct | tcggccccctt | atacttggag | taaataggaa | tgaaaatgaa | aatgcaaagt | 39120 |
| gatttcaatt | caatgtttga | agagttccaa | agacaggttg | atgttccaga | ccaattacta | 39180 |

FIG. 17V

```
                                  sequence.txt
aatgctctta aacgcatggc agaaggacgt aattactatt gggggtcttc atatgaaact    39240
gatgaaagcc tttccggaag attttctaga ggtaaaaagt ctttaatacg tcctggaata    39300
ctcattaaca gtattgaatc aattcattca ttgacgtgtg attttgatgt tgaatttact    39360
gatttcattt ctcctgaatg gacggtttgt tatttaaacg acgattttga ttatctcggt    39420
gtttatagtt taagtgacgc atggtttaaa cgtaatttac aaaagtcaaa tttatttat    39480
attgatacta ctgtaaaatt tcagggcaag aaatatttct ttactcttat agttgattct    39540
gaaacgaagc atgaaaataa acgtattctt agtaaaaaga atatcttaac tattgttgat    39600
gatcttttg ataaatttgt agaaaatccc aattttgaaa gtgatttatt actagaaaaa    39660
tttgttaagg aatgtagaga atatgtcaaa accatcacta taccttccaa gtaaacctgt    39720
gaagtatgaa ccaaagcgtc agataatttc tactgatgtg ttaataggtc ctgttatact    39780
catatcattt gtaattctat tgattattgg aggtgtttta gatgttatga ctgatattga    39840
ttctggcgaa atacttgtgt taatgctaat tcttccatta atagttccac ttttattagt    39900
acccgtaaat tgggtaggat actggtatca aggaagacat tatcgtaaac gtgtacgtga    39960
ttggaaagct cagtgtaaaa agattaaaaa ggaacaccag cttaagctag atatgtatga    40020
atttgatgaa attatgaaat tgttaaagga atcacgatgc aaaagccaaa actaaataaa    40080
gtcaaatatt cgtttcctga ggcactatta attcttgctg tatcagtatt tacagctctt    40140
gcgggtagtc ttattggatt gttaattgac tgttttattt taaatatcga cggcacagta    40200
attataacag aggtttggag tgaacttcgt tttactatag cgatttcatt attttcattc    40260
tttggtacca tgttatattt tcattatgat aattttaaaa taaattggca agaaaaaaag    40320
gattacaaaa tacaattaaa ggaatataat agctatatgt cttatattga aaaagaatca    40380
atggaagagt ttgtgagtga ttgtaggaaa attaaatgat tttaaaaact cgctggtatg    40440
atttagatga tggggacgat ggcatttcag ttgatagagt tgactggagc ggctgttctg    40500
aagatacaaa gaaacgatta attagggagt ttagaatggg atatcaagca gttaagccat    40560
ctactgtaac agatgataaa ttcgtgtgta ttcataatgg tcgtgctaag ttaacgaatg    40620
ctgaatggtt cacagataag attatgattc tgtggtatat cattagtctt cctgtgtcat    40680
cattcgtatt ttactttttt ataaaaaatc caatggacag aataggagat tggattcttt    40740
taaccatact tgttaatatt tttacagcat caatattatc tgggatatgg tacacgttca    40800
ttgaaatgcc atggcggcta cgcagacaac aaaagatttt tgatgaaaag aaatatactc    40860
aaaatttaaa taactttatc actgaatgca ggaaattaaa atgaaaacat tatcagctgg    40920
tattatcttc atgacagaag ataaagattt atttatgggt cgggttactg gttctcgtaa    40980
gcctggaatg atggcacatc gctgggtatat tccaaaggga cgtgtagaaa gttctgattt    41040
gaatgcactg gaagctgcaa aaagagaatg cttagaagag accggtttta gcaattataa    41100
```

FIG. 17W sequence.txt

```
tccagacctt ctagaagacc taggtgtatt taaatattct agtaataaag acttacagtt   41160
attttattat acgattccag tagagcatga gatgtttaga aattgccatt gcgagtctta   41220
ttttgaaaat aaagatggcg ttatgattcc agagatggat gcttttgctc ttattcctcg   41280
tactcagtgg caatatgtga tgggtccttc actttaccga ataatgaaca gcctctttta   41340
atttataaat accttctata aatacttagg aggtattatg aatatatttg aaatgttacg   41400
tatagatgaa ggtcttagac tcaaaatcta taaagacaca gaaggctatt acactattgg   41460
catcggtcat ttgcttacta aaagtccatc actaagtgtt gctaaatctg aattagataa   41520
agctattggg cgtaattgta atggtgtaat tacaaaagat gaggccgaaa aactctttaa   41580
tcaggatgtt gatgctgctg ttcgcggaat tctgagaaat gctaaattaa aaccagttta   41640
tgattctctt gatgctgttc gccgctgtgc attgattaac atggtcttcc aaatggggga   41700
aaccggcgta gcaggattta ctaattcttt acgcatgctc cagcaaaaac gctgggatga   41760
agcagcagtt aacttagcta aaagtagatg gtataatcaa acacctaatc gcgcaaaacg   41820
agtcattgca acgtttagaa ctggcacttg ggacgcgtat aaaaatctat aaagttgttt   41880
actttctcct agaattgtga tagtatattc acagttactt ggagggataa aatgactcgt   41940
attaatttga ctttagtatc tgaacttgct gatcaacatt taatcgcaga ataccgtgaa   42000
ttgccgcgtg tttttggtat agttcgtaag catgtggcaa acggtaagcg cgttaaagat   42060
tttaaaatat cttctaaatt tattttaggt tctggtcatg ttactttctt ttacgataag   42120
ttagaatttt tgcgaaagcg tcaatcggac attataacgg aatgcttaaa acgcgggttc   42180
agtataaaag atactgaagt tcctgacatc agcgatattc cagtagaatg gaaaaatgat   42240
tataatccat gcaaatcagc tattaagttg agtcaacaac gactcgatga aaaaatttta   42300
atgaagccac actggtataa gtattacggc aaaaatattt acatttaaat aacatgggaa   42360
taacctggac ctcatgattc tgtgagggat tcccgccaac ctgtaataag gtcgagccca   42420
agtgcggtaa tgggtaaata cagaaatgga caattcatgc gccatggaat ggcccaaacc   42480
tagagagaac aaaatgagaa cattttaac tggtccttat ctatccctga tgaatgcttt   42540
tacacaccat tctgatgcta gagtagaaga aatttgtaaa acgaatata tcccgccatt   42600
tgaagactta cttaaacagt attgtacact tcgactagat ggtgggcgtc aatctggtaa   42660
atcaactgca gtaactaatt ttgccgctaa ttggttgtat gacggtggaa cagttattgt   42720
tctttctaat acttcagctt acgctaaaat ttccgcagat aatattaaaa aggaattttc   42780
gcgttattct aatgatgata tacgttttcg tttatttact gattctgtgc gcagttttat   42840
tggtaataaa ggaagcaagt tcagaggttt atcgctttcg cgaatttgt atataattga   42900
tgagcctgtc aaatctcctg atatggataa gatttatagt gtccatattg acactgtaca   42960
```

FIG. 17X sequence.txt

```
ctgctgctgt aatattaaat gttgcattgg tggtattact cgtccacagt ttttcgtaat    43020
cggaatgcaa tgatgacaga cactcagctt ttcgaatatc tttattttc gccaaaaact    43080
attaaaaata aattggtgaa tcattttgaa attttggcaa aaataacat tttgagcgaa     43140
ttttatccca agcaatacaa attacaaaaa ggcgtattca aaggatgcag agttttgtgc    43200
acggctccta atgcacggct aatgaataaa attccatatt ttaccatgga atttattgat    43260
gggcctttta aaggactaat cacacagagt ttaatggcat atgattctga gccatttta    43320
attaaagaac aatcttggat aaatttattt tttaattgag gttatatgaa agcatatcaa    43380
attcttgaag gcacacataa aggtactatt tattttgaag atggtattca agcacgaatt    43440
attgtctcta aaacctttaa agaggactct tttgtagacc cagaaatttt ctatggtttg    43500
catgcccgtg aaattgaaat tgagcaacag cctacagtta aaattgaagg tggtcaacac    43560
ctgaacgtta acgttctgcg tcgtgaaact ctggaagatg cagttaagca tccggaaaaa    43620
tatccgcagc tgaccatccg tgtatccggt tatgcagttc gctttaactc tctgactccg    43680
gaacagcagc gcgacgttat cgctcgtacc ttcaccgaga gtttgtaatg gcaaagataa    43740
ttattgaagg ttctgaagat gtgctaaatg ctttcgccga gtggtttagt aattcaggcg    43800
aacagcaatt taacgaagca tggaacatgg gtgatattaa tggaatttat cctacgacag    43860
aaatttctgt tcaaggatat ggcattcatg aacctattcg tttagttgaa tatgatttgg    43920
gaacaggtga ggaagtaaaa tatgattgaa gacattaaag gttataaacc acatactgac    43980
gataaaatca gtaaagtgaa tgctatcaaa gatgctgaag ttcgtttagg gcttatcttt    44040
gatgctttat atgatgaatt ctgggaagca tttgatagct gtgaagatga tgaactcgcg    44100
aagaattacg ccgaaagcct cgatcagtta actattgcta aaatgaaact caaagaagcc    44160
agtatgtggg cttgtcgcgc agtgttccaa ccagaggaaa aatactaatg gctcaattaa    44220
gcgcagggtt tggttatgag tattatactg cccctcgtcg tgtatctgtt gctcctaaga    44280
aaattcaaag tcttgatgac ttccaggaag tagttcgtaa cgctttccag gactatgcac    44340
gttatcttaa agaagattca caggactgtc tcgaagaaga tgaaattgct tactatgagc    44400
agcgtcttga acagctcaaa aatctacatg aggttcgtgc agaagtttca aagtctatga    44460
ataaattgat tagatttaaa gaataactgt ttactttttcc tcttgactgt ggtataattt    44520
ttctatcagt taagaggaga ataacatgac tatcaataca gaagttttta tccgtcgaaa    44580
taagcttcgt cgtcactttg agtcggagtt tcgtcaaatt aacaatgaga ttcgtgaggc    44640
atcaaaagca gcaggagtct catcgtttca tctaaaatat tctcaacatc ttcttgatcg    44700
tgcaattcaa cgggagattg atgagacata tgtttttgaa ttattccata aaataaagaa    44760
ccatgtttta gaagttaatg aattcctgag tatgcctccg cgtcctgaca ttgacgagga    44820
ttttattgat ggggttgaat atcgtcctgg acgtttagaa atcacagatg gaaatctttg    44880
```

FIG. 17Y sequence.txt

```
gcttggattt acagtttgta aacctaacgc gaagttcaaa gacccgtcac ttcaatgtag    44940
gatggcaatt atcaacagtc gtcgtttacc aggaaaggct tctaaagcag taattaaaac    45000
tcaatgaggt aagcatgaga aaagcactac tcgctggtct attggccatt tcaatgatgg    45060
cacatagctc cgagcatact ttcagtaatg tccaactcga taacatgcgt tacgcgtatc    45120
aattcgggga acaattttct aaggatggaa aatataaaac acacaaaaac atccataaga    45180
gcggattggg tcatataatg gctgctattt tgtggcaaga aagctctgcc ggagttaatt    45240
taaaatctaa accaaagcat catgcctatg gaatgttcca aaattatttg cctactatgc    45300
gagcgagagt caaggaactt ggttataata tgaccgatgc tgaaataaaa agaatgttga    45360
ataaacggtc caattcagct tcctgggcgt acattgaact ttcttattgg ttaaatatac    45420
ataagggtga tataagaaaa gcaatatcat cttataattc gggatggaat gttaaagcag    45480
gttctaaata tgcttctgaa gtcctagaaa aggctaatta ccttaaaaat aataaacttt    45540
tggaaatagt aaatgactaa aattttggtt ttatgtatag gattaatttc attttctgtg    45600
ttagcagata catcatatac tgaaattaga gagtatgtaa accgtactgc agcggattat    45660
tgcgggaaaa ataaagcatg ccaagctgaa tttgcgcaga aattaatata tgcatataaa    45720
gacggagaaa gagataaatc aagcagatac aaaaatgata cattgttaaa acgatatgct    45780
aaaaagtgga ataccttaga atgttcagtt gcggaggaga aagataaagc cgcttgtcat    45840
tcaatggttg accgtttagt agattcttat aatcgaggat tgagtactag atgattgtaa    45900
aatatatcaa gggcgatatt gtcgccctat ttcttcaagg taatattatt gcgcacgggt    45960
gcaattgctt ccacacaatg ggctctggcg tagcgggtca attagcaaga gcctatccca    46020
aaattttaga aatagataaa accactaccg agtacggttc tcgtgataaa ttaggcgata    46080
tgtctattgt ttttaaacat agtcctacgg gatttggtat atgctataac ctgtatacac    46140
aatacgaacc gggtcctaat cttgattatg gtgctttagt aaactgcatg atagaattaa    46200
atctacaggc agaaacccctt ttgtttaaac cagtaattta cattccacgc ataggttgcg    46260
gtattgctgg cggcgattgg gataaggttt ctaaattaat cgacatgttt actcctgata    46320
ttgatttaat agtggtggat tatgaaagta cattacccgc atccgtttga tcctaaaaac    46380
aaagtggaaa ttattcgtca atgggaacgc atttgccgta ctaaatgccc aattaatagt    46440
ccacatgatg tagataaaga ctatattgga acattcgttg aatataccct tattgatagg    46500
aaaggtcgta acaacatgt agaagaatat tgtttaaagg ttacatggtt atgagccaaa    46560
ctagtattct taaaaatgcc cactgcgaaa agtgtgaatg gccagttgtt tttgctttat    46620
gtaatgatga aatggcttgt gatttcgatt attggtgcta ttgttctaat aaaggatgca    46680
tcaatcataa aggtgaagga ttttattcag gatttttatcc ttatcctgat ttcgttaaag    46740
```

FIG. 17Z

```
                                    sequence.txt
aaggtaaacc gaaatgaata gttttgagtt acagtatgaa gtgttacgtg agcttgataa    46800
tttaattgaa ctcgctgtca ataaaggttt tgccattgga atcggtcaaa aagatactgg    46860
tcatttaact atggaaatat ttaagcaaaa gcgaattatt ttaaaactcc tggaaattaa    46920
tatatgagtc tgagtaaaga acaaaaagat aaattgtttg agcttatcca tgaacttcta    46980
gatgagcata cagaagcaaa cacctttat gatgaatacg gcccgctatc tcccgaacag     47040
caagaagaat ttgctgatcg gtttgataag aaagaaaacg aattaatagc ttatgtgaat    47100
atgctttaag aaggtgatat ggcgagttta attttttactt acgcagcaat gaatgctgga    47160
aaatctgctt ctcttttgac tgctgcacat aattataaag aacgcggaat gggtgtatta    47220
gttcttaagc ctgctattga tactcgcgat tctgtctgtg aagtcgtttc tcgcattgga    47280
attaagcagg aagcgaatat tattacggat gatatggata ttttttgagtt ctataaatgg    47340
gctgaagcac aaaaagatat tcattgtgta tttgtagatg aagctcagtt tttaaaaact    47400
gaacaggtgc atcaattaag tcgaattgtt gatacatata atgttcctgt tatggcttat    47460
gggctaagga ctgatttcgc tggaaaatta tttgaaggtt ctaaagaact tttggcgatt    47520
gcagataaac ttattgaact aaaggcagtt tgtcattgtg gtaaaaaagc tattatgaca    47580
gctcgattaa tggaagatgg aacaccagtt aaagaaggta atcaaatctg tattggtgat    47640
gaaatttatg tttctttgtg tagaaaacat tggaacgaat taactaaaaa gctcggttag    47700
tgcaaaagtt ataaataggt ttatctaact aaaggggtat atatgctaca attaactgaa    47760
aagcaacttc gcaatcttac tgttcttcaa ttagatgaaa ttcgtaggga agttggaaat    47820
atcatttcag ctttgcgtcg agaagtatca ctcaaccaat ctccggcaga ctatactaga    47880
ttgcgaaatt ttgaaaaata ccttgataaa gttaaggccg tgcatcggca taaagtaaat    47940
acaggacaaa aatgatagga ggcctttatg gccttaaaag caacggcact atttgccatg    48000
ctaggattag cgtttgcttt atctccacca attgaagcga atgtcgatcc tcatttgat    48060
aaatttatgg aatctggtat tagacacgtt tatatgcttt ttgaaaataa aagcgtagaa    48120
tcatctgaac agttctatag ttttatgcga acgacttata aaaatgaccc gtgctcttcc    48180
gattttgaat gtatagagcg aggcgcggag atggcacaat catacgctag aattatgaac    48240
attaaattgg agactgaatg aaattcagcg acttttcaca aagtggaaaa ccttcaaagg    48300
cagatgaata cttaggttta ttaatggctg cacaagctta ttttcattct gcgcatttg    48360
aaactaaaag ttatgctaga cacaaagcat acgatttta tttctctgag ttgccagatt    48420
tgattgataa atttggtgag caatatttgg ggtattctgg tagaaaatac acgccttcta   48480
ttccagatgc cagtaaactt cctaccgaca caattaaaat gattgatcgc atactagacc    48540
aatctaacag catttataaa gaaatgcctc cagccattca aagcacgata gatgatatta    48600
ctgggatgtt ttaccagagt aaatatcttc tttccctcga ataacattag tctccttcgg    48660
```

FIG. 17AA sequence.txt

| | | | | | |
|---|---|---|---|---|---|
| gagactttt | tcatttacc | ggtttactt | ccatttgagc | tgtgatacta | tacaactatc | 48720 |
| ggataaagag | gagaacatca | tgaaaattga | agcacttaat | caagaaggaa | atatctacgt | 48780 |
| catcattaat | ggtgattttt | tcgtcgacat | ggatgaagtt | actagtgaag | aacttgtaga | 48840 |
| acttcttaag | aaacgttatg | atatgtgtga | tgaagctgca | actcatatgg | cgtgtgcaat | 48900 |
| attctctctt | tcatatgtgg | tggaataatg | actagaattg | aacaagcaga | taaaattaaa | 48960 |
| gaattggtag | ctttaattcg | caaagcagat | gaggaactta | gtgactttgc | ttggttttcg | 49020 |
| gcaggcattg | caaataaagg | tattgaaaaa | tttgaagcta | agttgataa | tgctttagaa | 49080 |
| gcgttagata | tgtttcttga | tgaaattatc | gatcataata | cgagagtgta | agtatgctaa | 49140 |
| cacgcgaaca | gtttgaaaaa | atcattaaat | tagcacgtga | tattgaaata | gattcatatc | 49200 |
| aattagcagt | tgagcattgt | gaaggatatt | catacgatgg | tatagaagca | gctaaaaagg | 49260 |
| atttggataa | atctaaagct | aagttagttc | aatatcttga | aatgattagg | tggaataatg | 49320 |
| aaaactgaaa | agcagatgtt | tttaatgaag | ctaattgaag | aatatgctaa | tgcagtttct | 49380 |
| gactatgaat | gttcttctcg | tgaaagaggt | acagcttttcg | ctaaagaaga | attgaaaatc | 49440 |
| atggttgatg | ctcatacaaa | gcttcagaat | tttattgaaa | acgtcattta | atggtttaca | 49500 |
| agttggcaag | gttatggtat | agtaatcttg | tcaactgcca | aggagaagag | aatgaaagtt | 49560 |
| ttgtttgttg | tgtatgtgat | gattcaatat | aattacccaa | tgtttactta | taatctggtg | 49620 |
| aacaacatta | ttgatattat | tcaaaggagt | atgtaatgac | aagtgagcag | gcttttaaat | 49680 |
| taaaagaatt | aattgaaaca | tatagcaaag | ctgttcatac | agcaacagtt | attgatgaat | 49740 |
| cagctttctc | cggacatgct | aacaagatta | aatacaaaac | tcttatggaa | gaagctaaag | 49800 |
| taaatcttga | ttcttatatt | gaaactttaa | ttggtgaata | acatgggctt | tcctaaatta | 49860 |
| gaagtaggtg | atttagtttt | aacaaaatta | tggaatggtg | ttcaatcagt | agaaatctgc | 49920 |
| caatatcgtg | gagcaacagg | taatttgatg | tacacgattt | ataatccaga | aattttgtta | 49980 |
| gagtgtcatt | tggaacgctt | tataaaagac | accgatagta | tgccttatag | tgtatcaatt | 50040 |
| gtacgtaaat | ctgatacaaa | ggaatattct | aaaatttag | aacaaattcg | tgccaataaa | 50100 |
| aaggattaat | atgaaacgat | tagtattaga | agttagtccg | ctttttggtg | aattggctat | 50160 |
| agaaaaagta | ataacatgt | atcgtttgac | gcaagaagac | gatatgctat | attttacgcc | 50220 |
| tagtgaaatc | attcatttaa | cccaaattga | atatccttat | actgataaaa | tagtaagcat | 50280 |
| caatgatgag | cacaaaattc | attttattc | ttcatgccca | ggatttaata | ttaaaagtga | 50340 |
| gtcaatgtgt | ttatcagtta | tccattggga | tagttttata | gataagatta | aatatttta | 50400 |
| ttattctaat | gaaagaaaac | atagtttaaa | atggctcaaa | aattgcaatg | ctattattac | 50460 |
| taacgcttgc | aatcagaatg | atgaaactct | tttaaatgta | tcaaaatgtt | atgaagaggg | 50520 |

FIG. 17BB sequence.txt

| | | | | | | |
|---|---|---|---|---|---|---|
| agatgtctta | actattcgcc | aaattgacga | ttttcgatca | catattgtca | catttaccaa | 50580 |
| agacgaagct | attgcgttaa | agacttatct | tgattctgtc | attccaacta | tgatttcaaa | 50640 |
| gtgaggaaat | atgtttattt | caagtggaag | cggtttaatt | cgtgttgaat | ttaaaaatga | 50700 |
| catctttctt | agtcaaggag | atgatattat | taaaatgagt | tatgacgaaa | tcaagaaaat | 50760 |
| ttgtcatgct | cttgaaagtc | atggaaagga | aaatgctact | atcgatatag | gtgatttatg | 50820 |
| ggtgacactt | tatgaagtat | ccgaaggatt | taacattgaa | gatgaaaaca | acattttagc | 50880 |
| tattgataaa | agaagtgatt | tgtttgatgt | attaaaagtt | tatgaacagt | caaatggtgg | 50940 |
| aagaaaagct | gtattagttt | atcaaaaacc | acattcatgt | ggaactgctt | caatcatttc | 51000 |
| aaatattgaa | gatgaaactg | atacttatat | gtgtgtttta | aaagctggtg | gtgaccgtca | 51060 |
| tccggatttt | atttctattc | gtcaaaataa | tggagaaatt | tcattatcaa | aatcagaagc | 51120 |
| tgaagctatg | attaagtatt | taacaactgt | tacaccttca | atgaaaggat | aattatgatt | 51180 |
| attaatgaaa | actcttggca | ttataaatta | ttcaaaatgt | ttaacgacga | atggaaacga | 51240 |
| cctaagacac | tttgtgcata | ttttggtct | attgttatcc | ctacattttt | cgtttctttt | 51300 |
| ttcggatgta | ctatactcgc | aggtctaact | attatctgtg | cagaaatcat | acagaaatgg | 51360 |
| cttattttg | gtagtttatg | gactcttatt | ccatcagcat | ttatacttgc | cattttgctt | 51420 |
| gttttactta | ttatcggttc | atttgttatt | cctgcacaac | tacatgaaaa | atataaagat | 51480 |
| tataaatgga | aaaggatta | tgctttacat | gtagaaaata | ttgatagggc | gtataaaggt | 51540 |
| ttacctccta | ttcaacccaa | gaaatctatt | atcgtcgaat | ttttaaaagc | gcgtaaagct | 51600 |
| aaagtatgtc | ctgttattga | atataaggct | gaatgatgaa | aacagtaatg | aaaagctatt | 51660 |
| ttggtagtca | tctttatgga | acttctactc | cagaatctga | tgtagatttt | aaagaaatct | 51720 |
| ttgttcctcc | tgctcgcgat | attcttatcg | gaaatgttaa | agagcatatg | agtaaaaaca | 51780 |
| ctaacaacac | atcatctaaa | aacactaaag | atgatattga | ccatgaacta | tacagtctta | 51840 |
| aatatttctt | taaattagca | gcagatggtg | aaactgtagc | gttagatatg | cttcacactc | 51900 |
| cacctgagtt | agtggttaaa | tctgatttgc | ctgatgtgtg | gaagtttatt | caagacaacc | 51960 |
| gttctcgttt | ttatacgact | aacatgaaat | cctatttagg | atatgtccgt | aagcaagctt | 52020 |
| ctaaatacgg | cgttaagggt | tctcgtttgg | ctgcattacg | tgatgtattg | aaagtagtta | 52080 |
| atcaaatccc | tgagcagtgg | gttgattacc | aagaagatgg | ttctattaag | cagcgtcgta | 52140 |
| ctaaagttga | agatattaag | catcgtcttc | cagaaaacga | attctgtgaa | tgggtgttcc | 52200 |
| ataatcatga | gaaacaggc | ccacagacgt | tctacacagt | gttgggtcgt | aaatatcaga | 52260 |
| caacgctttc | tcttattgag | cttaagcagt | cactgaacaa | attagatgct | gaatatggtg | 52320 |
| aacgcgctcg | taaggccgaa | gccaatgaag | gtattgactg | gaaagctctg | agtcatgctt | 52380 |
| gccgtggtgg | actccaacta | ttggaaattt | acaaaactgg | tgacttggtt | tatccactcc | 52440 |

FIG. 17CC sequence.txt

| | | | | | |
|---|---|---|---|---|---|
| aagatgctcc | atttattctc | gacgtgaagt | tgggtaaaca | tccatttaaa | acggttcaag | 52500 |
| agttttggga | agatgtggtc | gatcaagtag | aagcagcatc | tactgaagct | tctaagaacg | 52560 |
| gtatgcagca | aaaagtagac | atgagtttct | gggatgactt | ccttgagaag | gtctatcttg | 52620 |
| aaaaccatcg | aagttattat | aaatgatagg | gagccttcgg | gctccctttt | ttattttaaa | 52680 |
| aattttttca | caaaactgtt | tacaagcata | aagctttatg | gtactataca | actatcaaaa | 52740 |
| caaacactta | aacggaaaac | aaaatgaaaa | ttacaccaat | tgaagtaaaa | aagttgattg | 52800 |
| atacagaaga | aatttcagag | tgttttgaaa | gtttcttaga | agacgcaact | gaagataacg | 52860 |
| cggtttatct | cgcccagaaa | attatcgaaa | cttatttgga | gaagaatcaa | tgacagttta | 52920 |
| cgtagatgtt | ttaatgaatc | atggatggaa | acttcgcggt | catccaacta | aaaattgtca | 52980 |
| tatgttcact | gatggagata | ttgaagagct | tcatgaaatg | gcagaagcaa | taggaatgaa | 53040 |
| acgttcttgg | tttcaagata | aacgcattaa | acattatgac | ttacacgctc | gccgacgcca | 53100 |
| aaaagctgta | gaacttggag | ctgtagaagt | atctcgccgt | gaagcagtaa | aaatttggcg | 53160 |
| aacgttaaaa | taaattgttt | acagaagggt | agtagtgtga | tactattacc | ctatcaaaac | 53220 |
| aaatgtgaga | ttggagaata | aaatgaaaac | tgtaactatc | aataagggta | tctacttcgg | 53280 |
| taaagaaatc | tctggaactt | ttgagctctt | aggtgaatgg | ttcccagata | atgctccggt | 53340 |
| agatgcacaa | ggagatggta | aagtttttgt | tgaaattgac | ggtaagcgtc | gcggtgtttg | 53400 |
| ggtttacaaa | tcagacattt | catatgatgg | tgtaaaagtt | gaagaagtta | aagaatcata | 53460 |
| tgaagatatg | aaaacccgca | ttaataaaag | atttaatgtt | atgggaatga | tgacgaatgg | 53520 |
| tattattaac | ggaaacattc | gttcattaat | tatctctggt | gcggcgggta | ttggtaaaac | 53580 |
| gtattcttta | gataaagctt | tgaataaagc | aaatgataat | ggatacattg | aatataaaag | 53640 |
| cattaacggt | aaaatctccg | gtatcggtct | ttatgaacaa | cttttggaata | atcgtgaaga | 53700 |
| gaattctgtc | cttttgattg | atgatgtgga | tgttttctct | gatatggaca | ttcttaatct | 53760 |
| tctgaaagct | gctctggaca | ctggagagac | ccgtaaagtc | tgctggagca | ccgcatcttc | 53820 |
| ttacttagaa | gaaaaaggca | ttgagcgtga | gtttgaattt | aaaggaacga | ttgttttat | 53880 |
| cacaaacgtt | gacattgacc | gcgaattaga | ccgtggtact | aaacttgctc | cacatttaca | 53940 |
| agcattagtg | tcccgctcgg | tttatttgga | tttgggtgtt | cacactaatg | aagaaattat | 54000 |
| ggtcagggtt | gaagatgtta | ttcttcaac | tgacatgatg | caaaagcgcg | gtctttctga | 54060 |
| tgaagaaact | tataaagcat | tatcatggat | gaaagttaat | gttaatcgtt | tacgcaatgt | 54120 |
| ttcactgcgt | actgctcttt | atcttgctga | ctttattatg | accgacaaaa | acggttggga | 54180 |
| agaaattgct | gaggttactc | ttctgaaata | attcataaga | ggacttctat | gacaaaaagg | 54240 |
| cagttcagaa | atagattata | tggactgcca | ttaaaaagat | gactagaatt | aaactggtga | 54300 |

FIG. 17DD

```
                              sequence.txt
atggaggtaa tgatgttata ctcaaaggct cgtgaaattt acgaaactaa aattaaagaa    54360
gcagtattta agttcgcaac gacaatgcga tggacaaatg actgggagta ttcaaaaaat    54420
cataagaagc ccatggtgac aagaaaggct catatgttag tgttaataga ccgtgagcag    54480
attaaagccc gagaagccct ccagaatcat aaaaaggctg cctttgaatg gtttatggat    54540
aacactgctc ctgagactaa gaaagcggta agcgcatggt tcagtggaaa aaattgtgaa    54600
agaagtttct tttagtggtt tacaagactg ttcctctgtg gtactataca actatcaact    54660
acggaggaac acaaaatgaa cgctaaagat attttcaacc tggtaaatta caacgatggt    54720
aaatttaaat ctgaagcaca agtaagttc tttaatgaca tctcaatcgg aggtgaaatc     54780
acggttgacg gaggacaaat ttacaaatct cgttggaatt ggatcgttat tatcgatgag    54840
attggtattg tagaaattta caagaatacg aataaaaatc gtacattaca ctggtctcgt    54900
gatactaacg aacagtacaa aaaggataaa gcatctaaat tatctcgtgt aactcaagaa    54960
gatattgagt tcatcaagaa agatattttg atgtatgata acttaattgc tgaagagcaa    55020
gctgttattg ataaatttga tgagattaaa gcttctcgtg aaattcctga ttttatgaaa    55080
gaatcagtaa atgaacgata cactctcatt tcagagcgta ttgaaactta caaaaagcaa    55140
agagctgaac gccagaatac tcttcggaag tttgaagaac ggttaaagac ggtactcgca    55200
taaccgcttt ataccaagga tggtataatg gttctaagcc cttttaattg agattattat    55260
gaaacagttg ataattaaaa gattgaattt attgatatgt tgtttatgta tagcaattgc    55320
atatggttat tacgcaatta atgattatat gcattataaa gattatgatg ttactgtagt    55380
taataccatt acaggaacac aaggaaaagg gtctagttta tcgtttattg ccgtatatga    55440
actcaaagat ggttatagat ttagtgaata tatttcccca gagatgtatt catcaataga    55500
aaaaggtgat aatattactg taagtttacg tcctttcgac gtaaaacaga cattgtttga    55560
taatattgtt tggttctttg gaatggtatt agttcaatct gtgtgtggtg cttatatagt    55620
ctgttccatc ttattctgta tatttagtaa aattgaaatt gagtgaggaa aatatgtcag    55680
tagtaattaa taatgtcaat gcagtaatta aatctttagt taataaaaaa ttaaatgaat    55740
ggactgtact tcgtcgtgga gagccagata aatttttttca tagatttaac ccaactttgg    55800
atttgaatgt tattgacaga gatgttcatg ctgaaatttt agataaattt aaagttgata    55860
ttgggtttgg gttagataaa catttgcaac gaacaaacgg atctggaatg ggtttatcta    55920
atcgcatcat gaaagccctt aataaaattg gagcgttgtc tcgtattaat gcgagtgaaa    55980
tccttcgcaa ttataataaa ggatatgacc tttatggtcg actaatgccg aaattatcat    56040
ttgaccaaat gattgcggat ttgtgggaaa atcaacgacg attattagca ttaggcgctc    56100
gattagctaa aggtctagat aaacaaatga tttttaagac caataataca gaagacctta    56160
aatgctttaa atttagtact cgtggagatg attattacat cagagctcgc tctacagatt    56220
```

FIG. 17EE sequence.txt

| | | | | | |
|---|---|---|---|---|---|
| atgttaatat | ggggcatcat | ctctgtttag | cttttgaagt | tttaaaagaa | gccggaacat | 56280 |
| tagaatatgt | gtctggtgct | aaatgtccga | ttggttcaaa | ttgcatttta | atttatcgcc | 56340 |
| cagatgaatc | cagttcaact | aaattaccta | caaaacctgt | accagttcgc | agtaatgaaa | 56400 |
| aacattctga | acaaattgct | tattttaata | agcagattga | agagctaaat | atttctattc | 56460 |
| agcaatatga | tgatgaaatt | ttcagactat | ctggattgag | tagtaaagct | aaatctgagc | 56520 |
| gtgaaaaatt | aattaaaatc | gttgatttac | ttaaatctta | aggaacacca | tgaaaactcg | 56580 |
| ttctcaaatt | gaagatatgg | ttcgtaatgc | cagctatact | cgtgatgtta | tgacattttt | 56640 |
| gtgtgaaaat | aatttagacc | ctgataaagt | taatcgtgtt | attcatcact | ttaagtatac | 56700 |
| gaatagcagt | gaatgggtgc | gtaattttag | taaagcaggg | tatattacac | aaatgactgc | 56760 |
| tcgtgaacag | ctcaccgatt | tctgtaaaac | tattgattat | aaaaatcctt | tgattgttca | 56820 |
| aggcgttggt | caaagtaagg | tcgatttatc | atctggattt | ttcaatccaa | atcattatcg | 56880 |
| tattgaatgg | agatttattg | ctctattccg | taaacaatta | aagcaaattt | tgtctactgc | 56940 |
| tagtcgatta | aaaggctctg | atattaactt | aaagaacctg | aaatttgatg | gttatactct | 57000 |
| tcagatggaa | gtaagaccgt | taaaagaaaa | taatagaact | gcacgaatta | gctttaagcc | 57060 |
| taatactaaa | aattctcttt | caatttgtga | atgtcttaaa | tcacagctga | cagaagcatt | 57120 |
| taagtatatg | gatgttgttg | ctgctgttca | atctaagatt | ttacctcgtt | ttgagcgaaa | 57180 |
| ttgggaacat | acaacaacat | atgaacttga | tatgatcgtt | tcatttaaat | atgaattttt | 57240 |
| gagaaaggat | gaaattgttc | aagagaaaaa | gcaggaagtg | caagatacct | aaaatttaaa | 57300 |
| tttatccaat | tacttatcaa | acgatcctaa | attttggatg | tatagctcaa | gcaatataga | 57360 |
| tgcatgtaaa | cttaataaag | tgagttttct | tcctactgaa | aattcaaatt | ttaaacctgt | 57420 |
| agaaaaatgg | cacgctgacg | cgattgagaa | gtctcttaag | gcagtagatg | atgaactcgt | 57480 |
| taaagcgacc | aatgaagtgc | tagaagctga | aaaggcgtta | gaacaagctc | agtcaagggt | 57540 |
| tcaaaatctg | acaaagcaac | gttctaaact | gaacaatgca | ctaaatgcac | tgaactagtt | 57600 |
| tactttgcca | caaggatgtg | gtataatgtt | tttactttct | actgaggaga | ttattatgac | 57660 |
| tcgtaacgaa | tatatcaaat | cattcaatag | cgttattgat | gataaagcta | taccgatgtt | 57720 |
| tggccaaaat | agcgttcttt | ctattatcaa | tcaatggctc | aatagtgttg | atgcaagtat | 57780 |
| tgtttcttct | actaaattta | ttcatgaaat | tcgtaaaatt | tctagccgtg | tagataaaga | 57840 |
| tgttatcaag | aaaaccttta | aagagtctcg | tcttctttca | tatttggtta | atcgggatat | 57900 |
| tcttggtaat | tttgggaaag | aaattaaacg | aactaaagat | gtagtaggat | acaattggtt | 57960 |
| cggtgatgtt | aattcttatc | atcttaatat | taaagaagac | cctgagaata | tttttactcg | 58020 |
| tcgttggatc | agtaatttca | gactttttaa | gaaacaaatt | ctaaaatcag | cttctaaatt | 58080 |

FIG. 17FF sequence.txt

```
atgttatggc gattatcgtc aaattcatcc tttggcttct gatatgatta tcataaaaga    58140
atatgaactt gataaaaata aagtatctat ttttgtgaat tatggatttt ttacaccaga    58200
aactaaccaa aagaatatta ataaattttt ctcaattgct agcactataa ctcgtcaatt    58260
agagaccgca ttactttgta tggaaacagt agaaaatatt catacatatc cttttaagaa    58320
tatatgcggt tgggaaggat ataaactcgt aattagcctt cgtgaagtga atgtgctta    58380
ttcacctact gataaagaaa tttaccaaca aaaatgtgat gaaattgtga atactcctaa    58440
agaagaaact acccttgagg aactaatgga atgtcttgat gattcacctg aaccgataga    58500
aattcgtcca gaagttattg cactagaaaa agcttataaa gaagttctag aaatttctaa    58560
taaagcgcag aaagaatatg agcaggctaa aaggatttgg gaagaatctg ttaatcgtct    58620
tgatcgtctg gaacaagctt tacagttaat taagtaattt aaagccaagg atggctcgga    58680
gtataaatca ttaaccaagt gagaagaaca tgaaaactcg taaacattat attgattatt    58740
ttgacagtct tattactaaa catcgtaatt atcagatagg acacagagca gtaatcaata    58800
atattcttcg tgattttta gactatattg gatgggaaaa ccatatttgt aaagatacac    58860
aaaatgcgta ttcacattct cttggttctt tgctcgagtg gttcaaacgt tcccgattac    58920
tatcttctgt gatagctgtt aataatgtta aaaaattat gtatccaagc tacattgaga    58980
ctaatgtatc aaatgctagt gttgttacat ttaatattat taacgacgtg aaaagaactt    59040
atttagaaga atggttttct aaagatagta agaaaaaatt tgctagtgaa ttttcacacg    59100
aattcaataa taacgtgaat atgcttttta agcattctcg tagactgttt tgtcatggtg    59160
ataaccgtac tattaatgtg aatgtaaaag actgggttac ggctaaattc actccatcgt    59220
cccagaatgg gcaatttgaa ttgtcaatta tcatttgtgc tccgcacgag atatataaaa    59280
accttccgta tatgaaacca cgcgaagcta ataaacacaa tgaaactatt agttctttgg    59340
cttataattt acgcgtgtta ttatctgata tggatgtagt caaatccttt gatgataata    59400
cgaattatgg tctttcgctg tttgaaacta aatttgttat taaattaaag gaccctagtg    59460
aatttaaacc tacaccaaaa tccaatcatg gaaatgatac tatgaaagaa gaacgcgaat    59520
atctcagtgc ccgtttgatt gaagttgaaa aacagattga agagcatact aaagttctta    59580
aggctttaac cgccaaagca aatggtttac gtaatgctat tgaggtattg aaatgaaaaa    59640
gcgtttatta gaagacattg cagcttcaag taattccagt ttaattaaaa ttattatggc    59700
tggtgaggaa gatgatatgg aaatgcgtgg aaagattcac ggctgcgacg atttagattt    59760
taaacctcca gcatgggatg ctattatggc tatggttgaa cgacgtgaaa gagcttctaa    59820
aaacgttcct aattgccctg aatgcggtac tgaacaagtt caattgatta actggcgtaa    59880
accagagctt gaatataaat gccgtcaatg taaacataaa ttcagtaagc atgctccgga    59940
aatggttaaa ttgcctgact ctactgagtt cttaaagaa cttgtgagtg ttcaaccaat    60000
```

FIG. 17GG sequence.txt

| | | | | | | |
|---|---|---|---|---|---|---|
| gcctaataat | attttggatt | aaaaatgacc | aagcgtaaag | aatatatgga | ggctgctgaa | 60060 |
| aaggcagtcc | gtgaattagc | aatagcttat | tataatgaac | atggtaaatt | tcctgataga | 60120 |
| tacagcgtgc | ttaaatctgc | tttaactcgt | tcatataaaa | atatgctatc | agaagtaagt | 60180 |
| gatattatat | acaaacataa | agaacaaacg | ggccaaagtc | ttgattacga | cgagactttt | 60240 |
| aaacaagtac | taggaattaa | ggataatat | gtttaaagta | tatggttatg | atagcaacat | 60300 |
| tcataaatgt | gtgtattgcg | ataatgcaaa | acgtcttttg | accgtgaaga | aacagccgtt | 60360 |
| tgaatttatc | aacattatgc | cggaaaaagg | tgttttgat | gatgagaaaa | ttgctgagct | 60420 |
| tctgactaaa | ctaggtcgtg | atactcaaat | cggcttgaca | atgccccagg | tatttgctcc | 60480 |
| tgatggaagt | catattggtg | gatttgacca | actgcgagaa | tattttaaat | gatgctcgaa | 60540 |
| ggaactgact | atattcatga | ttaccgcgga | agcgcggtat | atgtaggtga | tgaagttgca | 60600 |
| gtttattatg | ggtatggaac | tttgatgaca | gccaaggtta | ttcaaattaa | aaataatcgt | 60660 |
| gctaaactcg | aagtttatta | ttctaatggt | gaaaagtcta | tttctaagtg | gaaatacggc | 60720 |
| gattgtatgg | ttaaattggg | gtaaatatga | tttacgtatat | taatgtatca | agaactccgt | 60780 |
| caatggttac | tattccagcc | gaagaactag | atcgtcttca | gaaaattgaa | gagcttcttt | 60840 |
| gggaaattga | atctgatttg | ccatcaggat | tagaatcctg | gattgattat | gaagaactta | 60900 |
| ataagcttcg | gggttaaacc | ttggtgggcg | gctagatggg | aaactgtaga | gccagagccg | 60960 |
| gaagaaccgg | tttacattga | tgaagaaaca | gtatataatg | aaccaacgat | aaatgactta | 61020 |
| attgatatgg | agatgggaca | tgattacagt | agataagtgg | tttagaatta | atcgtgttga | 61080 |
| tacagggcta | tgtaattact | ggccggaact | tagtgcaggt | actgtcttta | aagttcgtga | 61140 |
| acttgcaaaa | gaatgcgaag | atgatataga | acctgatact | ggaattattg | aaattgaact | 61200 |
| ttccgacgga | aagattatta | acatctatga | taagccaatt | acatactggt | gtttgtggaa | 61260 |
| tactgaatcc | gttgaaaatg | gcgaaattga | agaagttgta | gagagaacta | gccaagatgt | 61320 |
| tcagaagcct | aaagccgctt | tcaaggtga | acgtatttca | tacgcattag | ctaaattagc | 61380 |
| tgcgcaagaa | aataacgatg | gctatgaagg | taacctgatg | caagctgccg | cagagtacat | 61440 |
| tgaatggctt | gaaactcaaa | tttcttttc | tgaccaaaag | attcggcaat | ataagcgatt | 61500 |
| gcatcaaatg | ttttacaata | cttgaaaaaa | ctcaaaattc | tttttctgac | aggacatttt | 61560 |
| aatgaaaacc | gaattggttt | atactgaaaa | gttaaatggc | ggtaaggttt | ggaaactttt | 61620 |
| tattaaagga | cattctacgg | accctcatat | gaccacttgc | gtaggaacct | attctcgtcc | 61680 |
| tactaaaaag | atgattcgac | agtataaacg | attgcatcga | atgttttaca | atacttaaaa | 61740 |
| ataataaata | cccttatcta | tttaaggtaa | gggtatttat | tatgttattg | actggcaaat | 61800 |
| tatacaaaga | agaaaaacaa | aaattttatg | atgcacaaaa | tggtaaatgc | ttaatttgcc | 61860 |

FIG. 17HH sequence.txt

```
aacgagaact aaatcctgac gttcaagcta atcatcttga tcatgaccat gaattaaatg      61920
gaccaaaagc aggaaaggta cgtggattgc tttgtaatct ctgcaatgct gcagaaggtc      61980
aaatgaagca caaatttaat cgttctggct taaagggaca aggtgttgat tatcttgaat      62040
ggttagaaaa tttacttact tatttaaaat ccgattacac ccaaaataat attcatccta      62100
actttgttgg agataaatca aaggaatttt ctcgtttagg aaaagaggaa atgatggccg      62160
agatgcttca aagaggattt gaatataatg aatctgacac caaaacacaa ttaatagctt      62220
catttaagaa gcagcttaga aagagtttaa aatgacaatt gaaaagaaa ttgaaggatt       62280
gattcataaa actaataaag acctttttaaa cgagaatgct aataaagatt ctcgtgtttt     62340
tccaactcaa cgggaccttaa tggctggtat tgtgtctaaa cacattgcca aaaatatggt     62400
cccgtctttt attatgaaag cgcatgaaag cggaattatt catttccatg atattgatta     62460
ttccctgct cttccattta ctaattgttg tttagtagat ttaaaaggaa tgcttgaaaa      62520
cggatttaag cttggtaatg cacagattga aactcctaaa tcaattggcg ttgctactgc     62580
aattatggcg caaattactg cacaggttgc ttctcaccaa tacggcggaa cgacttttgc    62640
taatgtagat aaagtacttt ctccttatgt taaacgcacc tatgcaaaac atattgagga    62700
tgcagaaaaa tggcaaatcg ctgatgcgtt aaattatgct caatctaaaa cagaaaaaga    62760
tgtatacgat gcattccaag cttatgaata tgaagtaaat actctcttta gttcaaacgg    62820
acagactcct tttgtaacaa ttacatttgg tacgggaact gactggactg aacgaatgat    62880
tcagaaagca attctgaaaa atcgtattaa aggtctcggt cgtgatggga taactcctat    62940
tttccctaag cttgttatgt tcgttgaaga aggcgttaat ctttataaag acgatccgaa    63000
ctatgatatt aagcagcttg ctttagagtg tgcaagcaaa aggatgtatc ctgatattat    63060
ttcagctaag aacaataaag ctatcaccgg ctcatctatt cctgtttctc caatgggttg    63120
ccgcagtttc ttgagcgcgt ggaaagattc aaccggtaat gaaattcttg atggacgtaa    63180
taatcttggt gttgtaacac tgaatcttcc tcgtattgcg ttggattctt atattggaac    63240
acagttcaat gaacagaaat ttactgaatt gttcaatgag cgaatggatt tatgttttga    63300
agctttgatg tgtagaatta gttccttaaa aggagttaaa gcgactgttg ctcctattct    63360
ttaccaagaa ggtgcattcg ggttcgtct taaacctgat gacgacataa ttgagttatt     63420
taaaaacggt agaagttcag tgtctttagg atacattggt attcatgaat tgaatattct    63480
tgtcggtcgt gatattggac aagaaatttt aactaaaatg aatgctcgtc ttaaacagtg    63540
ggctgaaaga actgggtttg cttttagttt gtattcgact cctgctgaaa acctttgtta    63600
tcgcttctgt aaacttgata cagaaaaata tggaagtgta aaagatgtta ccgataaagg    63660
atggtacact aacagtttcc atgtttcagt agaagaaaat attactccgt ttgaaaagat    63720
ttctcgcgaa gccccatatc atttcattgc gacaggtggt cacatttctt atgttgaact    63780
```

FIG. 17II sequence.txt

| | | | | | | |
|---|---|---|---|---|---|---|
| tcctgatatg | aaaaataacc | taaaaggtct | tgaggctgtc | tgggattatg | ctgcacaaca | 63840 |
| tttagattat | tttggtgtta | atatgccagt | agataagtgt | tttacatgcg | gaagtaccca | 63900 |
| tgaaatgact | cctactgaaa | acggatttgt | ttgttctatt | tgtggagaaa | ctgatcctaa | 63960 |
| aaagatgaac | acaataagaa | gaacatgtgg | ttatttggga | aatccgaacg | aacgcggatt | 64020 |
| taatctcggc | aaaaataaag | aaatcatgca | tagggttaag | caccaatgaa | ttatgataga | 64080 |
| ttttatcctt | gcgattttgt | taatggtcct | ggctgcagga | ccgttctttt | cgttacaggt | 64140 |
| tgtttgcata | aatgtgaagg | gtgttataat | aaatcaacat | ggaatgctag | aaatggtatt | 64200 |
| ccattcactg | gtgaaacact | agaacaatta | attgaatgtt | tgaataatga | ttatatagaa | 64260 |
| ggattaacta | taaccggagg | tgaccctctt | tatcctgata | acagagacgt | gattcattgc | 64320 |
| atcgttcaaa | cagtaaaaaa | tctttatccc | aataaaagca | tttggttgtg | gacaggatat | 64380 |
| aagtttgaag | atattaaaca | actagaaatg | cttaaatatg | ttgatgttat | tattgatggg | 64440 |
| aagtatgaga | aaaatcttcc | gactaaaaag | ctgtggcgag | gatcagataa | tcagcgactt | 64500 |
| tggtcaaata | ccgatggggt | gtggaaacat | gattaaattg | aattatatta | tggatactat | 64560 |
| aaatgatatg | attttcatt | ttggtccaga | attttattcc | caatatagtt | tagtgcttat | 64620 |
| caatgcttgg | ttaattaatt | aagggtaaaa | tatgtataaa | tttcgtaaag | gtttagctga | 64680 |
| ttttcttaca | actgtaacat | tctttctgtt | tatggcagtt | ggagctattt | tccttattcc | 64740 |
| ttttattgct | atatttttcg | tgattagttt | aatttctcca | gaaaagggct | tatcttctag | 64800 |
| tgagtttaat | gagcgtctgg | ataaaattac | taacaagctg | aatgctgttc | ttgataaaaa | 64860 |
| ggcttaatta | tgattagttt | tgagcggtat | gtagtagaga | gttggaatgg | ttttgatatg | 64920 |
| ttcggtaatg | actattattt | ctatgaatgt | agtctgaacc | caagcttctg | ggctggacgt | 64980 |
| gaacaagacc | tcgaagaaat | caacgctcgt | gccgatttgt | taggtgaact | gcctactact | 65040 |
| tatttcacct | ttgatgaatc | cggcttcgtt | atccaggttt | attttcctga | agaaaactct | 65100 |
| ggtgaggatt | ctgttaatcc | tccttattgg | gcttaccaag | gaattatttc | tcgtggaaca | 65160 |
| aaactcgaac | ttaaagaata | agattgaagt | ctatggaatt | ccagatgaag | taggtcgttg | 65220 |
| tcctggatgt | caatcagtta | caaaacttct | aaaggagctc | aatgctcctt | ttactttcta | 65280 |
| taaagttctt | acaaataatg | gtaagattga | gtatgatcgt | ccactgattg | tatctcttgc | 65340 |
| taaacgcgct | ggattcacat | ctcttaacat | tcgttatcca | gtcattttca | ttaatgattc | 65400 |
| tagacaaaag | aacattaaac | acttcaaaga | aactctcatt | tcacttggat | atgatagaga | 65460 |
| tatcatagaa | gactaagacg | ggccctctgg | gcctttcttt | ctcacattct | gtatattacc | 65520 |
| attctaagct | atcgttccct | tcttatcatt | ccctaaaata | atttcacaaa | gttgtttaca | 65580 |
| acaagttcaa | actgtggtat | tattaacata | tgaattgcct | ttgaggattt | gatatggttg | 65640 |

FIG. 17JJ

```
                         sequence.txt
tggttgataa agagattaaa aagggacaat attattttat taatggtaat gttgttcgtg    65700
ttacttatgt aaacggtttt gaagtttatt atcttatact caagttacat aaacagatga    65760
tttgtgatcg tgctgtattt agttcagttg ctaaggaaat taaactccat gggtaaaacg    65820
tatcgtcgta aagatttaaa agtacgtgat tatgactatt tcggaaagcg taaagctcct    65880
gatggtgtaa gtcataaaga tatggttgaa aacattttc gctctgataa atggcgtaga     65940
atgaaaggca ttgattcaga agttaaagat gagctaaatc gtcaattacg tagtgaagta    66000
agaaagttga aaaaatcagt ttacattgac gatgattttg attacaatac ttctcaacga    66060
gttgctaagc gcaaatcaaa cgagtgttat cgttatagct gaggaaaata tgaatatcaa    66120
acgcatgctt tttaagcaag ggctatatac tttaaatgct actccaaaag gcgatacaac    66180
taagtggtca gtaaatgact ggattaaatt tattgatgaa acggtaatt gggaaattta     66240
aatgaatcct gaatctaaat tatcgcagcg aattgctgaa gaacgcgcca aatttttcca    66300
gaacatgaaa cacaatggta ttgaggatga agttttcta aattggttct ggaataataa     66360
gtatgcagca tgcgaaggag ccttgtcatt gtcagtcgca atgatgtacg aaggctggaa    66420
gggtgccaaa aagtttagct aagggcttcg gccctttttg gataataaaa ttttaatgca    66480
attgaggata atgtatgact attcaaatta aaaacgccat caattcttac gcatatgata    66540
aagtagtttc tctgctagaa aaaggcgata ttgtaactcc tcaaattttg gataaatggg    66600
aaaaagagct tcatcagacg atgaaacaga atgatcagaa gattggacgc aatactgtcc    66660
gtgaattgtt ggttcaatat atcttgtcag aatttgatgt taaagctttt ggtgtagaat    66720
ctaaagctta tcaaaagcat gaaatttccg ataaaactat tcgtcgtatg aaaaatcaac    66780
gcaagaaaaa atttgcagac ctgaaaatta ctaaggtata attatgaacg aagctcttat    66840
taacgatttg cgtcttgccg gatatgaagt aaatacaaat ggcattggtt taactcaaat    66900
tgaaggaaac ggattcatcc ttgagtatga atttagccaa tggtggttat atgccaatta    66960
cggcgaattg attgaatatg ttgaccaatt tgattcacta gatgcagctc ttgaagcggc    67020
taagttgatg aatgtatgaa attaattaat atttctattg ctattgaaaa ttttggtatt    67080
ttctatgttg accaatacat gaaaatttca tttttcccaa ataaaactgg tgttggatat    67140
tgggaaagcc atgtttctga attaaatgaa agtgaatatg ttagtacaca taaaaagttt    67200
ttagactttt tatatcgcgc tgatattaat gatcattaca tagatattca tgaatttaaa    67260
aagatgatgg agaaagtgtt ccaagcatac tgcttactta gataactgat atcctctatg    67320
ctttaagata gatcttcaaa tattatgata taatagatct atgaattgag ctaagaggtg    67380
aaaatgtcag aaactaagcc taagtataat tacgtaaaca ataaagagct tttacaagct    67440
attattgatt ggaaaacaga attagcaaat aataagacc caaataaagt agttcgtcag     67500
aatgatacta tcggattagc cattatgctt attgcagaag gcttatctaa acgtttcaac    67560
```

FIG. 17KK sequence.txt

| | | | | | |
|---|---|---|---|---|---|
| ttttcaggat | acacccagtc | ttggaaacaa | gaaatgattg | cagatggtat | agaagcttct | 67620 |
| attaaggggc | ttcacaattt | tgatgaaacg | aaatataaaa | acccacatgc | gtatataact | 67680 |
| caagcttgtt | ttaatgcatt | tgtccaacgt | attaaaaaag | aacgtaagga | agttgcaaag | 67740 |
| aaatatagtt | acttcgttca | caatgtctat | gacagtcgtg | acgacgatat | ggttgcgtta | 67800 |
| gtagatgaaa | ctttttattca | agacatctac | gataaaatga | cgcattacga | agaatcaacc | 67860 |
| tatagaacac | cgggggctga | aagaaaagt | gttgtagacg | attctcctag | tttggatttt | 67920 |
| ttatatgagg | ctaacgatta | acctctccgg | attcttggaa | gaaatacctg | aagttgaagc | 67980 |
| tattccctat | ttacttaaaa | tgtatctcag | ggaagtttta | gctcttgaca | ttgatattga | 68040 |
| tccagaaaat | ccgtatgata | ccgcttttaa | atctaatggt | gtagaattaa | actatcggta | 68100 |
| tcatttaaca | gatgatgatt | tttattttat | attagagaaa | taatatgact | gataaacccg | 68160 |
| aaattaatga | tgaagtggaa | aagcttattt | cttctattga | agaaaagaac | cgtcttgaag | 68220 |
| cagaaagaaa | agcaaataag | ttattgtcta | aaaacaaacg | cgaactgaat | cgtctttata | 68280 |
| agcacgctca | gatcgcagct | gaaaacaata | attttgctca | atacgaatat | gctatcaaga | 68340 |
| aaagtcggga | tattctgaaa | cagccatata | acgatgaact | catcagtatt | ctttggaaga | 68400 |
| ctactagatc | gcagattgag | gatatgattg | atgcttacac | acgtaaaatt | caagcgtctt | 68460 |
| aaaattaatg | caggatttac | tgaatctttg | aatggtcatc | tttgtgtgaa | aatttctgaa | 68520 |
| aagaatacc | atgatagttc | aattaaagaa | gttaatcctc | ctattgtaag | agcagacccc | 68580 |
| aatatgaaag | tgtgggttga | ttcttatcaa | gtcaaaaaat | ggtggcagtt | atgaaagatg | 68640 |
| aacacccaga | cttctgaaat | agattataat | aaaattcgtt | cctctaaaga | ggaaatgatg | 68700 |
| agacgcttta | aagagtctca | tgataaagct | aaagcagaag | gaactataaa | atataagcgc | 68760 |
| ataaaattta | aagttctaa | cgagcctctg | tatggcgtat | tatgtggata | ggagcttcgg | 68820 |
| ctcctatatt | gctttataaa | ttttggtaa | aataaaccaa | acaaagagg | atattaaatg | 68880 |
| aaagtatgta | tttttatggc | tcgaggtctt | gaaggttgcg | gtgtaactaa | attttctctt | 68940 |
| gagcagcgtg | attggtttat | taaaaatggt | catgaagtaa | ctttggttta | tgctaaagat | 69000 |
| aaatcattta | ctcgtaattg | tgcgcatgat | tataaatcat | tttcaattcc | ggttttatta | 69060 |
| gcaaaagaat | acgataaaac | acttaagctg | gtaaatgatt | gtgatattct | aattatcaat | 69120 |
| tcagttcctg | ctacttcggt | tgaagaagac | actattaata | actataaaaa | aattattgat | 69180 |
| aacattaaac | cttctgttcg | tgttgtagtt | tatcaacatg | accattcttc | tctttctttg | 69240 |
| cgccgaaatt | tgggattaga | agaaactatt | cgtcgagctg | atgttatttt | tagccattct | 69300 |
| gataatggtg | attttaataa | agttctgatg | aaagaatggt | atcctgaaac | agtttctctg | 69360 |
| tttgatgata | ttgaagaagc | accgacagta | tataactttc | agcctcctat | ggatattgcg | 69420 |

FIG. 17LL sequence.txt

| | | | | | |
|---|---|---|---|---|---|
| aaggttcggt | caacctactg | gaaagatgtt | tctgaaatta | acatgaatat | caaccgttgg | 69480 |
| attggtcgta | cgactacatg | gaaaggtttt | tatcagatgt | ttgattttca | tgaaaaacat | 69540 |
| cttaaacctg | caggactaag | tactattatg | gaaggtctgg | aacgttctcc | agcgttcatt | 69600 |
| cctattaaag | aaaaaggaat | tccatacgag | tattatcgtc | ttcatcaagt | agaccaaatt | 69660 |
| aaaattgctc | ctaatttgcc | aacgcaaatt | cttgaccgtt | atgtaaatag | cgaaatgctt | 69720 |
| gaacgcatga | gtaaatccgg | atttggttat | cagctgagta | agttggacaa | aaaatatcta | 69780 |
| caacgttctt | tagaatatac | tcatctcgag | cttggtgcat | gtggaacaat | tccggtattt | 69840 |
| tggaaatcta | ctggcgaaaa | tttaaaattc | cgtgttgata | atactccttt | gacctcgcat | 69900 |
| gatagcggta | tcatttggtt | tgatgaaaat | gacatggaat | caacatttga | acgtattaaa | 69960 |
| gaactgtcat | ctgaccgaac | tctttatgac | cgtgaacgcg | aaaaagctta | tgaattttg | 70020 |
| tatcagcatc | aagattcaag | cttctgcttt | aaagaacagt | ttgacattat | tacaaaataa | 70080 |
| agggcttcgg | ccctttagct | ttatacggag | tttgatataa | tgatatttct | tggatatgtg | 70140 |
| atacttttc | ttgcattta | tctattcact | agagcatgtt | ggattgggtt | ctttagcacg | 70200 |
| ccagatgggt | ttatttcaat | aatttatt | tgcatttcaa | tgacggttct | tgatatatga | 70260 |
| aaattttaaa | tttaggtgat | tggcatttag | gcgttaaagc | cgatgatgag | tgggttcaat | 70320 |
| ccattcagtt | ggatggaatt | aaacaagcaa | tagaatattc | taagaaaaat | ggaattacta | 70380 |
| cctggattca | atacggtgat | attttgatg | tgcgaaaagc | aatcacacac | aaaactatgg | 70440 |
| agttcgcccg | tgaaatagtt | caaatgcttg | atgatgctgg | tattacccta | catactattg | 70500 |
| taggaaacca | tgatatgcac | tttaaaaata | ctttaactcc | aaatgcctct | actgagcttt | 70560 |
| tggctaaata | tcctaatgtt | aaagtatatg | ataagcctac | tacagtagat | tttgacggat | 70620 |
| gtttaattga | tttaattcct | tggatgtgtg | aagaaaatac | tggtgaaatt | cttgagcata | 70680 |
| tcaaaacttc | atctgcttct | ttttgtgttg | gtcactggga | actgaatgga | ttttatttt | 70740 |
| ataaaggaat | gaaatctcac | ggtcttgaac | ctgatttcct | taagacttat | aaagaggtgt | 70800 |
| ggtctggtca | cttccatact | atctctgagg | ctgctaacgt | cagatatatt | gggacaccat | 70860 |
| ggacactaac | tgcaggtgac | gagaatgacc | ctcgtgggtt | ctggatgttt | gatacagaaa | 70920 |
| cagaacgaat | ggaatttatt | ccaaacaata | ctacctggca | tcgtagaatt | cattatccat | 70980 |
| ttaaaggaaa | aattgactat | aaagatttta | caaatctatc | agtacgtgtt | atagtaactg | 71040 |
| aagtagacaa | aaatctgacg | aagttcgaat | ctgaactaga | aaaagttgtg | cattcattac | 71100 |
| gagttgtgtc | aaagattgat | aactctgtcg | agtcagatga | cagtgaagaa | gttgaagttc | 71160 |
| aatctcttca | gacgttgatg | gaagaataca | ttaatgcaat | tccagacatc | actgattctg | 71220 |
| accgtgaagc | acttattcaa | tatgcaaatc | agttatatgt | agaggcaaca | caatgacttt | 71280 |
| tgatgaattt | aaaaatgtta | tgatgagtca | gcattttgaa | tgcgaagtaa | aagatgatat | 71340 |

FIG. 17MM sequence.txt

```
tggtcataaa gaaattattg aatattggtt tgaaccgcta gaggttgaag ataattgtat     71400
taaaaaagtt acggtctgta cagattgggc tgtatctttt aacttcaaca ttttagataa     71460
tgacacacct aaatcattgc gagatatggc cgtatcttgt attaaggatg catactgtga     71520
agttttcgac atttgacatt aatgatgaat tcatagcaaa cattgattat accgaagaag     71580
attctagata tgttggaata atttatatta catcaaaaac agcacaaggt gttgtttgca     71640
tggctgaatt tgatgaatac tttttagatt atgatgatat gatagaatgg tctaaaagat     71700
acattaaaag gaatcttttg tgaagaattt taaactaaac cgagttaggt accaaaatat     71760
aatgtcagta ggtggaaatc ctattgacat tcaattagat aaggttcaaa aaactcttat     71820
tactggacga aatggtggtg gtaagtctac tatgttagaa gccatcacat ttgggctttt     71880
tggcaagcca tttcgtgatg taaagaaagg tcaattaata aacagcacaa ataagaaaga     71940
acttttagtt gaactgtgga tggaatatga tgagaaaaag tactatatca aagaggaca      72000
aaaaccgaac gttttcgaaa tcaccgttaa cggtacacgt cttaatgaat ctgccagcag     72060
taaagatttc caagcagaat tgaacagct atcggaatg tcatatgcca gtttcaagca      72120
gattgttgtc cttggtacag cagggtatac ccctttcatg ggtttgtcga cccctgcgcg     72180
aagaaagctt gtggaagact tgcttgaggt aggaacatta gctgaaatgg ataagcttaa     72240
taaagcacta atacgcgaat taaattcaca aaaccaagtg cttgatgtta aaaaagatag     72300
tattatccaa caaattaaaa tatataatga taacgttgaa cgccagaaaa aattaacggg     72360
tgacaacctt actcgtctgc aaaatatgta tgatgatttg gcaaaagaag ctagaacgct     72420
aaaatcggaa atagaagaag ctaatgaaag attagttaat attgttttag acgaagaccc     72480
gactgatgca tttaataaaa tcggtcaaga agcagtttta attaaatcaa aaattgactc     72540
gtataataaa gtcattaata tgtatcacga aggtggatta tgcccaacct gtttgtcaca     72600
attaagttcc ggtgataaag ttgtttctaa aattaaagat aaagtttctg aatgcacaca     72660
ttcatttgaa cagctttcaa cgcatcgtga taatttaaaa gttcttgttg atgaataccg     72720
agataatatt aaaacccaac agtcgttggc aaatgatatc cgcaataaaa agcaatctct     72780
aatcacgacg gtagataaag ctaaaaaagt taaagcggct atagaaaaag catcttctga     72840
gtttattgac catgctgatg aaatagcact gcttcaagaa gaacttgata aaattgttaa     72900
gacaaaaact aatttagtaa tggaaaaata ccaccgagga attttgactg atatgctcaa     72960
agattctggt attaaaggtg ctattattaa aaagtacatt ccattattta ataagcagat     73020
taaccattat cttaaaataa tggaagcgga ttatgtgttt acattagatg aagaatttaa     73080
tgagacaatt aaatcccgtg gtcgtgaaga ttttagttat gcttcattca gtcaaggtga     73140
aaaagcacga attgatattg ctctttttatt tacttggcgt gatattgctg aaaaagtttc     73200
```

FIG. 17NN sequence.txt

| | | | | | |
|---|---|---|---|---|---:|
| aggtgttaaa | ataaacacac | taattcttga | tgaagttttt | gattcagcga | ccgacgttga | 73260 |
| aggtgtaaaa | gctatttcaa | ctattttaga | tagtttaaaa | aatactaacg | ttttgttat | 73320 |
| ttcgcataga | gaccatgacc | cgcaagcata | cggtcagcat | cttcaaatga | agaaagttgg | 73380 |
| tcgatttact | gtaatggttt | aatttataag | agattatgct | ttaatttatt | agagtataat | 73440 |
| ctctatggag | gaaaaacatg | gaatattcaa | ccggacagca | tctattaact | attcctgaaa | 73500 |
| taaaacgata | tattctgaga | aataattttt | ctaatgaaga | gcatatagtt | actgaatcta | 73560 |
| tgcttaggaa | tgcatttaaa | gcagaatata | caaaaataat | gtccaataga | aatgaagctt | 73620 |
| ggactgttac | tgattattat | gactaaaggt | gtattatgac | taaaattact | gtgaattata | 73680 |
| ctgttgatgt | aaaagatatt | cagccaaaac | acgtgcgttc | tgaatcaaat | ccacaaaacc | 73740 |
| aaaataaaat | tcgtcgagca | tgggttttgt | ctctttctga | taacgcaatg | gaagttattc | 73800 |
| agaacaaaat | taaatctgca | cctgctcgtc | atgcgtatta | tgaagctatc | gatcgtgaag | 73860 |
| taagtaataa | atggattgaa | ctaatgcgca | aacatactac | agaatcccta | aacgctggtg | 73920 |
| ctaaatttat | tatgacttca | tgtggtgaac | gccttgaaga | tgaatattgt | ggcaatgcag | 73980 |
| atgaacgtct | gattgttgcc | gctcaaattg | ttgccgaaac | aatcgcagct | gattttaatc | 74040 |
| gttaattgct | ttattaaatt | agttataaaa | ttaaatctca | tttgaattga | aggaaattac | 74100 |
| atgaaactgt | ctaaagatac | tactgctctg | cttaaaaatt | tcgctactat | taactctggt | 74160 |
| attatgctta | aatccggtca | atttattatg | actcgcgcag | ttaatggtac | aacttatgcg | 74220 |
| gaagcaaata | tttctgacgt | tattgatttt | gatgtagcaa | tttacgattt | gaacggtttt | 74280 |
| ctcggtattc | tgtctctagt | taatgatgat | gcagaaattt | cccagtcaga | agatggaaat | 74340 |
| attaaaattg | ctgatgcccg | ctcaacaatt | ttttggccag | cagccgatcc | gagtacagta | 74400 |
| gttgctccta | ataaaccaat | tccattcccg | gtagcatctg | ttgttactga | aattaaagct | 74460 |
| gaagaccttc | aacaactgtt | gcgtgtatct | cgtggtctgc | aaattgatac | aattgctatc | 74520 |
| acggtaaaag | aaggtaaaat | cgtaattaac | ggttttaata | aagtagaaga | ttctgctttg | 74580 |
| actcgtgtta | aatattcttt | gactcttggt | gattatgatg | gtgaaaacac | atttaatttc | 74640 |
| attatcaata | tggcaaatat | gaaaatgcaa | ccaggaaatt | ataaacttct | gctttgggca | 74700 |
| aaaggtaaac | aaggcgctgc | taaatttgaa | ggtgaacatg | cgaattatgt | agtagctctt | 74760 |
| gaagctgatt | ctacccatga | tttttaatag | agggcttcgg | cccttttataa | tttacactaa | 74820 |
| aacttgaatg | aggaaattat | gattaccgta | aatgaaaaag | aacacattct | tgaacagaaa | 74880 |
| tatcgtccat | ctactatcga | tgaatgtatt | cttcccgcct | ttgataaaga | aacctttaaa | 74940 |
| tctattacaa | gtaaaggtaa | gattccacat | attattcttc | attctccttc | tccaggaaca | 75000 |
| ggtaaaacaa | ctgtagcaaa | agcattgtgt | catgatgtaa | atgctgatat | gatgtttgtg | 75060 |
| aatggatcag | actgtaaaat | tgatttcgtt | cgtggtcctt | tgactaattt | tgctagtgca | 75120 |

FIG. 1700 sequence.txt

| | | | | | |
|---|---|---|---|---|---|
| gcttcatttg | atggtcgtca | aaaagtaatc | gttattgatg | aatttgaccg | ttcaggttta | 75180 |
| gcagaatctc | agcgacatct | tcgttccttt | atggaagctt | atagttcaaa | ctgtagtatt | 75240 |
| attattactg | ctaacaatat | tgatggtatt | attaaaccac | ttcagtcacg | ctgccgagtt | 75300 |
| attacgttcg | gtcaaccgac | cgatgaagat | aaaattgaaa | tgatgaagca | gatgattcgt | 75360 |
| cgattgactg | aaatctgtaa | gcatgaagga | attgctatag | ctgatatgaa | agttgtagca | 75420 |
| gctttggtta | aaagaatttt | cctgatttt | cgtaaaacta | ttggcgagct | cgatagttat | 75480 |
| tcatctaaag | gtgttttgga | tgctggtatt | ttatcactgg | ttactaacga | tcgtggtgct | 75540 |
| attgatgatg | ttcttgagtc | tctcaaaaat | aaagatgtta | acaactcag | agctttagca | 75600 |
| ccaaaatatg | cagccgatta | ttcgtggttc | gtgggtaaac | ttgccgaaga | aatctattca | 75660 |
| cgtgtaactc | cacagagtat | tattcgtatg | tacgaaattg | tcggcgaaaa | taatcagtat | 75720 |
| catggtattg | cagctaatac | tgaattgcat | ctagcttatc | ttttcattca | gttagcatgt | 75780 |
| gaaatgcagt | ggaagtgata | tgagcttatt | tgaagatgat | attcaattaa | acgagcatca | 75840 |
| agttgcttgg | tattcaaaag | attggacagc | cgtccaatcc | gctgctgatt | cttttaaaga | 75900 |
| aaaagctgaa | aatgagtttt | ttgaaataat | tggagctatt | aataataaaa | ctaaatgctc | 75960 |
| tattgctcaa | aaagattatt | caaaattcat | ggttgaaaat | gcattatcac | aatttccaga | 76020 |
| gtgcatgcca | gctgtatatg | caatgaattt | aatcggttct | ggattaagtg | atgaagctca | 76080 |
| ttttaattat | ctaatggctg | ctgttcctcg | tggtaaaaga | tatggtaaat | gggcaaaact | 76140 |
| ggttgaagat | tccaccgaag | tattgattat | taagttactt | gctaagcggt | atcaagttaa | 76200 |
| tacaaatgat | gcaattaact | ataaatcaat | tcttactaaa | aatggaaaac | ttcctttagt | 76260 |
| attaaaagaa | ctaaaaggtt | tagtcacgga | tgattttttg | aaagaagtga | ctaagaacgt | 76320 |
| aaaagaacag | aaacaactca | aaaaactagc | attggaatgg | taaaatgatt | gaaattactc | 76380 |
| ttaaaaaacc | tgaagatttt | ctgaaagtaa | aagaaacttt | gactcgtatg | ggaattgcta | 76440 |
| ataataaaga | taaagttctg | tatcagtcct | gtcatattct | tcagaaaaaa | ggactatact | 76500 |
| atatcgttca | ttttaaagaa | atgcttcgta | tggatggccg | tcaagttgaa | atgacagaag | 76560 |
| aagatgaagt | tcgtcgtgat | tcgattgcat | ggctgttaga | agattggggg | ctgattgaaa | 76620 |
| tcgttcctgg | tcaaagaact | tttatgaaag | atttaactaa | taacttccga | gttatttctt | 76680 |
| ttaaacaaaa | acatgaatgg | aaactcgttc | ctaaatatac | gattggtaat | taatatgact | 76740 |
| gctataactc | cacaagaata | catggcgtct | cttaaagaaa | aatataatct | ttctgcaaca | 76800 |
| gaaacacttt | ttgatttacc | agaaaacctc | caattaaaat | ttcaggtaga | atttcaaaaa | 76860 |
| ttagttcacc | cagaacaaaa | acattttact | gcagtcgtta | agtcaattaa | tgcagatgga | 76920 |
| atgataattt | tcacccggca | aatagtacta | atttaagcaa | ggggcttcgg | cccttattt | 76980 |

FIG. 17PP

```
                                    sequence.txt
ggagtataat atatcaagag cctaataact cgggctataa actaaggaat atctatgaaa    77040
gaattttata tctctattga aacagtcgga aataacattg ttgaacgtta tattgatgaa    77100
aacggaaagg aacgtactcg tgaagtagaa tatcttccaa ctatgtttag gcattgtaag    77160
gaagagtcaa agtacaaaga catctatggt aaaaactgcg ctcctcaaaa atttccatca    77220
atgaaagatg ctcgagattg gatgaaacga atggaagaca tcggtctcga agctctcggt    77280
atgaacgatt ttaaactcgc ttatatcagt gatacatatg gttcagaaat tgtttatgac    77340
cgaaaatttg ttcgtgtagc taactgtgac attgaggtta ctggtgataa atttcctgac    77400
ccaatgaaag ctgaatatga aattgatgct atcactcatt acgattcaat tgatgatcgt    77460
ttttatgttt tcgacctttt gaattcaatg tacggttcag tatcaaaatg ggatgcaaag    77520
ttagctgcta agcttgactg tgaaggtggt gatgaagttc ctcaagaaat tcttgaccga    77580
gtaatttata tgccattcga taatgagcgc gatatgctca tggaatatat caatctttgg    77640
gaacagaaac gacctgctat ttttactggt tggaatattg agggatttga cgttccgtat    77700
atcatgaatc gcgttaaaat ggttctcggt gaacgcagta tgaaacgttt ctctccaatc    77760
ggtcgagtaa aatctaaact tatccaaaat atgtacggta gcaaagaaat ttattctatt    77820
gatggcgtat ctattcttga ttatttagat ttgtataaga aattcgcatt tactaatttg    77880
ccgtcattct ctttggaatc agttgctcaa catgaaacca aaaaaggtaa attaccatac    77940
gacggtccta ttaataaact tcgtgagact aatcatcaac gatacattag ttataacatc    78000
attgacgtag aatcagttca agcaattgat aaaattcgtg ggtttatcga tctagtttta    78060
agtatgtctt attacgccaa aatgcctttt tctggtgtaa tgagtcctat taaaacttgg    78120
gatgctatta tttttaactc attgaaaggt gaacacaagg ttattcctca acaaggttcg    78180
cacgttaaac aaagttttcc gggtgcattt gtatttgaac ctaaaccaat tgctcgtcga    78240
tatattatga gttttgactt gacgtctctg tatccgagca ttattcgtca ggttaacatt    78300
agtcctgaga ctattcgtgg gcaatttaaa gttcatccaa ttcatgaata tatcgcagga    78360
acagctccta agccaagtga agaatattct tgttctccga atggatggat gtatgataag    78420
catcaagaag gtatcattcc aaaggaaatc gctaaagtat ttttccagcg taaagactgg    78480
aaaaagaaaa tgttcgctga agaaatgaat gccgaagcta ttaaaaagat tattatgaaa    78540
ggcgcagggt cttgttcaac taaaccagaa gttgaacgat atgttaagtt cagtgatgat    78600
ttcttaaatg aactatcgaa ttatactgaa tctgttctca atagtctgat tgaagaatgt    78660
gaaaaagctg ctacacttgc taatacaaat cagctgaacc gtaaaattct cattaacagt    78720
ctttatggcg ctcttggtaa tattcatttc cgttactatg atttgcgaaa tgctactgct    78780
atcacaattt tcggccaagt tggtattcag tggattgctc gtaaaattaa tgaatatctg    78840
aataaagtat gcggaactaa tggtgaagat ttcatcgcag caggtgatac tgattcggta    78900
```

FIG. 17QQ sequence.txt

| | | | | | |
|---|---|---|---|---|---|
| tatgtttgtg | tagataaagt | tattgaaaaa | gttggtcttg | accgattcaa | agagcagaac | 78960 |
| gatttagttg | aattcatgaa | tcagttcggt | aagaaaaaga | tggaacctat | gattgatgtt | 79020 |
| gcatatcgtg | agttatgtga | ttatatgaat | aaccgcgagc | atctgatgca | tatggaccgt | 79080 |
| gaagctattt | cttgccctcc | acttggttca | aagggtgttg | gtggattttg | gaaagcgaaa | 79140 |
| aagcgttatg | ctctgaacgt | ttatgatatg | gaagataaac | gatttgctga | accgcatcta | 79200 |
| aaaatcatgg | gtatggaaac | tcagcagagt | tcaacaccaa | aagcagtgca | agaagctctc | 79260 |
| gaagaaagta | ttcgtcgtat | tcttcaagaa | ggtgaagagt | ctgtccaaga | atactacaag | 79320 |
| aacttcgaga | aagaatatcg | tcaacttgac | tataaagtta | ttgctgaagt | aaaaaccgcg | 79380 |
| aacgatatag | cgaaatatga | tgataaaggt | tggccagggg | ttaaatgccc | gttccatatt | 79440 |
| cgcggtgtgc | taacttatcg | tcgagctgtt | agtggtctgg | gtgtagctcc | aattttggat | 79500 |
| ggaaataagg | taatggttct | tccattacgt | gaaggaaatc | catttggtga | caagtgtatt | 79560 |
| gcttggccgt | cgggcacaga | acttccaaaa | gaaattcgtt | ctgacgtact | gtcttggatt | 79620 |
| gactactcaa | ctttgttcca | aaaatcgttt | gttaaaccgc | ttgcgggtat | gtgtgaatcg | 79680 |
| gctggtatgg | actatgaaga | aaaagcttcg | ttagacttcc | tgtttggctg | atagaataaa | 79740 |
| tctagggacc | tccgggtccc | tttttcatac | aagtaatata | aatctatact | tatgaaaaac | 79800 |
| agatgattct | ggacctttag | aattccctaa | aaaattttc | acaaaactgt | ttacaagact | 79860 |
| gttcctctgt | ggtactatac | aactatcaac | taatacggat | ttggagaatg | aaatgaaaat | 79920 |
| cgctattttg | gttattgcat | taggtcttac | tggttgtgta | gctcaaggac | cggtagtaaa | 79980 |
| tcagtctgat | gtaggaaaaa | ttgtaaactg | ttcaagcaaa | ttttataatc | ctaatgtcaa | 80040 |
| gtgttataaa | gaagctccaa | agcaaacagt | agaacaaatg | caggcgaatt | ttgacgaagc | 80100 |
| tattcgtcca | gatgaatctg | ctcaagcata | tcgtaattct | gatgtaatta | cacgcgaaga | 80160 |
| aaaaattgaa | aactactgcg | cagagctttg | ggcaaattgg | gctaataatt | accaatggcg | 80220 |
| tactggtaaa | aatgctccga | tggagtatgt | agtgaattct | tataattcat | gcgtaaaaaa | 80280 |
| tttgactaag | tgaggaaaag | atggaaactt | tagtagcagg | ttcaattttt | atggttttag | 80340 |
| tttcaggcgt | gttggctatt | attatataca | tgcttccatg | gttcatcgcc | ttgatgcgtg | 80400 |
| ggtcaaaatc | gacagtagga | atcttttca | cgtctttact | gtttaactgg | tcaattattg | 80460 |
| gttggtttat | tacatttatt | tggtcaattg | cgggtgaaac | taaaaagtct | gcacaaccaa | 80520 |
| accaggtaat | tatcatcaga | gagaaggaat | gaaaagcaaa | attataacag | tgttgctttt | 80580 |
| aatcttgatg | attataataa | gtatatacta | tagtgtaacg | gttcctctta | tgattccaac | 80640 |
| tattatttta | ggttggggtt | tattactgtt | acaagttaaa | tatgaatgta | tcaattgagg | 80700 |
| tttaaatgat | tagtgactct | atgacagttg | aagaaatccg | tcttcatttg | gggcttgcat | 80760 |

FIG. 17RR sequence.txt

```
taaaagaaaa agatttcgta gttgataaaa ctggtgttaa aactattgaa attattggcg    80820
catcatttgt agcagatgaa ccgtttattt ttggcgctct taatgatgaa tacattcagc    80880
gtgaacttga atggtataaa tctaagagct tgtttgttaa agatattcca ggtgaaacac    80940
caaagatttg gcagcaggta gcatcttcta aaggcgaaat taactcgaat tatggttggg    81000
ctatttggtc agaagataac tatgcccagt atgatatgtg tttagctgaa cttggtcaaa    81060
atcctgattc tcggcgtggt atcatgattt atactcgtcc atccatgcaa tttgactaca    81120
ataaagatgg tatgtcagat ttcatgtgta ctaatacagt acagtacctg attcgtgata    81180
agaaagtcaa tgcggttgtt agcatgagaa gcaatgattg ctgggcaggc tatcgtaatg    81240
attatgcttg gcaaaaatac gtactagata aattagtatc tgatttgaat gcaggcgacc    81300
catcgcggca atataaagca ggttctatta tatggaacgt tggaagtctt catgtgtacg    81360
aaaatcagtt ttatttagtt gaccattggt ggaacaccgg tgagactcat attgctaaaa    81420
aggattatac tggaaaatgg aagtaaatgt gccgcatgtt tataagtata aacatcctaa    81480
aactaaaaag tggtatatag gaagtcatga tggtcacaac ccgaattatg atggttcggg    81540
tgtagtttgg caacatgtta aaaagaaata tggaataaaa tcctttaata agaaatatt     81600
atatgaagga ccaatgttta gacaggttga agaaattatt ttaacttgtt tagatgctgc    81660
taattgtccg gattcatata atttaaagaa tgaagcatgg ggaggaagtt ttccaggcaa    81720
attaaatgga atgtacggta aaaaactatc tccagaagaa agatataagt gcggaaatgc    81780
ctttcgtgga atcaagcgtc ctgatcattc taaaagaatg aaaggcgaag gtaatccaat    81840
gtatggtaaa aatgagcagg catatggaat tataaatcga gccaaggaaa attctggtaa    81900
aacttatgaa gaaattttg gcgtagaaaa agctaaaata attaaagaaa cgatgtctaa    81960
aaatcgtaaa ggaaaacctc ataatttgat agaaaaaata tgtccgcatt gcggactaaa    82020
aggacgtggg ccaaatatga caagatacca ttttgataaa tgtaaggcac ttaaatgatt    82080
caattcgtaa ttccgagcta tcaacgtgta ggggcagttt ctgcccttga tatgtttccg    82140
actgattatg aacctcatat cgtagtacgt gaacatgaag aaaaagctta ttatgatgcc    82200
tatgggtcta aagctaaaat tgtaactatt cctgatgatg ttaatggaat tgccggtact    82260
cgtaaagcaa ttactgatat gtatgcaggt caacgaatct ggatgattga cgatgatact    82320
actattcgta tgagttcaat gcgaaaaaga gatgatcgtc gttgtgtgga taaagtcaat    82380
caattgactc gtgaacagtt ctatgaattg attcaatacg tcgaagatgc catggattgt    82440
gggtattatc acggtcatgc tcgcctacca attttaaaa ttacttcatc ttggggtaat    82500
tatcgtgaaa attcatatgg attcacgaat acatggtatg accttggaaa acttacgaca    82560
gaacaaattg ggtatggaaa aattgatttg tgcgaagata tgtatgcatt tctcaattta    82620
attaatcaag gttatccgca tttggccttg ttcaaatatc tggttgtatc tggaaaagca    82680
```

FIG. 17SS sequence.txt

| | | | | | |
|---|---|---|---|---|---|
| caagctcctg | gagggtgcag | ttcaattcgt | agtaattcta | aacataatag | agcgcttgag | 82740 |
| caaatcaata | gagagtttcc | agagcaagct | cgttggaaaa | cttctaatat | tgaaaaacga | 82800 |
| aaatcgttgg | gtgaagaaga | cgagccatta | aaggttcttc | gcatgtgcgt | ttcgcgtaaa | 82860 |
| gaaaaatcag | aagcatttca | taagtttaat | gctattcatc | caatagcagt | tgattaatgc | 82920 |
| ctaaatttat | tgtgttataa | ttactctatc | tttaaccagt | gaggaaaata | taatgatgcc | 82980 |
| tatggaaaaa | aatgaatgtc | tattgcagat | ttaaaatccc | gtttgattaa | agcttccact | 83040 |
| tctaaaatga | ctgctgaact | gactacatct | aaattcttta | atgaaaagga | tgtaattcgt | 83100 |
| acaaaaattc | caatgcttaa | tattgctatt | tctggtgcga | ttgatggcgg | tatgcagtct | 83160 |
| ggtttaacta | ttttcgcagg | gccttctaaa | cactttaaat | caaatatgtc | tttgactatg | 83220 |
| gttgcggcat | atttgaacaa | atatcctgac | gcggtttgtc | tattctatga | tagtgaattt | 83280 |
| ggtattactc | cagcttattt | gcgatccatg | ggagttgacc | cggaacgagt | aattcatacg | 83340 |
| ccaatccagt | cagttgaaca | gctgaaaatt | gatatggtga | atcagcttga | agctattgag | 83400 |
| cgtggtgaaa | aagttattgt | attcatcgac | tcaatcggta | atatggcttc | taagaaagaa | 83460 |
| acggaagatg | ccttgaatga | aaaatctgtg | gcagatatga | ctcgtgctaa | atcactgaag | 83520 |
| tcattattcc | gtattgttac | tccttacttt | agcattaaaa | atattccatg | tgttgcggtt | 83580 |
| aaccatacaa | ttgaaacaat | tgaaatgttt | agtaaaaccg | tgatgacagg | tggtacaggc | 83640 |
| gtaatgtatt | cggctgatac | tgtattcatt | atcggtaagc | gtcagattaa | agatggttct | 83700 |
| gatcttcagg | ggtatcaatt | tgttctaaat | gtagaaaaat | ctcgtaccgt | taaagaaaaa | 83760 |
| agtaaattct | ttattgatgt | taaatttgac | ggtggtattg | atccttattc | tggattgtta | 83820 |
| gatatggctc | tagaattagg | atttgtagta | aaacctaaaa | atggttggta | tgctcgtgaa | 83880 |
| tttcttgatg | aagaaaccgg | cgagatgatt | cgcgaagaaa | atcttggcg | tgcaaaagat | 83940 |
| accaactgca | ctacattctg | gggtcccttta | tttaagcatc | aaccattccg | agatgctatt | 84000 |
| aaacgtgctt | atcagttagg | tgctattgat | agtaatgaaa | ttgttgaagc | tgaagttgat | 84060 |
| gaattgatta | actcaaaggt | tgaaaaattt | aaatctccag | aaagtaaaag | taaatcagca | 84120 |
| gctgatttag | aaactgacct | cgagcagtta | agtgatatgg | aagaatttaa | tgagtaaaga | 84180 |
| tgatttagat | ttagaaatta | tcgatgaatc | cccctcttcg | gagggggaag | aagaaagaaa | 84240 |
| agaacgtctt | tttaatgagt | ctcttaagat | aattaaatcc | gctatggaaa | atgttatcca | 84300 |
| ggagattgtc | attaaactag | aagatggttc | tacacacatt | gtgtatgtga | caaaattaga | 84360 |
| ttgggttgat | ggaaagtcg | taatggactt | tgctgttctt | gaccaagaaa | gaaaagctga | 84420 |
| gttagctcct | catgtagaaa | aatgtattac | aatgcaacta | caagatgcat | ttaataaaag | 84480 |
| gtcaaagaaa | aaatttaaat | tcttttaagg | agtaagtgtg | gtagaaatta | ttctttccca | 84540 |

FIG. 17TT sequence.txt

| | | | | | |
|---|---|---|---|---|---|
| tctcatattt | gatcaagctt | atttttcaaa | agtttggcca | tatatggatt | cagaatattt | 84600 |
| tgaaagtggt | ccagctaaaa | atacattcaa | attaattaaa | tctcatgtta | atgagtacca | 84660 |
| tagcgttcca | tctattaatg | cgttaaatgt | tgcattagaa | aatagttcat | ttactgaaac | 84720 |
| agaatattct | ggtgtaaaaa | cacttatttc | aaaactagcc | gattctccgg | aagaccacag | 84780 |
| ctggttagta | aaagaaacag | aaaaatatgt | tcagcaaagg | gcgatgttta | atgctacgtc | 84840 |
| taaaataatt | gaaattcaaa | ctaatgctga | gcttcctccg | gaaaaacgaa | ataagaaaat | 84900 |
| gccagatgta | ggtgctattc | ctgacatcat | gcgccaagca | ttatcaattt | catttgatag | 84960 |
| ttacgttggt | catgattgga | tggatgacta | cgaagcacgt | tggctatctt | atatgaataa | 85020 |
| agctcgtaag | gttccattta | aactcaaaat | tctaaataaa | attactaaag | gcggagctga | 85080 |
| gactggaaca | ctgaacgttt | taatggctgg | tgttaacgtt | ggtaagtcat | taggattgtg | 85140 |
| ttcattggca | gcagattatt | tacagctcgg | tcataatgtt | ctttacattt | ccatggaaat | 85200 |
| ggcagaagaa | gtctgtgcta | aacgtattga | cgctaatatg | cttgatgttt | ctcttgatga | 85260 |
| cattgatgat | gggcatattt | cttacgctga | gtataaagga | aaaatggaaa | aatggcgtga | 85320 |
| gaaatctact | ctcggtcgtt | taatcgttaa | gcaatatcct | actggtggag | cagacgctaa | 85380 |
| tacatttcga | tctcttttaa | acgaattgaa | gctcaagaag | aattttgttc | caacaatcat | 85440 |
| tattgttgac | tatctgggta | tttgtaaatc | ttgccgcatc | agagtttatt | cggaaaatag | 85500 |
| ttacacaact | gttaaagcta | tcgcagaaga | attgcgtgct | ctggctgttg | aaactgaaac | 85560 |
| tgttctttgg | actgcagcac | aggttggtaa | gcaagcttgg | gattcttctg | atgttaacat | 85620 |
| gagcgatatt | gcggaatctg | ccggtcttcc | agcaacagcc | gattttatgc | ttgcggtcat | 85680 |
| tgaaaccgag | gagttagcag | ctgctgaaca | acaactcatt | aagcaaatca | aatcacgata | 85740 |
| tggtgataag | aataaatgga | ataagttttt | gatgggtgtt | caaaaaggaa | atcagaaatg | 85800 |
| ggtagaaatt | gaacaagatt | ctactccaac | tgaagtgaac | gaagtagcag | gttcacaaca | 85860 |
| gatacaagct | gaacagaacc | gctatcaaag | aaacgaatcc | actcgagctc | agttagatgc | 85920 |
| tttggcgaat | gaattaaaat | tttagtttac | aagctgacaa | gactatggta | tagtagtctt | 85980 |
| gttggttaaa | tgaggagatt | gttatggaat | tggtaaaggt | agttttatg | gggtggttta | 86040 |
| agaatgaaag | catgtttact | aaagaaatca | caatgatgaa | agatgacgtt | caatgggcta | 86100 |
| ctactcaata | tgctgaagtt | aataaagcgc | tagttaaagc | tttcattgat | gacaagaaag | 86160 |
| tatgtgaagt | ggattgccga | ggataatatg | cacattgttt | tatttaaacc | tactccgtat | 86220 |
| aatgtcagga | aaaatactca | attcaaagca | cttatcgcag | atacgtggga | attggtgtta | 86280 |
| gatattccag | cagaagaaag | tcctccatt | ggtcgagtgg | aatttattaa | gtttgctgtg | 86340 |
| cgccctacga | agcgacagat | tcgccaatgc | aaaagatact | ttcgtaaaat | cgtcaagtta | 86400 |
| gagaaacagt | tattgatgct | agtaaaatag | tagtttacaa | gctgatagag | ttgtgttata | 86460 |

FIG. 17UU sequence.txt

```
gtaattctat cagctaatcg cggagaaaag aaaatgatgc tagttaatag agaatatcag    86520
tttaaatcag aagaagattt ggaaaaattc gcgagtggtt gtgaactgaa tagacgcaca    86580
gctaaagtca taggattaaa accctttaca gttctagatt gtgaagtttc taaattccgc    86640
agagggtgtt ctattagcgg tcatgctctg gttgatgaa acacattttt ctttgttttt    86700
agcgtcagag aactttatt gattaacgaa cttgaggaaa taaaatagtt tacttttgtt    86760
ttaaacatgt tattatagac ctatcaaaac aaacgagtaa atggagaaca aaatgtctaa    86820
agtatcaggt tatcaattat taacacaaga acaacgttca gagatggatt ctttacaaga    86880
acggtgtcag catagaaata acgcacttga ttcattttta ttagttgaat atgaaaactt    86940
gtgctctaga cttgaaaaag aatatgttca tcaacatgaa ggaggagaag aatgaaactg    87000
aaatcaccaa ttattgcaat ttgtctgttt gcttctacta gtgtttactt ttgttgaaaa    87060
ttgagatact ataaacataa actactgagg agattatcat gaaaaaattt atctttgctg    87120
caatttttgc tttatcttct tgcgctgctc agcctgctat ggcgggttat gacaaagatt    87180
tgtgtgagtg gtctatgact gcagatcaga ctgaagttga aactcaaatt gaagcggata    87240
ttatgaatat cgttgagcgt gatcgtcctg aaatgaaagc tgaagtgcaa aaacagctca    87300
agtctggtgg tgtaatgcag tataattacg ttctgtattg tgataaaaac ttcaataata    87360
aaaatatcat cgctgaagtg gtaggtgagt aattagaggt taatatgtat agttctgaat    87420
tttcatattt aaaaatggaa aaaaatttca tacgatttta tagatgaaaa ggtttattac    87480
agtttccatg aaccacgttt taatagtgag gttgggttta ttgcagtaaa agacaatttc    87540
attttaaaaa tatattcggc attaaaggat tttcactacg aaaatattaa cctaaaattt    87600
gataaagaaa acgttcgtaa ttgcgcagta acaattacag gaaataaagg tacatgcgtt    87660
atgctatctg atgaaattaa tgatttgcta aatgatgccg aaaaggttgc tattccatcg    87720
attgatgacc aaattttaa tgcttttatg aatagaggtt aatatgaaaa cgtttaaaga    87780
atttatcaaa gaagatatgg tcgctggaga ttcaggtggt aatcctgaaa atatctctac    87840
tggaacaacg tcaggcgctg tagtaaataa aggtcctgaa cagattccta aaaagaaaaa    87900
agaggaatct aaagaaaaag aagagtaaaa atgtcatcga taccttggat tgataatgag    87960
tttgcatatc gtgcattagc tcatttacct aaattcacac aagtaaataa tagttcaact    88020
tttaaattgc ggtttagatg ccctgtttgt ggagattcaa aaaccgacca aaataaagcc    88080
cgtggatggt attatggtga taataatgaa ggaaatattc attgttataa ctgtaactat    88140
catgcaccaa tcggaatata tttaaaggag tttgaacctg atttatatcg tgagtatatc    88200
tttgaaataa gaaaagaaaa aggtaaaagt cgtccagtag aaaaacctaa agaacttcct    88260
aaacaacctg agaagaaaat aattaaatct cttccgtcat gcattagatt agataaattg    88320
```

FIG. 17VV sequence.txt

```
gcggaagacc atccaattat aaaatacgta aaagctcgct gtattccaaa ggataaatgg      88380
aaatatcttt ggtttacaac tgaatggcct aaattagtta atagcatagc accaggaaca      88440
tataaaaagg aaatacctga gcctcgtctt gttattccaa tttataatgc taatggaaaa      88500
gctgagtctt ttcaagggcg tgcattaaag aaagatgctc cccaaaaata tatcaccatc      88560
aaagcttatc ctgaggcaac aaaaatctat ggtgttgaac gggttaaaga tggtgatgta      88620
tatgttctag aaggacctat agattcgctt tttattgaaa atggtatagc tattacgggt      88680
ggtcaattag acctagaaat tgttccattt aaagatagac gtgtatgggt tttagataat      88740
gaacctcgtc accctgacac tattaaacga atgactaaat tagttgatgc aggagaaagg      88800
gttatgtttt gggataaatc tccctggaaa tcaaaagatg tcaatgatat gattagaaag      88860
gaaggtgcaa cccctgaaca aattatggaa tatatgaaaa ataatattgc ccaaggggttg     88920
atggctaaaa tgcggctatc taaatatgct aagatttaaa ttaacccaac caaagcaaat      88980
gctaaatcta cgaatgtatc aagagtaatt actggaatac taacgccatg agcaatagca      89040
actggcgata aacaaaatt ccaaagtaaa attcctatca tagcagaaat agtaaaagct       89100
atacgttttt tattacctt gatggcatta acaagtgcca ttaattttg taccatatgt        89160
cctccttatt gctttatata tttattgtat aattaatcta ctaatccatg aattgaaagg      89220
aaaaataatg gcatacttta atgaatgcgc tcatttgatc gaaggtgttg ataaagcaaa      89280
tcgtgcatat gctgagaata ttatgcacaa tattgacccg ctgcaggtta tgcttgatat      89340
gcagcggcat ttacaaattc gtttggctaa cgataaacca gaaacaaatc gtcatcccga      89400
ttcacttgaa actgcgggag aagttcttgc ttggctgcga aaccaagacg attatatcgc      89460
agacgaaact cgcgagctat atacttctct tggtggtatg agtaatggtg aaaaagaagc      89520
ttctgctgta tggaaacctt ggaagaaacg ttattctgaa atgcaatcca agaaaattca      89580
agatttatct cctgaagatc agcttgaaat taaatttgaa ctgattgatc aatttcactt      89640
tttcatgaat aaatttattg ctcttggaat gtcagctgaa gaaatcttta aactttatta      89700
tctgaaaaat gctgaaaatt tcgctcgtca agatcgaggt tattaatggc tcgtttaaat      89760
aaacgccagc ttaagaaagc ccacaagaaa cgtattgacc agctatttaa aaattatgac      89820
aaagagctcg tgtgtgagct cttatctaat cagcttcgtg cggttgattg ggttgtagaa      89880
gaaggtcctg atgaaatttt tgtcagcgaa gaagccttaa aattaattat agagcattca      89940
aaatgaaaat atccaaagaa gaatttatta gacgacaaaa agctttaatt aatttacacg      90000
agtggtatgc ttaccagctt aaagtagata gctctaatat aaatgctgta atggctttat      90060
ataaacaaat tcaagatgaa cacgaattcc tggcacaagt tttcattgaa gactgatata      90120
aatacacctg taattaaaca ataaaggagt ttattatggg tggtttcgtt aacatcaaga      90180
cctttactca tccagcgggt gaaggcaaag aagttaaagg tatggaagtt tctgttccgt      90240
```

FIG. 17WW sequence.txt

| | | | | | | |
|---|---|---|---|---|---|---|
| ttgaaattta | ttctaacgag | catcgtatcg | cagattctca | ttatcagatc | tttccgtcag | 90300 |
| aaaaggcagc | atattctact | gtagtttctg | atgcagctga | ttggaaaact | aagaatgctg | 90360 |
| caatgtttac | gcctacacaa | ataggtggtt | aataattcaa | ggactcctcc | gggagtcctt | 90420 |
| ttttcatttt | actggtttac | tttccaaaat | gagtatggta | taataaaatt | atcttataga | 90480 |
| ggagagcact | atgttaaatc | gttggattaa | accaaatgaa | gatttagata | ttatcatttc | 90540 |
| acggcatgta | atgaagaaat | atgaactgca | gccatggtct | acagaagttg | ttgtgcattc | 90600 |
| atttatgatg | tacgcagatg | gttctgtcga | atttaatgca | gaaattcgat | atgattatgg | 90660 |
| cgagaagcaa | gtcgaattca | agagaggctt | tttgtaatgt | ttatctttaa | ttggtttaaa | 90720 |
| agcttcttta | cagattttt | ctctacaact | cctggagaag | gtgtagttcc | tatttcaaat | 90780 |
| gactaccttc | ctttaactgt | agttgaatat | gtttatatgg | gagatggaac | agtagaagca | 90840 |
| gttactatga | cttatgaaga | agcccaagaa | tattataaaa | atccttggcg | ctggtcaaca | 90900 |
| cctattacat | catctaatac | acagaataca | cagtctagtt | ctgattcata | tgacactaat | 90960 |
| gttcctgttc | atgtatggac | gggcgattcg | tgtggaagtt | cttgtgattc | tagttgttca | 91020 |
| tctacatctt | gtgattgagg | aaaattatgg | aagcgatttt | gtttgaaatg | tatattagca | 91080 |
| gtaatagtat | gtcgtttgct | aaagacgttc | caattaccgt | agcagtaatg | attgataagg | 91140 |
| gttattgtga | cccaatgtat | ctcgtagaaa | atttcgtttc | aatgccagtt | ccagaagatg | 91200 |
| ctgaaataaa | acttaaaaag | attggtatta | ttgaaactgt | accaaatatt | ccgtttagag | 91260 |
| caattgaagc | atttactaaa | tccgaataca | ttaatgttag | cgcagaacaa | tataatgata | 91320 |
| aacctatatc | tttctattcg | tatgattcag | tatatagttg | gaaaatagat | aaaggaaata | 91380 |
| aatttataat | tgtgagtgaa | gatgctttat | catactttat | ttcttctata | tggaatagtt | 91440 |
| tacatccaaa | tttgctaaaa | attcatgaat | tcgatgatgc | tcctactgtt | gttttaggta | 91500 |
| aaacaaatga | aagttctgaa | gaaatgtttt | gaatggttca | gtagaccaaa | ctcaatgtac | 91560 |
| attgatgatg | gttgggttga | acaagcaaat | aaagaaatgc | agaacgaatc | agaagaatgg | 91620 |
| atgaaatcaa | tgattagcgt | tgagaaagaa | aagaaattag | aacgctcagc | gcttaaattg | 91680 |
| atgagagaca | tttatgggga | taaatcgtga | acagagatat | gacgctagaa | gaggctaaag | 91740 |
| ctaaagcaaa | tgaagcttta | gatttgcttc | ttaaaattgg | cagtaaaatg | atggaagaaa | 91800 |
| atgagaaata | tatccaggaa | aacaaaattc | ctgatggtcc | attagtaggc | aaaaggaaat | 91860 |
| cgcatgattg | aagtagcaaa | acattattca | atagaattta | tgtctaaaga | aggtaaatca | 91920 |
| gtaaatacac | ttgataaaaa | gtgctcatta | attattcctt | tagcagaaaa | tccggatatt | 91980 |
| ttaattaaag | atataaaaga | aagaaaatat | ccagaaaatg | ttattctaat | tataaagcat | 92040 |
| actgaagata | ttttgcagaa | tactgattca | ccgttttctt | cttctgaagc | tttaactatt | 92100 |

FIG. 17XX sequence.txt

| | | | | | | |
|---|---|---|---|---|---|---|
| aaaggctata | aaagagctca | tgaatatggt | cttttttgacc | tgtttgaaga | cgataaagtt | 92160 |
| aaattagcac | ttaatttagc | aggtcaatct | tctaaaagta | aaacattcat | tattgaagat | 92220 |
| attaaagata | taaatgcatt | tgttaagatg | gtctgggctc | attttgacgt | tggactacgc | 92280 |
| tggagaatgt | ccgaagaaga | aagaaaaatt | attgaagcta | atcgttattt | tggtttttat | 92340 |
| cgctaggaat | taatatggat | ttatttgaga | tgttagaaga | taatcattct | acgaatatcc | 92400 |
| agaatgattc | tagtgattat | aagaaagagt | accgtatagt | attacagaat | tatggaattg | 92460 |
| aagccccaga | tgctcttcta | gaagaactag | cttcatacca | tcttgaccct | ccgccctggg | 92520 |
| ctccctgggc | aaaataattc | aaaaagttgt | ttactttcct | tcctaacaat | gatatgatag | 92580 |
| cttctgaagt | atatggaggc | tatcatgatt | attaatcttg | cagatgttga | acagttatct | 92640 |
| ataaaagctg | aaagcgttga | ttttcaatat | gatatgtata | aaaaagtctg | tgaaaaattt | 92700 |
| actgactttg | aacaatcagt | tctttggcaa | tgtatggaag | ccaaaaagaa | taaagctctt | 92760 |
| catcggcagt | tgaataaaat | cattaaaaag | catttaacta | aatcacctta | tcagctatat | 92820 |
| cgtggtatat | caaaatcgac | aaaagaactc | attaaagatt | tacaagttgg | agaagtgttt | 92880 |
| tcaacgaaca | gagtagattc | atttactact | agtttgcaca | cagcgtgcgg | ttttttcttat | 92940 |
| gttgagtatt | tcactgaaat | aatatttcgc | ttaaaaactg | ataaagcttt | taattattct | 93000 |
| gaccatatca | gcgatattat | actttcttct | cctaatactg | agtttaagta | tacatatgaa | 93060 |
| gatactgatg | gattagattc | agaacgtact | gataacttaa | tgatgattgt | gcgtgaacaa | 93120 |
| gaatggatga | ttccaattgg | aaagtataaa | ataacttcta | tttcaaaaga | aaaattacac | 93180 |
| gattcatttg | gaacatttaa | agtgtatgat | attgaggtag | ttgaatgaaa | tattcagcaa | 93240 |
| tgcaattaaa | agattttaaa | atcaaatcaa | tggatgcatc | ggtgcgtgct | tctattcgtg | 93300 |
| aagaattact | ttctgaagga | tttaatttat | ctgaaattga | acttttaatt | cattgtatta | 93360 |
| ctaataagcc | agacgatcat | tcttggttaa | atgaaataat | caaatctcgt | ttggttccaa | 93420 |
| acgataaacc | tctttggaga | ggtgttccag | ttgagactaa | gcaggtgtta | aatcaaggaa | 93480 |
| ttgatattat | tacatttgat | aaagtagtat | cagcttcata | tgataaaaat | gtagagctac | 93540 |
| attttgcttc | tggattagaa | tacaacacgc | aagttatttt | tgaattcaaa | gctcctatgg | 93600 |
| tatttaattt | ccaggagtat | gctataaaag | ctctacgttg | taaagaatat | agtccgagtt | 93660 |
| ttaagttttcc | agatagccat | cgttatcgta | atatggaatt | agtttcagat | gaacaagaag | 93720 |
| taatgatacc | agctggaagt | gtatttagaa | ttgcggatag | atacgagtat | aaaaagcatt | 93780 |
| caacatacac | tatctatact | cttgactttg | aaggatttaa | tctataatgg | aaggacttag | 93840 |
| attcattata | ccatgaaagt | tttaaagcat | ttttcataaa | gttgtttaca | agctgaagta | 93900 |
| aaaatgttat | agtataagta | gttaaccgtc | cgtgagaaaa | atatgaaact | gtctaaaaat | 93960 |
| caaattcgta | aaattacacg | tcgtttagag | catactcagg | catctgctaa | aagacgttct | 94020 |

FIG. 17YY sequence.txt

| | | | | | |
|---|---|---|---|---|---|
| aaagatttta | acttagactt | caattacatt | aagaacattt | tagatcagaa | agtttgcgct | 94080 |
| tactcgggag | aacctttga | taatcgtatt | gaaggagaga | aattatcatt | agaacgtttt | 94140 |
| gataataacg | ttggatacat | taaagggaat | gttattgcag | taaagaaaaa | gtataataca | 94200 |
| tttcgttctg | attatacttt | agaagagttg | attgaaaagc | gtgatttatt | tgctttgcga | 94260 |
| attggtcgtt | catctgcgaa | aaaagttcat | aaactaaatt | tagatgaaaa | gaaatgggct | 94320 |
| aaaatcaaaa | agacttataa | tcaaattaaa | gctatacaga | aaaaacgtga | aaaccgaatt | 94380 |
| gagcacattt | ctcagctttc | taaatcaaaa | caaacttctg | acgttaagct | aacgattata | 94440 |
| gcacttaaag | ctcgtattga | tggttctcgt | atagcagaag | gcgctgaagt | tgttaaattg | 94500 |
| aacgttcttc | ttaaaggctc | ggattggaaa | actgtgaaaa | agctgtcaga | agcagaaatg | 94560 |
| caatatgata | tgtgtgataa | aattattcaa | ggtgtagagc | ggtatcaaaa | cttgtctttt | 94620 |
| attgataaac | ttaaactgaa | aagaggatac | ccgctaaatt | gttcaatttt | taaacttatc | 94680 |
| cgaggataat | atgttttatg | tatatgcgat | agtgtataga | gataaagatg | gatttgcggt | 94740 |
| gcctgttcct | cttgatgaac | atcgccctgc | tgtattttt | gaaagggaga | ttgctgataa | 94800 |
| agtatttaca | actcttaaag | agcagtatca | actagcttta | ggtatgggaa | ttccgagatt | 94860 |
| agttgagact | ccacgcaagt | tttggtttaa | taaatagaa | gttaaacatg | ttaagcctga | 94920 |
| tgtagacacg | caaagattat | atcggcgaat | tttagatact | gggcgtattg | ttagtatacc | 94980 |
| aattgcaggg | aatttacgat | gacatttgat | gatttgacag | aaggccagaa | aaatgccttt | 95040 |
| aacatcgtta | tgagggctat | caaagaaaag | aaacatcatg | taactattaa | tggacctgcc | 95100 |
| ggtactggta | aaactactct | tactaagttc | atcattgaag | ctttaatatc | tacgggcgaa | 95160 |
| actggcatta | ttttagcagc | tcctacacat | gcagctaaaa | agattctttc | aaaactgtca | 95220 |
| gggaaagaag | cgagtactat | tcatagtatt | cttaaaatta | accccgtaac | atacgaagaa | 95280 |
| aacgttcttt | ttgaacaaaa | agaagtaccg | gatttagcca | aatgtagagt | attaatctgc | 95340 |
| gacgaagtgt | caatgtatga | tagaaagcta | tttaaaattc | tgctttcaac | tatcccgcca | 95400 |
| tggtgtacta | taattggaat | aggcgataat | aagcaaatta | gacctgttga | cccagggga | 95460 |
| aacactgctt | atatcagtcc | attctttaca | cataaagatt | tttatcagtg | tgaactcact | 95520 |
| gaagttaaac | gcagtaatgc | tcctattatt | gatgtagcta | ctgatgttcg | caacggtaag | 95580 |
| tggatttatg | ataaagttgt | tgacggacat | ggagtacgtg | gatttactgg | tgataccgct | 95640 |
| ttacgcgatt | ttatggtaaa | ttattttca | atcgttaaat | cactagatga | tttgtttgaa | 95700 |
| aatcgcgtaa | tggcatttac | gaataaatct | gttgataagt | taaatagcat | tattcgtaaa | 95760 |
| aagattttg | aaactgataa | agattttatt | gtcggtgaaa | ttattgtaat | gcaggaaccg | 95820 |
| ttaattaaaa | catataaaat | tgatggaaag | cctgtgtcag | aaattatttt | taataacgga | 95880 |

FIG. 17ZZ sequence.txt

| | | | | | | |
|---|---|---|---|---|---|---|
| caattagttc | gtattataga | agcagaatat | acatcaacat | ttgttaaagc | tcgtggcgtt | 95940 |
| cctggagaat | atctaattcg | tcattgggat | ttaacagtag | aaacttacgg | cgatgatgaa | 96000 |
| tattatcgtg | aaaagattaa | aataatttca | tctgatgaag | agctgtataa | gtttaactta | 96060 |
| tttttaggta | aaacagcaga | aacttataaa | aactggaata | agggtggaaa | agctccatgg | 96120 |
| agtgattttt | gggatgctaa | atcacagttt | agtaaagtga | aagcacttcc | tgcatcaaca | 96180 |
| ttccataaag | cgcagggtat | gtctgtagac | cgtgctttca | tctatacacc | ttgtattcat | 96240 |
| tatgcagatg | ctgaattggc | tcaacaactt | ctttatgttg | gtgttacccg | tggtcgttat | 96300 |
| gacgtatttt | atgtgtgagg | atatatgatt | aacatcaatt | caaatatttt | aaatcgtcta | 96360 |
| atagatggta | taaggaagca | tactaataag | caagataatc | tcgatgttat | ggtaacagga | 96420 |
| gctgagctcc | ttcataagct | ttatcttata | agtgatacta | tattagcaat | taaacgaatt | 96480 |
| gaaaaacaat | catatcacag | taatacagat | acggtaatta | cactagatga | aagtgtctgt | 96540 |
| aaattactaa | ttaaatttga | ggaagctatt | cgtggaaata | actaaagacc | agttttatct | 96600 |
| gcttcaagat | aaagtgagcg | aaatttatga | aatagcttat | agtaaaaatc | gtgaaactgt | 96660 |
| aaaaattgaa | tctagtaagt | tgatgcttca | attagaagaa | attgaacgag | atttaattgc | 96720 |
| gttagaattc | ttttgtggtg | aagtgaaaac | tgtcacaatc | agtgattatg | ttttaggtga | 96780 |
| aattagctat | ctttataagg | cgattattaa | tgattgaatt | aagttggtgt | cagtttaaat | 96840 |
| ctcttatgac | aaatgttaaa | gctgtcattg | agaaaaattc | tggtcctgaa | aatattacta | 96900 |
| ttcgcgaaaa | agcttaaaag | ataatataca | gtcttgaaga | gatgcaaaaa | gatattgaat | 96960 |
| ctatggcaaa | atttattgat | gaacctatta | ataaagttta | tattcaagac | tatactgtag | 97020 |
| gccaaattcg | cgatttagcg | aggaaaattt | aatgtttgat | tttattatag | attttgaaac | 97080 |
| aatgggaagt | ggtgaaaaag | cagctgttat | tgatttagct | gtaattgctt | ttgaccctaa | 97140 |
| cccagaagta | gttgaaacat | ttgatgaatt | agtttcacgc | ggcattaaaa | tcaaatttga | 97200 |
| tttaaaaagc | caaaaaggac | atcgtctttt | tactaaaagc | actatcgaat | ggtggaaaaa | 97260 |
| tcagtctcct | gaagctcgaa | aaaatattgc | accgtccgat | gaagatgtaa | gcactatcga | 97320 |
| cggtattgcg | aaatttaatg | attacatcaa | tgcacataat | atcgatcctt | ggaaatctca | 97380 |
| aggctggtgc | cgtggaatgt | cgtttgattt | tccaatttta | gtcgatctca | ttcgtgatat | 97440 |
| tcaacgtctt | aatggtgttt | ctgagaatga | acttgacaca | tttaagttag | aaccatgtaa | 97500 |
| attctggaat | cagcgtgata | ttcgtaccag | aattgaagca | cttctgcttg | ttcgtgatat | 97560 |
| gaccacgtgt | cctcttccaa | aaggaacttt | agatggattc | gttgcgcatg | attctattca | 97620 |
| tgactgcgcg | aaagacatcc | tgatgatgaa | gtacgctttg | cgatatgcta | tgggtcttga | 97680 |
| agatgctcca | tcagaggaag | attgcgatcc | tctatctctt | ccaacaaaac | gataaaaagt | 97740 |
| tgtttacttc | ctcggttagt | tgtggtatta | taacaccata | gctactgagg | ataataaaat | 97800 |

FIG. 17AAA sequence.txt

| | | | | | |
|---|---|---|---|---|---|
| gaaaatttat | cgtgttgaat | catcgtttag | tattcttgat | tatgaagatg | ctataacaat | 97860 |
| acgtcgaaat | ctttgtgttc | aaataacgcc | gtacaggagt | ataatagatt | catggagcga | 97920 |
| agagtggcta | ttacacgtag | gttatgacag | acctaattt | atgcatcata | gcgataataa | 97980 |
| taaaagaatt | cctttaccac | acgaagataa | actattagtt | aaaaacgcta | atatagtaat | 98040 |
| taatactaag | ttcaagaaag | attatgttgg | agtagaatat | catattccag | gatggtttat | 98100 |
| agctctttat | cattttgctt | tcgctagcga | atatgatatg | atgagatggt | tcacacgaga | 98160 |
| agagcgtgaa | gaattagctt | cgaaaggatt | ttatcttgct | gtatacgaag | taccagatga | 98220 |
| ccaagttatc | gttggcgggc | atcaagtaat | gttccgtaaa | tcccatgctg | aacttgtaga | 98280 |
| ttttattgaa | atgagataat | tatgaaattt | aattataatc | ctgaatacac | accgaatccg | 98340 |
| gcagctaaac | tgattgattt | tgacgttgta | agtacttatg | tatgccctgt | taaaccactg | 98400 |
| gaaattaagg | aacctactat | gactaccgct | attgaaatcg | gcaaaaccta | caaactggtt | 98460 |
| gaacctaaaa | ttaaaactaa | tgccttgatt | tctggtcata | aaactctgac | tgatgttttt | 98520 |
| ggcgaaggcg | aatttattgt | tgaagaattt | gccaaaagtg | agtggtttga | caaatcttac | 98580 |
| gtcatccacg | gtcgccggtt | agataataac | aaaataaaga | aaaacctggt | ttatgaagat | 98640 |
| gagttcatcc | tgttccaaga | agttgaagaa | caagacccta | cagacctgtt | gtgtgctgct | 98700 |
| gtgtctatcc | gtcgtccttt | tgataatcct | atctgtggtt | gggtaacaga | ccagtggatt | 98760 |
| gaagatggtg | ttgagcttct | gaacgttgtc | catgcaggag | attttagtgt | agtacctcgt | 98820 |
| agtgcggtgg | tagctatttt | gaattaatag | tttacaaact | cttgggacca | gagtataatg | 98880 |
| gtcctgtgga | gtataaaatc | ttttttaacaa | gtgagagata | actatgatta | ttaatattgg | 98940 |
| tgaaattgct | cgtgtatctg | ataaatcccg | ttctaaagca | gcaggaaaat | tggtcgaagt | 99000 |
| tgtaagcatt | cagcttaaac | acggtgttaa | agatgaagat | tctgaagtaa | aagtacgtat | 99060 |
| cattgctaaa | gatggaatgt | ctaagcccca | gtttggttat | gttcgatgga | aatttcttga | 99120 |
| gcctgcgttt | ttgaaagctg | ttcctgctaa | aggaattgaa | acgattgata | cttcgcatgt | 99180 |
| aggtgtagac | tttaagtgga | aactcggtca | agctatcaag | ttcattgctc | cttgtgaatt | 99240 |
| taaatttatc | aaagatgatg | gaaaggctgt | ttatactcgc | gctatgtgtg | gatacattac | 99300 |
| cgatcaatgg | gtagaagatg | gcgttaagtt | gtacaacgtg | gtatttttag | gaacatataa | 99360 |
| agtcattcct | gaaagttgga | ttaaacacta | cagcaatgct | ctctatgcat | aaagtttaaa | 99420 |
| atttttcat | aaactatat | acatcagtag | ttgattatgg | tactatatca | atatcaacta | 99480 |
| ctgatacaga | aaacaacttg | gagaataaaa | tggataattc | gttaaaggtg | cgctgatact | 99540 |
| cttctgaaac | gcatcgctcc | aatgttcaat | taatgaggaa | attatgatga | aacgtaaaat | 99600 |
| tgttcagaat | tgcactaatg | atgaatttga | agatgtatta | ttcgatccag | atttggtagt | 99660 |

FIG. 17BBB

```
                                   sequence.txt
agttcaaaag gaacacacta tcaagtttac tcacttgact tcggtttatg tgtatgaaaa    99720
ggttggggat aaacaaccaa tttacggtgt atttcgtgaa atcactgaag atggtacaac    99780
ttactggaag gaaatttatt aatggctatt aaatttgaag ttaataaatg gtatcaattt    99840
aaaaataaac aagctcaaga aaatttttatt aaagaccata ctgataacgg aatctatgca   99900
cgccgtttag gtatgcatcc ttttaaaatt ttagatgtgg atgctcttgg gcgtcctatt    99960
aaaattatgt catttgctgg aaatttagta ctatcttctg gtaaagatat tttggatgaa   100020
gattttattt ggctttcatc gaatgaagct gaattcttta atgaagttga aaatccatac   100080
caggcagctg aagagcagga agaatctgca ccgataactg atcaatctaa attccctgta   100140
atgaaagtta ctattgaaaa tgatgaacag gcatggtcct tgtatcagat gttgaaagct   100200
cactttaagg aataattatg ccgctttatg attataaatg tcaatcaaaa gactgcgcaa   100260
aagaatacga aaaaatcaag aaaatttctg aaagagatac tgatgtatgt cctgattgtc   100320
atcggattgc tattcggtta gtctctgccc ctaagcatgt gaatggcgga ttttacgact   100380
tacttaaagg gtaattatgt ttaaaatcgg taagaaatat cgcattcgcg aaggtgaaga   100440
aaagaaatat ctattttctg ctatttatag gaatggttct attaatgctg taatatctac   100500
aagcgaattt atcgttgaag atatgaaagg taataatgtt acaatgatta gtacagcatc   100560
tggaaatgac ggaaaaattc ttcacagttt tcagagtaat gttctaattt atgatgaaga   100620
atttgacttc ttcgaagaag ttcccgaagg ttttgctttt gaatgcacta tcactatgaa   100680
atctggtgac cctctttctt ttacagttaa agatgaagga agtcgcttga gaattattag   100740
tcttcttcaa gccattaaat ttaagtgaaa attatgaaat atattaatcg ttctatcgcg   100800
gcattagtat tagcagtgtc tttagtagga tgtactgatg ctgataatgc aaccaaagtt   100860
ttgtcttcaa gcggttttac taatattgaa atcactggat ataactggtt cggttgttct   100920
gaaaatgatt tccaacatac tggatttcgt gctattggac ctactgggca gaaagtagaa   100980
ggaacagtat gttctgggct gttctttaag gattcaacta ttcgttttaa ataaaaggcc   101040
ttcgggcctt tagctttatg attaccggag tataatattc ccgaaaccaa acgaggataa   101100
gtgatgatta agaatgaaat taaaattctg agcgatattg aacatatcaa aaagcgtagc   101160
ggcatgtata ttggctcttc tgctaatgaa atgcatgagc gctttctgtt tggtaaatgg   101220
gaaagtgttc agtatgtacc tggtcttgtt aagcttattg atgaaattat cgataactca   101280
gtagatgaag gtattcgtac taagtttaaa ttcgcaaata aaattaatgt tactattaaa   101340
aacaatcaag taacagttga agataacggt cgcggtattc cacaagcgat ggttaaaaca   101400
cctactggtg aagaaattcc tggtccagtt gctgcgtgga ctattccaaa agcaggtggt   101460
aactttggtg atgataaaga acgcgtcacc ggtggtatga atggtgttgg ttctagttta   101520
actaacattt tttctgtgat gtttgtcggt gaaactggcg atggtcaaaa taatattgta   101580
```

FIG. 17CCC sequence.txt

| | | | | | |
|---|---|---|---|---|---|
| gttcgttgtt | caaatggcat | ggaaaataaa | tcatgggaaa | ctattcctgg | aaaatggaaa | 101640 |
| ggaactcgtg | ttactttcat | tccagatttt | atgtcatttg | aaactaatga | attatctcaa | 101700 |
| gtttatcttg | acattacatt | agatcgtctc | cagacacttg | ctgttgttta | tcctgatatt | 101760 |
| caatttacct | ttaatggtaa | aaaggttcag | ggcaattta | agaaatatgc | acgccaatat | 101820 |
| gatgagcatg | ctatcgttca | agaacaagaa | aactgttcta | ttgcagttgg | tcgttcaccg | 101880 |
| gatggttttc | gtcaattaac | atacgttaat | aacattcata | ctaagaatgg | tggccatcac | 101940 |
| attgactgtg | ttatggatga | tatttgtgaa | gaccttattc | cacaaatcaa | acgtaagttc | 102000 |
| aaaattgatg | tgactaaagc | acgcgttaaa | gaatgtttga | caatcgttat | gtttgttcgt | 102060 |
| gatatgaaaa | acatgcgatt | tgattctcaa | actaaagagc | gtttgacttc | tccatttggt | 102120 |
| gaaatccgta | gtcatattca | gcttgatgct | aaaaagattt | cacgtgctat | tttgaataat | 102180 |
| gaagcaattc | tgatgccaat | tattgaagct | gctttggctc | gtaaattggc | ggcagaaaaa | 102240 |
| gcagcagaaa | ctaaagcagc | taaaaaggca | tctaaagcta | aggttcataa | acatatcaaa | 102300 |
| gcgaatcttt | gtggtaaaga | tgctgatact | acattgttct | tgactgaggg | tgattctgct | 102360 |
| atcggatatc | ttattgatgt | tcgtaataaa | gaacttcatg | gtggttatcc | attacgtggt | 102420 |
| aaagttctca | acagttgggg | tatgtcatat | gctgacatgc | ttaaaaacaa | agaactgttt | 102480 |
| gatatttgcg | caatcactgg | attagttctc | ggtgaaaaag | ctgaaaactt | gaattatcat | 102540 |
| aatattgcta | ttatgactga | tgctgaccat | gatggtctag | gaagcattta | tccttctctg | 102600 |
| cttggatttt | ttagtaattg | gccagaactg | tttgagcaag | gaagaattcg | cttcgtcaaa | 102660 |
| actcctgtaa | tcatcgctca | ggtcggtaaa | aaacaagaat | ggttttatac | agtcgctgaa | 102720 |
| tatgagagtg | ccaaagatgc | tctacctaaa | catagcatcc | gttatattaa | aggacttggc | 102780 |
| tctttggaaa | aatctgaata | tcgtgagatg | attcaaaacc | cagtatatga | tgttgttaaa | 102840 |
| cttcctgaga | actggaaaga | gcttttgaa | atgctcatgg | gagataatgc | tgaccttcgt | 102900 |
| aaagaatgga | tgagccagta | gtttacttta | ccacaaggat | gtggtataat | taattgggca | 102960 |
| aatgaggata | ttgaaatgaa | atcatataaa | gtaaatttag | aactttttga | taaagcagtt | 103020 |
| catcgagaat | atagaatcat | tcaacgcttt | ttcgatatgg | gagaagctga | agagtttaaa | 103080 |
| aaccgcttta | aggatattag | agataaaatt | caatccgaca | ccgcaactaa | agatgaacta | 103140 |
| ctagaagttg | ctgaagttat | taaacgcaat | atgaattaat | gaggaaatta | tgattatcac | 103200 |
| cactgaaaaa | gaaacaattc | ttggtaatgg | ttctaaatca | aaagcattta | gcatcacagc | 103260 |
| atctcctaaa | gtatttaaaa | ttctatcatc | tgatttgtac | acaaacaaga | ttcgcgcagt | 103320 |
| agtccgtgaa | ttgattacca | acatgattga | tgcccatgct | ctcaatggaa | atcctgaaaa | 103380 |
| atttatcatt | caagttcctg | gacgtttaga | cccacgattt | gtttgtcgag | attttggtcc | 103440 |

FIG. 17DDD sequence.txt

```
gggtatgagt gattttgata ttcagggtga tgataattct cctgggttgt ataattcata   103500
cttcagttca tctaaagctg aatctaatga ctttattggc ggatttggtt taggttctaa   103560
atctccgttt agttatactg atacgtttag tattacttcg tatcataaag gtgaaattcg   103620
tggttatgta gcttacatgg atggtgatgg cccacagatt aaacctacat tcgtaaaaga   103680
aatgggtcca gatgataaaa ctggtattga aatcgtagtt ccagttgaag aaaaagactt   103740
tagaaacttt gcttatgaag tttcttatat catgcgacca ttcaaagatt tggctatcat   103800
taatggtctt gaccgcgaaa ttgattattt tccggatttt gatgattatt acggcataaa   103860
tccagaaaga tactggcctg atcgtggtgg attatatgct atctatggcg gtattgttta   103920
tcctatcgat ggtgttatta agaccgtaa ctggctaagc attcgtaatg aagtgaatta   103980
cattaagttt ccaatggggtt cgcttgatat tgctccatca cgcgaagctc tttcactaga   104040
tgatcgtact cgtaaaaata ttattgaacg agttaaagaa ctcagtgaga aagcatttaa   104100
tgaagatgta aaacgattta agaatctac atctcctcgt cacacatatc gtgaattgat   104160
gaagatggga tattctgctc gagattatat gattagtaat tcagtcaaat tcacgactaa   104220
aaatctgtca tataaaaga tgcagagcat gtttgaacct gacaataagt tatgtaatgc   104280
aggagttgtg tatgaagtaa atcttgatcc tcgactgaag cgcattaagc aaagtcatga   104340
aacttcagcc gttgcatcaa gttatcgtct gtttggtatt aatacaacaa aaattaatat   104400
cgttattgat aatattaaaa atcgtgttaa tattgttcgt ggattagcac gagcgttaga   104460
tgatagtgaa tttaataaca ctttgaatat tcatcataat gagcgtcttc tgtttattaa   104520
tccagaagta gaatcgcaga ttgatttgct tcctgatatt atggcgatgt ttgaaagtga   104580
tgaagttaac attcattatt tgtcagaaat tgaagcttta gttaaaagct atattccaaa   104640
ggtagttaaa agtaaagctc ctcgtcctaa agctgctaca gcatttaagt ttgaaattaa   104700
agacgggcgc tgggaaaaag aggaattatt tacgctcaca tcagaagcag atgaaattac   104760
tgggtatgta gcgtatatgc atcgttctga tattttctct atggatggta ctacatctct   104820
ttgtcatcca tctatgaata ttttgattcg tatggctaat cttattggca ttaatgagtt   104880
ttatgttatt cgtccgcttt tgcagaaaaa ggtaaaagaa ctcggtcagt gccaatgtat   104940
ttttgaaact ctgcgtgatt tatatgtaga tgcttttgat gatgtagatt atgataagta   105000
tgtaggttat tcaagttcag ctaaacgata tattgataaa attattaagt atcctgaact   105060
agattttatg atgaagtact tcagtgtaga tgaagtttct gaagaatata cacgactcgc   105120
taatatggtt agttcattac agggtgtata tttcaacggt ggaaaagata ccatcggtca   105180
tgacatctgg acagtaacta atcttttga tgaattatca cgtaatgctt caaaaaacag   105240
tgataaaatg gttgctgagt ttaccaagaa attccgtatt gtttccgact tcatcggata   105300
tcgcaactct ttaagtgatg atgaagtttc ccaaatcgct aaaactatga aggcccttgc   105360
```

FIG. 17EEE sequence.txt

| | | | | | |
|---|---|---|---|---|---|
| ggcctaataa | ggaaaattat | gtacaatatt | aaatgcctga | ccaaaaacga | acaagctgaa | 105420
| attgttaaac | tgtattcaag | tggtaattac | acccagcagg | aattggctga | ttggcaaggt | 105480
| gtatcggttg | acacaatccg | tcgtgttttg | aaaaatgctg | aagaagcaga | acgctctaaa | 105540
| gttactatta | gcggtgacat | tacagttaaa | gttaatagcg | atgcagttat | tgctccagtt | 105600
| gctaaatctg | acattatttg | gaatgcatct | aaaaaattca | tttcaattac | tgttgacggt | 105660
| gtaacttata | acgcaactcc | taatactcat | tcaaacttcc | aggaaattct | taatctgctt | 105720
| gtagcggata | agttggaaga | agcggcacaa | aaaattaatg | ttcgtcgcgc | tgttgaaaaa | 105780
| tatatttccg | gcgatgttcg | aattgaaggt | ggaagcttat | tctatcaaaa | tattgaattg | 105840
| cggtctggtt | tggttgatcg | tattcttgat | tcgatggaaa | aaggcgaaaa | ctttgaattt | 105900
| tattttccgt | tcttggaaaa | tctgctggaa | aacccaagcc | agaaagcggt | atctcgactc | 105960
| tttgatttct | tggtagcaaa | cgatattgaa | attacagaag | atggttactt | ctatgcttgg | 106020
| aaagtagttc | gtagcaatta | ctttgattgt | cactcaaaca | cttttgataa | cagtcctggt | 106080
| aaagtagtta | aaatgccgcg | tactcgtgtg | aatgacgatg | atacgcaaac | ttgttcccgc | 106140
| ggtttgcatg | tatgttctaa | atcttatatt | cgtcactttg | gcagttcaac | cagccgagtc | 106200
| gtaaaagtta | aagtacatcc | gcgtgatgta | gtatcaattc | cgattgatta | caacgatgct | 106260
| aaaatgcgta | cctgccaata | cgaagtagtt | gaagacgtta | ctgaacaatt | taaataaggg | 106320
| cttcggccct | taactaagga | aaattatgtt | aggttatcaa | gcacgagtaa | aagaagaata | 106380
| cgatcaatta | atgctcaaaa | ttaatgcact | tagcaatttt | ttagaaagca | caaagtttct | 106440
| aacggttagt | gcagttgagc | aagaattgct | actttcgcag | tttatctcaa | tgaaatctta | 106500
| cgcagattgt | ttagaaaaaa | gaattgcaca | attcaaataa | aataagggct | tcggcccttt | 106560
| tgttttaagg | gaaattatga | ttccgacata | aaggaaagtt | taaatgcaga | aaacgaatcc | 106620
| gggtttgcag | agactatttc | agattccgtc | atttacccta | tcgaacagtg | acttgactag | 106680
| tgaaatgaag | gtcaaaattg | ctgatactgc | aagatactct | ttaaaacaaa | acccgaacca | 106740
| ggataaagca | gaagttatcg | aaagatgtcg | tatcgctgtg | tacgcagagt | ttttttgtggc | 106800
| agattggcta | agagggtatg | ttaacaaagg | ccaagaggat | gttaatgacc | cgtatacata | 106860
| cgcatgggat | gtactggcgc | atccaaaata | ctgcgggctt | cgtgtagaag | ttaagacaca | 106920
| tcaaactgac | tcacgttgga | tttcggtaac | aacaggatgc | agcggagagt | atccatatgg | 106980
| ttctggaata | aatctagggc | ccattctaaa | tcatcaagtc | gctgactgta | taattatatt | 107040
| caacactaaa | gaaattcatc | caggtgtcat | ccagtacact | ccgaagttca | tcggtgacag | 107100
| agaagacctt | cgtaaggttg | taagaaaaag | caactacaat | ggatggtatc | tttccattta | 107160
| aaaattttca | caaaacggtt | tacataccac | aaggactgtg | gtactataca | actatcagct | 107220

FIG. 17FFF

```
                              sequence.txt
acggaggagt aaaaatgaaa tttaaatttt attacgctaa acataaaatt accggtgaat    107280
ttattgcatt tacgacttca actacagatg aaggagatat ttttactgca gtatttttat    107340
caaaatggga atcagatcaa ccttacttat catcacgtga agatctccaa cgattagtta    107400
atggagaata taatgattca tggtcatatt tagtccatga ttgtgttaaa aaggcaataa    107460
aacaaaaaca cttggaaatc gttgagattg aactatgagt tcattatggt ggtgtttcgt    107520
ttggttaatt agtattccat taatttgttt aacatttact tttgtgatga ggttattatg    107580
aaaattttga attctgtgct tattgcttgt gcgtggtggg ttgcgcaagt ttcagcagta    107640
gtagttggta ttcacattta ttacgaatat ttttaaaaaa gttgtttaca agactgttct    107700
tccgtggtat tattacccta tcaactacgg aggaacagaa aatgaaaaag attgttaaag    107760
ctatatggaa tgtagttata atactaatag ttttgagtat attcccaatc gttttaatga    107820
ttgatgtatt aaacgcttac tttggattta tgtgaggaaa atatgaagcg taaacgcagt    107880
gcttttacat ttattgaatg gttttcgat aatatttttc cggctttatt cattttcatg     107940
ctgatttttg ctttaggttc agttgtagtt ggaatctatt tgatgacagt agtcggaatt    108000
gatattcatc aaaatggttt aaaatccgta gttgaaacaa tttggaacgg tgtaaaatga    108060
tgaatttgct gagcggttgg ttttatattc ttatgtttta cattggcgca aattttccat    108120
attggatggg atggtcaaca actgcgtttg gattttatac tccttgaggt gaattatgaa    108180
aatctttaaa gatgtaaaag ttggtgaaat tttctgttta gataacggtg atcagttaat    108240
tcgtatttca cctcttaaga gcactagcga gaaaccgaca gttaacgcta ctttagcaaa    108300
caatagtaat gaacgtttct gtattgaaaa tgatactgaa acttataccg tagaagagtt    108360
ttgggaattg agcgtcgact gcgacgatta atttaatggc cgtgtgtatt catgcggcct    108420
tggagtagaa ataatttag aggaaattaa tatgaaatac atgactgtta ctgatctgaa     108480
taatgcaggc gctaccgtta ttggtacaat caagaacggt gaatggtttt tgggagttcc    108540
acataaagat attttatcta aacctggatt ttactttta gtaagtaaat tagatggtcg     108600
tccatttagt aatccatgtg tgtctgcacg attttatgta ggtaatcagc gttctaagca    108660
aggatttagt gcggttctaa gtcatattcg tcaacgtcgg tctcagcttg cgcgtactat    108720
tgcaaataac aatgttccat acacagtatt ttatctgcct gcttctaaga tgaaacctct    108780
gactacggga tttggaaaag gtcagttagc tttggcgttt attcgtaatc atcattctga    108840
gtatcaaaca cttgaagaaa tgaaccgtat gttggctgat aactttaaat tcgttttgca    108900
ggcatattaa tgagtaattt ccacaacgaa catgtgatgc agttctatcg taataatttt    108960
aaaactaaag gcgtcttcgg acgccagtga ggaaaatatg aatattgcaa aattattagg    109020
agttatttca tttatttgtt ggatagtagc atgtgtttta actatctgta ttgatgtcag    109080
cagtgtgttt tcgcaagctt tagctcaggg tatgtgtgca tatttaacat ttgtgttgtt    109140
```

FIG. 17GGG sequence.txt

| | | | | | |
|---|---|---|---|---|---|
| atctactaat | gattaagaaa | atcttgggct | attcattagc | ccttgctatt | ttattgatag | 109200 |
| cattatatta | cggaataatg | ttcggattaa | ttcaagtcgt | gcttttcatt | tctgatgtta | 109260 |
| ttatggcact | acattcacta | gtatggtaaa | tttatgcaac | tgaataatcg | tgatttaaaa | 109320 |
| agtatcattg | ataatgaagc | attggcttat | gctatgtaca | cggttgaaaa | tcgtgccatt | 109380 |
| ccaaatatga | ttgacggatt | taagccagtt | caacgatttg | ttattgctcg | agctcttgat | 109440 |
| ttggcacgag | gaaataaaga | taagtttcac | aaactcgctt | ctatcgcagg | cggtgtagcg | 109500 |
| gaccttggat | atcatcatgg | tgaaaactct | gcgcaagacg | caggtgcttt | gatggctaac | 109560 |
| acttggaata | ataactttcc | tctgttagac | ggtcaaggaa | actttggttc | tcgtactgtc | 109620 |
| caaaaggcag | cagcaagtcg | ttatattttt | gctcgtgtaa | gtaaaaattt | ctataacgta | 109680 |
| tataaagata | ctgaatatgc | tccagtacat | caagataaag | aacacattcc | gcctgctttc | 109740 |
| tatttgccta | ttattcctac | tgttcttctt | aatggcgttt | ccggtattgc | aactggttat | 109800 |
| gcaacttaca | ttcttcctca | tagtgtttct | tctgtcaaga | aagctgtact | gcaagctctt | 109860 |
| caaggaaaga | aagtaactaa | accgaaggta | gaattcccag | aatttcgtgg | tgaagtcgtt | 109920 |
| gaaattgatg | ggcaatatga | aattcgtgga | acatataagt | ttacttcacg | aactcaaatg | 109980 |
| catatcactg | agattccata | taagtatgat | cgtgaaactt | atgtgagtaa | aatcttagac | 110040 |
| ccgcttgaag | ataaaggctt | cattacatgg | gatgatgctt | gtggtgagca | tggctttggc | 110100 |
| ttcaaagtta | aattccgaaa | agaatactct | ttgagcgata | atgaagaaga | acgccatgca | 110160 |
| aaaattatga | aagacttcgg | gttgattgag | cgtcgttccc | agaatattac | cgtcattaat | 110220 |
| gagaaaggaa | agctgcaagt | ttacgataat | gtagttgatt | taatcaaaga | cttcgttgaa | 110280 |
| gttcgtaaaa | cttatgtcca | aaaacgaatt | gataacaaaa | tcaaagaaac | tgaatcagca | 110340 |
| tttcgtttag | cttttgccaa | ggcacatttc | attaagaaag | taatttcagg | tgaaattgtt | 110400 |
| gtacaaggta | aaactcgcaa | agaactgacc | gaagaacttt | ctaaaattga | tatgtattct | 110460 |
| tcttatgttg | ataaactagt | tggaatgaac | attttcata | tgacttccga | cgaagcaaag | 110520 |
| aaacttgctg | aagaagctaa | agccaaaaaa | gaagaaacg | aatattggaa | aactactgat | 110580 |
| gtagttacag | aatacaccaa | agatttagag | gaaatcaaat | gagtccattc | attggtatca | 110640 |
| caagcgctgc | attagtatct | ggtggcattt | tactggcggg | tttaggtgtt | gttcctgccg | 110700 |
| tagcaggagg | tcttcttgcg | ttcggaattc | aacgtgttat | catgacagtt | atcacagtca | 110760 |
| tgcagtaatt | ttagggagag | cctcggctct | ccctttttat | ttcaaaaatt | ttttcacaaa | 110820 |
| acggtttaca | accaaagcat | actgtggtac | tatacaacta | tcaaataaat | gaactgaaac | 110880 |
| aaacaacccg | gagatacaaa | aatgaaaatt | taaaatcgaa | aacgaaatcg | ttaaagctaa | 110940 |
| aaatgctctg | actgctaaca | aactggttgt | agatggtatt | gaatatgata | tctgtggagt | 111000 |

FIG. 17HHH

```
                              sequence.txt
tcgtgaagaa aaacctggtg ttctgacttt cttcacaatg attttttaaat ttaaaggtga    111060
cacagaattc aaacagtttg attttgccca tgaagacgaa atcgaagttc gtaatctgaa    111120
cattaagtaa gtactttatt agagctcttg aaaaagagtg caaaaaagtg tttacttctg    111180
ctttaaacat gatactatag acctatcaaa taaatgaact gaaacggaga ttaaaatgtc    111240
taaagtaact tacatcatca aagcttctaa cgatgttctg aatgaaaaaa ctgctgcgat    111300
tttaattacc attgctaaga aagatttcat tacagccgca gaagttcgtg aggtgcatcc    111360
agatttaggt aacgcagtag ttaatagtaa tattggggta ttgattaaaa aaggcctggt    111420
ggagaaatct ggtgatggat taatcattac tggtgaagct caagatatta tttcaaacgc    111480
agcaacttta tacgcgcagg aaaatgctcc ggaactactg aaaaaacgtg ctactcgtaa    111540
agctcgtgag attacttctg atatggaaga agataaagac ctcatgttaa aactttttaga    111600
tgaaaatgga tttgttctta aaaaggttga aacttatcgt agtaattatc ttgccatttt    111660
agaaaaacgc actcacggaa ttcgtaatttt tgaaattaac aataatggaa atatgcgaat    111720
ttttggatac aaaatgatgg aacatcatat tcagaaattt actgatatcg gaatgtcatg    111780
taaaatcgct aaaaacggta atgtgtatct tgacattaaa cgctcggcag aaaacattga    111840
agctgtaatc actgtagcat ctgaactgtg aggaataaat aatgaacaag ttagaaattg    111900
tcaatgaact tcgtcgttgt gtagaaccta ctcaagaggg ttgggacatc tggtaccatg    111960
gagcttatct tggaactatc gtaaagatta agactggtaa atacatgatt attcgtgaaa    112020
gtaaagatgc tccagtaggt attcgcaata attttatggc agcgataagt tcatttacag    112080
atgcagctta cgaaatttac cttgccgatt ataaagaatt ccaggaatct caaccggtta    112140
ttcgttcaat tggtgttaac aaagctcagc agaaaacttt gtggcagcgt attaaaggat    112200
ggtttaaatg aacccattta ttaatcgttt aaaaatgctg aatgttcctt tatctcgtga    112260
aactccagaa agtcttgttg aaaaatttaa agcgcatggt tataaatgca cagaagaaga    112320
tattctgaaa gaagttcctg aaatctgttg gcagactgcg tactgggatg aaaaccaaaa    112380
gtatcaacga cgaattgtct gcgcagctaa tcgttttaaa ttaaaagatg gacgaactct    112440
tattattcca ggtgctcgtc attattctaa agatatggca gaagttttag atgtagttaa    112500
acctcaatta gttactcaac aagtttgtga tgatgaccaa ggatttattg accaatatag    112560
taattattgg acacgtgaag aagcaatgat tattgcaact tacgccggac aagtacgtat    112620
tgaacgtggt ggtagtgaaa aagaacttta ctctgaggac ctttactaat gaatattaaa    112680
aagtttcaaa ttgatggaat tacgaatcaa attaaggcat ggaatatgc caataaaatg    112740
atgtcaacta attggggaat ttatgcgaat gagccagcat ttaaattttg tgatatggaa    112800
tttaccaaaa agcttgtagg aaaagatcat gtatgcccat ttagttctcc ggtaaatgga    112860
atgctaaaac ctgctttacg cgatctttat attgcgatga cgaagaaat gataaaagag    112920
```

FIG. 17III sequence.txt

```
ctaaaacgtc aactgaaggt gattcaattt ggccagggaa attaattcaa aatcagatta    112980
ttttaactct ctcaatgata aagataaaaa tctaatacgg cattttattg ttgagatggg    113040
ataccgat acacacgatt taagagaaca tatatttgaa tgtggtgtag ctaaaaagtt      113100
ttcattcacg tgcaaatgtt taagagaggt aattcaacac tatgaacaat ttagtcgcaa    113160
aacataattt taataaagct tctgtccata aagataagaa gaaagcgttt aaagaatcta    113220
atcgcaaaca gaaacataag gggaaggtct atgattattg attctcaatc tgtagttcaa    113280
tatacaatca aaattgatat tctagaaaag ctatataagt ttctaccaaa tttataccac    113340
tcaattgtta atgaattagt tgaagaactg catcttggga ataatgattt cttgattgga    113400
acttataaag acctctcaaa agcaggatat ttttacataa ttccagctcc aggaaaaagt    113460
attgatgatg tattaaaaac tataatgatt tatgtccatg attatgaaat tgaagattat    113520
ttcgaatgag tcataatctt gaaaaagtaa tcgagcataa tgtagctcag gaacgtaagt    113580
cgttcaagga attcgtagaa aaatttttg aagaaaatac cacagaccag tttacaaatc     113640
aagcgtctga tgatattata acaaagtcaa ctaattgagt ggtatagtta atgaataaaa    113700
atattgatac agttcgtgaa attattactg ttgcgtctat tttgattaaa ttttccagag    113760
aagatattgt tgagaatcgc gctaattta ttgcatttct gaatgagatt ggagtaacgc     113820
atgaaggtag aaagttaaat cagaattcat tccgtaaaat tgtttctgaa ttaactcaag    113880
aagataagaa aaccctcatc gacgaattca acgagggttt tgagggtgta tatcgatatc    113940
tagagatgta tacgaacaaa taattattta gcccttccta atattctggc cgcctgagca    114000
catattgatt caaggcggtc attacttata tgatcatttc tataccagta catggttatt    114060
gttccagcat agatattatc caaattaaaa tatggacaac tgtacatgta gtttatttcg    114120
ggagtaggct ttttagttgg taaaaaagca aattttgagt cggaataata atgacgtcca    114180
tttaaatgaa ctgtatattc atccatagtt ttatcaacag gatatcctcc aagtgatttt    114240
tcacttattg ttgaaggtaa ttttccttca tatgctataa tatcaacaaa atagtttaag    114300
tttttagggc ggaaagaata caccgcacta aagtctgcct cagatgatat atgaactatc    114360
tggagttgtt ccagggcgac agattcaaag cgtgcatttc tttccttttc aataatttca    114420
ctgtatgttt catactttga ttgcttatag tactcaaaga aactatctcc cctataccaa    114480
acaatcgcca tcataaataa aagaattacg acagctaccc gggaagcaag aactttcccg    114540
gtagcgttat ctttgaacaa gcgatctaga acaccaaaca gaatatcaga gggcgaaaat    114600
gatattctag gtgctgccat agaccctcct tttaagggta tttattcaca ttatactctt    114660
ggaccatata ttgctccaac attttgccat gttggagcgg accctatgac agcataacca    114720
gcagcgccgc cattatattc agatccttga ccgcgaatat tgcatctacc tcccgcggaa    114780
```

FIG. 17JJJ sequence.txt

| | | | | | | |
|---|---|---|---|---|---|---|
| cctacttcac | caccgtttcc | accattatag | ataccattca | cggatcctga | gccaggtgca | 114840 |
| gaaatagtac | cgccagtcgc | gcctgattgc | atatcaatag | atcctcctgg | cgcaccaaaa | 114900 |
| ggacgaccgc | caccaccacc | aaaggtcaat | ctcatttgtg | aaaaaggaga | ataatatccg | 114960 |
| ccgccgccac | cgccgccacc | gcctgcaata | gctccgccat | tattaattct | tagtctccca | 115020 |
| ccaatatcgt | tttgaataca | atgacctcca | gctgagccag | gactattgct | accgccatta | 115080 |
| cctccacgac | catacatcgt | tacgccatgt | atatttaact | gaacatattc | atttggtgta | 115140 |
| tctccgtaca | tgaagaataa | aggaacatct | ttagaataag | aaacgatatc | accaacaata | 115200 |
| ttgaatacaa | taggtgcacc | gccagcttca | aagcatctat | cacggaacca | ctgaccatta | 115260 |
| aaattgtggt | ttgctcctac | agtatgaata | atttctcgtg | agcgacctgc | aaattgactc | 115320 |
| atccagcaag | gaacacccaa | tcttaattga | ccagctgctt | gactcatcca | gcgctgtcct | 115380 |
| gtttcatttg | cggctgaact | tccaatccaa | ccaggaacac | caactactgc | cataatttat | 115440 |
| actccaaagg | gggcatttcc | cccttgttgt | tagaatttaa | aatatttact | aattttgcga | 115500 |
| gcaattttag | taaagagagg | cgttttcaat | tctttaattt | cttcactcat | ttcctgaata | 115560 |
| gccttaatta | aaagagcatt | cacagcagag | ttagaaattg | tcagaacatc | agatccatca | 115620 |
| acttcaactt | tagatacagc | ttccggtaat | tccttttcaa | ggtcctgagc | aataatacca | 115680 |
| acttcacgtt | taataacact | acggtcttta | atagacttaa | ctttatcgta | aatataaact | 115740 |
| ttcagtcggc | aaacttttttc | gactgctcca | tattctaatt | cttctttatt | aatcttgaga | 115800 |
| cgggagtcag | aacgaatata | cacatcgcta | aagctaccat | ttcctggtgt | ataaaagaat | 115860 |
| ccatcatgat | ggaattcaaa | cacagcttgt | gggtgtccag | catcaggaga | agcctccgtg | 115920 |
| gatccgacac | gaatgattgc | ttgcccccac | tgtgatggaa | tacgacgcat | accaaagtca | 115980 |
| acagcggtgc | tatatccttg | attggttata | acgcttcttg | ctttaagaat | aggataataa | 116040 |
| ctatcttgac | caacataacc | atgatcaacg | aataatggag | cttctactcg | ccattggttg | 116100 |
| ccccaatcac | ccggttgtct | agcaatccat | ccagaaccgt | taatgtgtac | acggtcacgg | 116160 |
| ttaacgttaa | ccattgcggt | attttgcggg | tttaacgcaa | tctcaccatt | gtttgtgata | 116220 |
| tgtactgccg | cctgagaagc | atagctataa | aatgctagcg | aattatcagc | accacccttg | 116280 |
| ccaatatacc | agttaccagt | cccgtctatg | tcaccgcgaa | atgcaaagaa | attactagca | 116340 |
| gttgttgata | atacaataga | atcattaggt | gcattgattg | ttaaccgacc | tgtcatcgta | 116400 |
| tcaccgcctt | tacctaggcg | agtattcaag | gcagcatcta | aattggttgc | atcgttgtat | 116460 |
| ttcttccaga | ttgaaccagc | aatgttacca | tcagtgttca | agaatgctgc | gccagcataa | 116520 |
| actcggcttt | gtgacatgaa | tcggccagac | ggcaagaaac | gccatgtagc | taattcagtg | 116580 |
| gctgtagttc | cagtagcgga | taaatcaccc | tgagcaacga | tacgatattc | tgaactagca | 116640 |
| atatccatac | cagaagccat | agtaatattt | gttacagtgt | ttttctgttt | aacaattggc | 116700 |

FIG. 17KKK sequence.txt

```
gcaaactggt tttatttga atcgtcaata gcctgatata atggcgcaat ggtagtattc      116760
tgatttgcgt aagtattaga accagaaccg ctagcagggg cttgaatata tgctcctgga      116820
gcaagtgaaa ttttctgatt agcaccaaga ttaacagcag cagtgatatt cagcaatccc      116880
ctaaagtttt gttgagcagt ccaagtatgt gatccgtctt caagaacaac acgacgacaa      116940
gtattagtcc tacttcctgg attaccagcg atacgaacaa cgaaataacg atagttcgcc      117000
tgagatacag taccgcgcca cacttgaaca gttcgacccg ttccggtatg ttcgctagga      117060
ccgacagaaa acataaccag gtttccatca atcgtgcccc aatccatatt tgctggcata      117120
ttctttattt tgttcaaagg aacactaaac atactaccag ggacaaaatc aaaggtttgc      117180
caatctaact ccgctaattg agctttaata ccacccatac ccaaagtaat tggcagagaa      117240
taagatgtat atacttcgtt ccatgcaccc cacgcaccac cagtatatgc acgctcaaaa      117300
atacgatcgc gagtagttgc acccgttcct gcggtagtga aacgttggaa aatagcaccg      117360
ccagaagcac gctgtttaac ttccagcaaa ccaacaataa cagtcggcaa accttcacct      117420
gtaggacagt taataacggc atcagtgcct aaaatattat ataacccggg agttttaaaa      117480
tcattcagat ctccatcata gaaagtcgct ggtgtgccat gaccaacctg cttccattcc      117540
tcccacttag gtgcactagc atcccatgca gcagcgagac aacgagtata aaccataccc      117600
atgcgggtag tataacgctg agttctcgtg tataaaccac cttcaaatat ttctaaaaat      117660
ccttgtgcgg ctgatccttc ttctggataa tggcgatcaa atgatgcgat tgcgcttgaa      117720
ctgtttcgcc ataagccaca atgttctaat tctcccaagc tatcaaggtc aatcgtttgt      117780
gaaagtggac gagttgacgc ttgaacatta cgccacacac cccatggacc atcgacgcca      117840
ttccatttag cagataagga acgaatatag acgttaccag atcttacagt ataacgctga      117900
gtgccagcaa attggccggc cacaaacact tctagtacac ctacggcatt ttcttctggg      117960
aatttatttg ctggttgcgc atttgttgaa gtagatttcg accaaacacc aagatattct      118020
tcaatgggcc catacgtatc taaattagca tcagtaggta attcgccatt attttttata      118080
aatgttgtgc tattgacatt tatgtcagat ggagttaagg taatgtcctt tgacccatca      118140
aaagatatac cattaatttt cctaggtgtt tgcaatttag tagctgtgct agaatttcca      118200
attaaagttc cagttatatt ttctgtaacc tctaaagacc catttatagt tcctccatat      118260
tttaaaccta attctataac actacctgag tcatcttttg tgaaaattgt tttatctttt      118320
aagtttatag ccaattcacc ttcggctaat actgaagcag caggacgttg acctgcagtt      118380
ttgcttcttt taaattgtat ttgttttaaa gtagccataa gtcctcttaa taatagccga      118440
aatcttgaac agaatcctta attacgattt ggtcaaatcg tggaacgtgt gaaggttgag      118500
atgcaggatt ctgtgaaaaa aggtttggcg cagttaaatt tcctgtcata gtgtctccag      118560
```

FIG. 17LLL sequence.txt

| | | | | | |
|---|---|---|---|---|---|
| agcgtaatac | cctagagttt | gcatttgctg | taacagtatt | tattgctcca | tcaacataat | 118620 |
| ctttgcgagt | aacatcagat | gctgcggaag | gagtagatgt | aacagttacc | gatggagccg | 118680 |
| ttacagccct | ggtaaatgtt | gtcaaacctt | ctggcgtaat | agtaatttgt | ccagtagtga | 118740 |
| tttcactacc | tgcaggtcta | aaactaatac | caccggaaga | gccgccaact | acaagagtat | 118800 |
| taccagtgcc | gccaccagaa | cgaattcgga | taggggtttc | attattactt | aattgaagat | 118860 |
| aactatttac | cccgtaatta | atagtaattg | gaccggcgta | agtaccacca | ttagctttag | 118920 |
| aaacgaaatc | gttatcagct | gcctgcggtt | tattatattc | tgaatatatt | ttaaatgatt | 118980 |
| tgtagagtac | atcgtcaccg | gctgaattca | atggaaaatt | tccttgatgc | caaatgacag | 119040 |
| atccacccac | agttgaacct | acttttaaat | cagccattat | atgccccttt | attttaatat | 119100 |
| tatttataaa | gaaaaaggga | acccgaaggc | tccctcagtt | taaacttctc | taaattcctg | 119160 |
| tccaaacact | ttgccagttt | tagaagaggc | ttgtgtagga | agtaccatta | tatctggagg | 119220 |
| tgaagccgat | tcacagacat | aattaacgcg | aataccgttg | acgccaaatt | cggcaggttt | 119280 |
| tgaaatgccg | ccatttcttg | atacttcaga | aaaacttaaa | tttctcatgc | cgccttgacc | 119340 |
| tgcttgagca | gttctttgtg | catatatcgt | aaatcctacg | gcgttttctg | gaacaactac | 119400 |
| atagtcttct | tttaattccc | aagacccagc | ttgcccagta | aactcagctt | gggtcgagga | 119460 |
| aatatatcca | tttgatgcat | cataaaaacg | aatggatatg | tttgtagttc | caagatcaag | 119520 |
| taaatcagca | tcagcatata | actgtgcttt | aagataaaga | acatcaccag | gaattaaatt | 119580 |
| atagtcagaa | agtttactta | tagcagctga | agttggcaat | cgcgcaattt | cgttattagt | 119640 |
| tccaccaact | gctgacatga | attgctctac | actttcataa | gttcttttg | gaaatcctgt | 119700 |
| cgctccgacg | tcttctaaac | tatcaaatac | aacatctaaa | atagtttgat | aatcatctgt | 119760 |
| gcttttcta | ttacttagtt | taacatgctc | taatgcaata | gctcttttag | aagaagtata | 119820 |
| aaaagcagca | tatgatacgt | caaatcttga | caatactgaa | tctgatggaa | aaactgaagt | 119880 |
| tcctgctccc | cttaaccaag | ataccacttc | aggaggaaaa | ttaacctttc | cgctagttaa | 119940 |
| tatagcaaca | agtctattgt | ttgacaaaga | attcatgaaa | ctgacaaaag | cggcagatgt | 120000 |
| tgtattgttt | gaagcagaaa | aagcatatga | cttgctatca | actaatgctc | ccgtagaagg | 120060 |
| gtcaaaaact | cttaaatgaa | gacctgcact | aaatgtttga | tttccaacgg | gattatcctg | 120120 |
| aaatttaaca | tatggccccg | cagtagaaag | cgggcaagaa | cccgctatgc | ttattttgta | 120180 |
| tcttactgaa | ttactttccg | ataaaaatgg | cgtttggacg | tatccttgtc | caaactctgc | 120240 |
| cataaatttt | tccataatac | ctcttattca | acccattcaa | atttaacagt | tttattcact | 120300 |
| gggtcaggaa | taatgcgaac | attaccaatt | cgtaagaaat | cacgaatagt | aagattacct | 120360 |
| attattccat | tatcagatgg | gattgctcct | atatccgaag | gttgaggagg | gttacctcca | 120420 |
| tcaaataccct | gaacaaaact | tgaccaagaa | tttttagttt | tctgccatgt | acgcgtccag | 120480 |

FIG. 17MMM sequence.txt

| | | | | | |
|---|---|---|---|---|---|
| cgagtggtac | gtgcttctgg | ggtcgttgga | taagtaatcc | aatcttggta | aagcgaatca | 120540 |
| agtgtgttac | caaactgagt | caatgtacca | ggagatttaa | cttcttcgcc | acgttctaag | 120600 |
| tatggaagcc | cagtcacttc | attagttttt | tcaaccattt | taaaataacc | cgggaactgg | 120660 |
| ttataagtgg | ctgaatcgtt | aatatcaatt | gaccagaatc | ctacagtatc | agatgttgga | 120720 |
| gcgcgggtgt | ataaatcaga | tgttttagtg | ccctgagaac | gaattctcga | gttaacagtc | 120780 |
| aaaccgcctg | aatttatagt | agcacctttg | gcaatgatta | agctttcacc | aatcgttact | 120840 |
| tggccagatg | cattattaat | agctaaagga | cgtaatccat | taaatccacc | agtctgatca | 120900 |
| cccgatgcag | taagcataaa | attcgttact | gatccatcat | tgcgaacaat | gaaaccataa | 120960 |
| tttccgttaa | tagcacggaa | agcatttgcg | cttcgagaaa | taatttcacc | agttgcagtg | 121020 |
| actgaattac | caaatgttgc | tacaccattt | gcattcaatg | ttcctgaagc | attaacattt | 121080 |
| atcggtgtta | ctgtaccgtt | gatattaaat | gttatatttc | cagctttatt | acgctgagaa | 121140 |
| taaaaatgac | tagacgtttc | atcactaact | tcaaatacgg | tagaacgtgt | tgtgtctgat | 121200 |
| tccccgctaa | attgatttcc | ccacactctg | actgtcatcg | tttgagccgg | gtttgttcca | 121260 |
| gttttgaggtc | cttttctcaaa | aatcagacga | gttgccgttc | cagtattaga | aatagttaat | 121320 |
| gtactatttg | ctgaaactga | tccaccgaat | gtagcagtac | tagatgatac | aagaggggca | 121380 |
| cccagattcg | tttgttgggt | taaggttagt | gaaccattaa | ctgtttgtgc | aatgtccta | 121440 |
| cgaatgaact | ggagcgaatc | tagaccatct | aataaattac | tatctacagc | ttttgctttt | 121500 |
| aatggcaaat | aatttgctaa | tacgcgattt | aattcatatg | gtgatactgc | ataaccattt | 121560 |
| ttctcatatg | attctaatgg | ctgtgttgaa | cctaccgtat | cattaccaac | aaacgttaat | 121620 |
| gaaccagaag | aagttttaac | aaaccctctt | atcagagtag | ttgctgccca | agttggttca | 121680 |
| ctctgcacaa | tccattttaa | attttttgga | gatacagcag | tatttgctga | cgttccagtc | 121740 |
| acagtttcag | actgagttgc | aactttaata | acaccttctt | gcgattcggt | agatttagta | 121800 |
| cctaaaagct | ttttaggagt | tattaaaaca | ttatctaatg | ttcctgcagc | agcttcaact | 121860 |
| tgtgtagcta | cacgaagtgt | accacgctgt | gtctcatttg | cttcaagaat | attaagggta | 121920 |
| taatggtccc | agagagttcc | tgattcaact | aatccagata | gagcaacaac | agaagtacga | 121980 |
| tcagtactat | taaatctggt | tttaatttt | aatggtgtag | agatacgagt | atcgtcgacg | 122040 |
| cctgcgtcga | attcaacttg | cgtagcaatt | tcagctatac | cacttaaact | ttcagttgct | 122100 |
| ctacggtcat | ttaaagtttt | aggagtgact | gcgcgagtat | aatcagttcc | tgtattaact | 122160 |
| tcgctttgcg | tagcaatttc | aattaaacca | attcttccat | cagttgatgt | cttttatgt | 122220 |
| aacgtttctg | gtgttacaac | cgcatttgcc | catccttctt | ggctttgtcc | agcaattact | 122280 |
| tcactttcaa | ctgctaaaat | tactgcgcct | tgttgcgttg | gagtagcttt | atactgatcc | 122340 |

FIG. 17NNN

```
                                sequence.txt
aaagctttag gtgaaacaac taaattatta gtgtttttat tataaacatt cgtaccattt    122400
aattcacgac tagaagctgg agtagctcct gcggtagata caaaagttac aataccagat    122460
aatgattcag aaccttgacg agcttgaagc tttttaggag tgatgattgt agtatcatca    122520
gtacctgtat tagtttcctg ctgcgtagca atttcagcga cacctctacg agtttctgta    122580
gcagttcttt cattcagctt tttaggagtg atgataaggt catctgcaaa agagaatgtg    122640
gtgttctgat ttacttgagc agtagttgct attcttgcaa tacctctgcg agtttcagta    122700
gcagtacgat tagctaacgt ttctggagta attgccaatt cttttgcgg agaattttct     122760
aaatcagcat ttgcttgagc ttgtgtagct aaagcaatta cgcctaatct tgctctagta    122820
gaagcattta aagagtctac tctttctaca gttggaacgt tttgctgtac aacccagtat    122880
tttccatcag aatcttctat ataagcaagt tgtaaaactg aacataatt agtttcaccg     122940
ttaaaaacta attcttgaac tgttacccat tcagcttcag gcggatattc tgaacgtttt    123000
gggaattgca gcaattgaac tgaagaagca attttatctt caccagcagc tttgatttta    123060
actgtttgtc cttttctcat gtaattcatg gaaattttaa cagtatcacc aacagaaata    123120
tcagtcggaa gctgaagttc aattgtttgg gttgttccat tattcgcgcc aaataccatg    123180
acttcttcat ttggacgaat atttgaatta gttgttataa tgcgtaaacg tgctttacta    123240
tccccgtcaa acaatctcca caatttctca ttatcgtcaa acatcaagaa accgtcaatc    123300
gatgtacggc cttcaatgga atgagttcca acttcttgta ctgaagtcgt ttcatcgtat    123360
gtagtaacaa ttgtatgata aagtggattc agtttatcta aatcaacgaa attaataata    123420
tcgccatgat tagcaaatct cggaagttta acattaattg gtgcagcaga agtaaatcta    123480
cgtacgataa aatcattaga ttgtgcttga tacgcagtcg atggagtaac aatcgcagct    123540
tctctgctat aatcagcaac atacatttgc cacaaacgat tattaaaaat gaatatcatc    123600
tgtgactttg gatgagtcat taaaactgaa cgtacttgtt cacctctaaa attgacaata    123660
ctctgatttg aagaatttat tttaacctga tttatgccag gttttccacc gatatcttga    123720
attattacgg tttctccatc aagcggagaa ggtggtaaag taaactcaat gtcattgcca    123780
actgatgtat ctactgaaat tgcttctccg gattttaatt gatatggtcc agatgataca    123840
gttgtatata cagcatcagt acgtaatgct ttccaacgaa ttctattaaa atttccagca    123900
ggttttggaa tattatccgt tgctgcccaa aaacgattat tataaatgat tacaaaatct    123960
tttaaatatc cacgagttgg atcatattgc tgaactgtgt tttcttgaat taagtaatca    124020
acgttaacac cgtcagttcc tacggtacga tcagctaaag ctacgttgat tattttatcg    124080
ccacctgcgt ccagaccatc ttctgctctg aactttcttt taatctcggc cattctcccg    124140
ggctcctatt gtgttttcaa taataagtat ttatacctgt ttactttaag atttagatag    124200
tatataatag aaatctcact aattgaacga ggttcatatg gatttagaaa tgatgctgga    124260
```

FIG. 17000 sequence.txt

| | | | | | |
|---|---|---|---|---|---|
| tgaagattac | aaagaaggaa | tttgctttat | tgactttagt | caaattgctc | tttcaactgc | 124320 |
| tctggtaaac | ttcccagata | aagaaaaaat | taatttatcg | atggttcgtc | atttgatatt | 124380 |
| gaactcaatt | aagtttaatg | tcaaaaaagc | aaaaacgctt | ggatacacta | aaattgtgct | 124440 |
| gtgtattgat | aacgcgaaat | ctggatactg | gcgtcgtgat | tttgcttact | attacaagaa | 124500 |
| aaaccgtgga | aaagcacgag | aagaatctac | ttgggactgg | gaaggttatt | ttgaatccag | 124560 |
| tcataaagtt | atagatgaat | tgaaagctta | tatgccatac | attgttatgg | atattgataa | 124620 |
| gtatgaagca | gatgaccaca | ttgctgttct | tgttaaaaag | ttctctttag | aaggacataa | 124680 |
| gattttaatc | atttcatcgg | acggtgactt | tacacagctt | cacaaatatc | caaatgttaa | 124740 |
| gcaatggtca | ccgatgcata | agaaatgggt | taaaattaaa | agcggttctg | ctgaaattga | 124800 |
| ctgtatgact | aaaatcctta | aaggcgacaa | aaaggataac | gttgcttcag | ttaaagtacg | 124860 |
| atctgacttt | tggtttacca | gagttgaagg | tgaacgaacc | ccttcaatga | aaacttcaat | 124920 |
| cgttgaagct | attgctaatg | accgtgagca | agctaaggtg | cttctcacag | aatctgaata | 124980 |
| taatcgttat | aaagaaaatt | tagttctaat | tgattttgat | tatattcctg | ataatattgc | 125040 |
| ttcaaacatt | gtgaattact | ataattcata | taattacca | ccgcgtggca | aaatttattc | 125100 |
| atattttgta | aaagcgggtc | tttctaaatt | aactaatagc | attaatgaat | tttgaggtga | 125160 |
| ataatggcta | aaaagaaat | ggttgaattt | gatgaagcta | tccatggcga | agacttggct | 125220 |
| aaatttatta | aagaagcatc | tgatcataaa | ctgaaaattt | ccggttataa | tgaactgatt | 125280 |
| aaagatattc | gaattcgtgc | taaagatgaa | cttggcgttg | atggtaagat | gtttaatcgt | 125340 |
| ctattagctt | tgtatcataa | agataaccgt | gatgtgtttg | aagctgaaac | tgaagaggta | 125400 |
| gttgaacttt | atgacacagt | tttctctaaa | tgatattcgc | ccggtcgatg | agaccggtct | 125460 |
| ttcagaaaaa | gaactttcaa | ttaagaaaga | aaaggatgaa | attgcaaagc | ttcttgaccg | 125520 |
| ccaagaaaat | ggatttatta | ttgaaaaaat | ggtagaagaa | tttggaatga | gttatcttga | 125580 |
| agctacgaca | gcattcttgg | aagaaaactc | tattcctgaa | actcaatttg | ctaaatttat | 125640 |
| tccttcgggt | ataattgaaa | aaattcagtc | agaagccatt | gacgaaaatc | ttttacgtcc | 125700 |
| ttctgttgtt | cgttgtgaaa | aaactaatac | attagatttt | ctgctatgat | taaactccgc | 125760 |
| atgcctgctg | gtggtgaaag | atacattgat | ggtaaatcag | tttataaatt | atacttaatg | 125820 |
| ataaaacagc | atatgaatgg | aaagtatgat | gtaattaagt | ataattggtg | catgcgggtg | 125880 |
| tctgatgccg | cttatcaaaa | gcgaagggat | aagtattttt | tccagaagtt | atcagaaaaa | 125940 |
| tataaattaa | aggaacttgc | tttaattttt | ataagtaatt | tggttgctaa | ccaagatgct | 126000 |
| tggattggtg | acatctctga | cgctgatgca | cttgtgtttt | atcgtgaata | tatcggacgc | 126060 |
| ttaaagcaaa | ttaaatttaa | gtttgaagaa | gatattcgca | atatttacta | ttttagtaaa | 126120 |

FIG. 17PPP sequence.txt

| | | | | | |
|---|---|---|---|---|---|
| aaagttgaag | tttctgcttt | taaagaaatc | tttgagtata | atccaaaagt | tcaatcaagt | 126180 |
| tatatttta | aactacttca | atcgaatata | atttcgtttg | aaacgtttat | cttgcttgat | 126240 |
| tcgtttttaa | atataattga | taaacatgat | gaacagactg | ataatttagt | ctggaataat | 126300 |
| tattctataa | agttaaaggc | ttatagaaaa | attttaaata | ttgattcaca | gaaagctaaa | 126360 |
| aatgttttca | ttgaaactgt | gaaatcttgc | aagtattaat | tgcttattat | aaataagatt | 126420 |
| ataattatct | cactgaccag | ctatgaggtc | atacatcgtc | atagcaccaa | ctgttaatta | 126480 |
| aattaaaaag | gaaataaaaa | tgtttaaacg | taaatctact | gctgaactcg | ctgcgcaaat | 126540 |
| ggctaaactg | gctggaaata | aaggtggttt | ttcttctgaa | gataaaggcg | agtggaaact | 126600 |
| gaaactcgac | aatgcgggta | acggccaagc | agtaattcgt | tttcttccgt | ctaaaaatga | 126660 |
| tgaacaagca | ccattcgcac | ttcttgtaaa | tcacggtttc | aagaaaaatg | gtaaatggta | 126720 |
| tatcgaaaca | tgctcatcta | cctacggtga | ttacgattct | tgtccagtat | gtcagtacat | 126780 |
| cagtaaaaat | gatttgtaca | acactgacaa | taaagagtac | agtcttgtta | aacgtaaaac | 126840 |
| ttcttactgg | gctaacattc | ttgttgtaaa | agacccagct | gctccagaaa | acgaaggtaa | 126900 |
| agtatttaaa | tatcgtttcg | gtaagaaaat | ctgggataaa | atcaatgcaa | tgattgcagt | 126960 |
| tgatgttgaa | atgggtgaaa | ctccggttga | tgtaacttgt | ccgtgggaag | gtgctaactt | 127020 |
| tgtactgaaa | gttaaacaag | tttctggttt | tagtaactac | gacgaatcta | aattcctgaa | 127080 |
| tcaatctgcg | attccaaaca | ttgacgatga | atctttccag | aaagaactgt | tcgaacaaat | 127140 |
| ggttgacctt | tctgaaatga | cttctaaaga | taaattcaaa | tcatttgaag | aactgagcac | 127200 |
| taagttcagt | caagttatgg | gaactgctgc | aatgggtggt | gccgctgcaa | ctgccgctaa | 127260 |
| gaaagctgat | aaagttgctg | atgatttgga | tgcattcaat | gttgatgact | tcaaaacaaa | 127320 |
| aactgaagat | gattttatga | gctcaagctc | tggcagttca | tctagtgctg | atgacacgga | 127380 |
| tctagatgac | cttttgaatg | acctttaaca | gattatatta | ctaattaatt | ggggacccta | 127440 |
| gaggtcccct | ttttatttca | aaaatttttt | cacaaaactg | tttacatcct | tgtccttcca | 127500 |
| tggtactata | caactatcgg | caatactgct | gataattaaa | gaggaaaata | atatggctaa | 127560 |
| agttgatatt | gacatcgttg | attttgaata | tattgaagaa | attattcgta | atcgttatcc | 127620 |
| tgaacttagt | atcacaagta | ttcacgatga | tcccaattat | tgcaattttt | ctattgtcat | 127680 |
| tgaaggtcct | cttgaagacc | tcacccgctt | tatggctaat | gaatattgtg | atggtatgga | 127740 |
| ttctgaagac | gcagaatttt | acatgggatt | gattgaacaa | taattatcaa | ggggctatta | 127800 |
| caagccccgt | taaaatgagg | aaaacgtaat | gtatattggc | aaaaagtatg | agcttgttcc | 127860 |
| aagacttatt | gatacattta | ttaattatcg | cccacgttct | aattcatcga | tagttaaaat | 127920 |
| tattcaagaa | aatggtggat | ggtttgaagt | taaagaagct | ttctttgttg | atggatttag | 127980 |
| agtaataaaa | cacattgaat | gcgcaaatgg | aaagcatttt | tactttaacg | tttgtgaaga | 128040 |

FIG. 17QQQ sequence.txt

| | | | | | | |
|---|---|---|---|---|---|---|
| cgaatttcat | tgttttcgtg | agtataaaga | accgacttct | gaagaagatg | gagccgaaga | 128100 |
| catagtttct | ggcgtaacaa | aaattcactg | cattgttgac | gaaaataatg | tagatgaaat | 128160 |
| cattgaactt | ttgcgaaaaa | ctttcaaaaa | gtagtttaca | acagggtagt | agtgtgatac | 128220 |
| tattacccta | tcaaaactaa | tggagaaaag | aaaatgttcg | cacctttatat | tatggcagca | 128280 |
| gttatgttgg | tctgtttata | tcttttgatt | aaagcttgct | aaggagaata | aaatgagatt | 128340 |
| acaacgccag | agcatcaaag | attcagaagt | tagaggtaaa | tggtatttta | atatcatcgg | 128400 |
| taaagattct | gaacttgttg | aaaaagctga | acatctttta | cgtgacatgg | gatgggaaga | 128460 |
| tgaatgtgat | ggatgtcctc | tttatgaaga | cggagaaagc | gcaggattct | ggatttatca | 128520 |
| ttctgatgtt | gatcagttta | aagctgattg | gaaaattgtg | aaaaagtctg | tttgaggaaa | 128580 |
| ataatatgtc | tggcattcat | gtaactggaa | ttgctcaagt | aaacatccgc | tgccaattta | 128640 |
| aaactgtacc | tggggtgact | catattactt | tatcacacga | cccatattct | cgtggaagac | 128700 |
| agttaactgg | cgtaattaag | tttttcggcg | gaattggcgg | aagcgaattt | actataggag | 128760 |
| atgacgaaat | tgttggctgt | aaattaaaag | ttcagaaggg | cgtgttagaa | cttttttagtg | 128820 |
| atgaagtttt | tgatgaaatc | tcacgagcag | ttaacaaagg | aatgttaacg | ttaattaaaa | 128880 |
| tgattaaagc | tagcggatat | gttactgatc | cttttttaata | ggaggcaata | tgattttttgt | 128940 |
| atttgaattt | atgaatgatg | aattcgatta | tgcaattttt | aacgcattgc | ataatcctga | 129000 |
| tttaagtgaa | tttaatgaaa | tgttttctga | cgctttgagt | atgtcagaag | aatactgtgg | 129060 |
| agaatgtcaa | cgtgtttgtg | tgacagtctt | tgaaaacaaa | gaaaagacct | atgaagaatt | 129120 |
| attctttgat | gctaataaag | ccactgaatg | gtttgttgaa | agaggttttg | cgtaatgatt | 129180 |
| aaattggtat | tcgcttattc | tccaactaaa | acggtcgaag | gctttaatga | attagcattc | 129240 |
| ggtttaggtg | atggtttacc | atggggacga | attaaaaagg | acctccagaa | ttttaaagct | 129300 |
| cgtacagaag | gtacaatttt | gattatgggt | gctaaaacgt | tccagtcatt | atctacatta | 129360 |
| cttcccggtc | gtagccatat | tgtggtgtgt | gaccttgcgc | gtgattatcc | tgtaactaaa | 129420 |
| gacggcgatt | tagcacattt | ctatattact | tgggaacagt | acataactta | catttctggc | 129480 |
| ggcgaaattc | aagtttcaag | tcctaatgca | ccattcgaga | ctatgcttgg | tcagaattcc | 129540 |
| aaagtaagtg | taattggcgg | gcctgctctg | ttatatgctg | cgttacctta | tgcggatgaa | 129600 |
| gtagttgttt | ctcgcatcgt | taaaaggcat | cgtgttaatt | caacggttca | attagacgca | 129660 |
| agttttcttg | atgatataag | caagcgtgaa | atggttgaaa | cgcattggta | taaaatagat | 129720 |
| gaagtaacaa | cccttacgga | atcagtatat | aaatgagcaa | taaattaaaa | gttaaggatg | 129780 |
| ttcctaatgc | tatggcccctt | tttatttgta | ggcagatgca | tcaagggcct | atgacaccaa | 129840 |
| aacaatatct | taaggtgag | cgttctttag | gatttactcg | caaagcaaaa | caaatggtta | 129900 |

FIG. 17RRR sequence.txt

```
aattaggata taagcctaac tttgccaaat atccttctac atattcttgg atgaactaat    129960
gaaacaatac caattttaa ttaaagatat cctggaaaat ggctacgaaa ccgatgaccg    130020
aacaggcaca ggaacaattg ctttgttcgg tactaaatta cgctgggatt taactaaagg    130080
ttttcctgca gtaacaacta agaagctcgc ctggaatgca tgtatttctg agttattgtg    130140
gttcttatca ggaagtacta acgtaaatga tttgcgatta attcaacata attcattaat    130200
tcaaggcaaa acagtttggg atgaaaatta cgaaaatcaa gcaaaagatt taggatacca    130260
tagcggtgaa cttggtccaa tttatggaaa acagtggcgt gattttggtg gtgtagacca    130320
aattatagaa gttattgatc gtattaaaaa attgccaaat gataggcgtc aaattgtttc    130380
agcatggaat ccagctgaac tcaagcagat ggcattaccg ccttgtcata tgttctatca    130440
gtttaatgtg cgtaatggct atttggattt gcagtggtat caacgatcag tagatgtttt    130500
cttgggttaa ttgaggcctg agtataaggt gacttatact tgtaatctat ctaaacgggg    130560
aacctctcta gtagacaatc ccgtgctaaa ttgtaggact gcccttaat aaatacttct    130620
atatttaaag aggtatttat gaaaagcgga atttatcaga ttaaaaatac tttaaacaat    130680
aaagtatatg taggaagtgc taagatttt gaaagagat ggaagaggca ttttaaagat    130740
ttagaaaaag gatgccattc ttctataaag cttcagaggt cttttaacaa acatggtaat    130800
gtgtttgaat gttctatttt ggaagaaatt ccatatgaga aagatttgat tattgaacga    130860
gaaattttt ggattaaaga gcttaattct aaaattaatg gatacaatat tgctgatgca    130920
acgtttggtg atacatgttc tacgcatcca ttaaagaag aaattattaa gaaacgttct    130980
gaaactgtta aagctaagat gcttaaactt ggacctgatg gtcggaaagc tctttacagt    131040
aaacccggaa gtaaaaacgg gcgttggaat ccagaaaccc ataagttttg taagtgcggt    131100
gttcgcatac aaacttctgc ttatacttgt agtaaatgca gaaatcgttc aggtgaaaat    131160
aattcattct ttaatcataa gcattcagac ataactaaat ctaaaatatc agaaaagatg    131220
aaaggtaaaa agcctagtaa tattaaaaag atttcatgtg atggggttat ttttgattgt    131280
gcagcagatg cagctagaca ttttaaaatt tcgtctggat tagttactta tcgtgtaaaa    131340
tctgataaat ggaattggtt ctacataaat gcctaacgac tatccctttg gggagtaggg    131400
tcaagtgact cgaaacgata gacaacttgc tttaacaagt tggagatata gtctgctctg    131460
catggtgaca tgtagctgga tataattccg gggtaagatt aacgacctta tctgaacata    131520
atgctaccgt ttaatattgc atcatatgct acgttagttc atattgtagc taagatgtgt    131580
aatcttatcc caggagattt gatattttct ggtggtaata ctcatatcta tatgaatcac    131640
gtagaacaat gtaaagaaat tttgcgtcgt gaacctaaag agctttgtga actggtaata    131700
ggcggattgc cttataaatt ccgctatctt tctactaaag aacaattgga atacattctt    131760
aaactcaggc ctaaagattt cgttctcaaa gattatcagt cccacggcgt cttgaaagga    131820
```

FIG. 17SSS sequence.txt

| | | | | | | |
|---|---|---|---|---|---|---|
| aaaatggcgg | tgtaatttca | atttaattgc | gaggatatat | gattttacga | tttaaagata | 131880 |
| cttctggtgc | agttctttt | acacttccta | atccaagtga | gctagaagtt | ccaggaccaa | 131940 |
| atcagcctat | tatcatttat | ggcaaaaaat | attatactca | taaaatgact | cgtgagtatt | 132000 |
| ttgataataa | aatttctaca | gttaaaactt | cttctgattg | ttactatgat | attactgttt | 132060 |
| taacggaaaa | acaatatgac | gaattatcac | cgcgcgggcc | gtctatgcca | ggtagtgaat | 132120 |
| aaatataaat | ccgactttga | tgtcaatatt | caccgcggta | cattttgggg | aaattacgtc | 132180 |
| ggtaaagatg | ctggcagccg | ggaggctgcc | attgaattat | tcaaaaaaga | ttttatacgt | 132240 |
| cgaattaaat | ccggagaaat | aactaaagca | catttagagc | ctttacgtgg | aatgaggcta | 132300 |
| ggatgcacat | gtaaaccaaa | gccgtgtcat | ggtgatataa | tagctcatat | agttaaccga | 132360 |
| ttgtttaaag | acgattttca | agttgaggac | ttatgcaatt | aattaatgtt | atcaaaagta | 132420 |
| gtggtgtttc | tcagagcttt | gacccacaaa | aaattattaa | agttttatct | tgggcagctg | 132480 |
| aaggaacatc | agtagatcct | tatgaattat | atgaaaatat | taaatcatat | ctccgtgatg | 132540 |
| gaatgacaac | tgatgatatt | cagactattg | tcattaaggc | cgctgcgaat | tctatttcgg | 132600 |
| ttgaagaacc | tgattatcaa | tatgtagctg | cacgttgttt | aatgtttgct | cttcgtaagc | 132660 |
| atgtttacgg | gcagtatgaa | ccgcgttcat | ttattgacca | tatttcttac | tgtgtaaatg | 132720 |
| aaggtaaata | tgaccctgaa | ttgttgtcaa | aatattcagc | agaagaaatt | acatttttag | 132780 |
| aatcaaaaat | taagcacgag | cgggatatgg | aatttactta | ttccggggcg | atgcaattaa | 132840 |
| aagaaaaata | tctcgttaaa | gataaaacca | ctggtcaaat | ttatgaaact | ccgcagtttg | 132900 |
| catttatgac | tattggaatg | gcattgcatc | aagatgaacc | tgttgataga | ttaaaacatg | 132960 |
| ttattcgttt | ttatgaagca | gtatctactc | gacagatttc | attaccaact | cctattatgg | 133020 |
| ctggttgtcg | tactccgact | cgacagttta | gttcatgtgt | tgttattgag | gcaggtgatt | 133080 |
| cgctgaagtc | tatcaataag | gcttccgctt | cgattgttga | atatatctct | aaacgcgctg | 133140 |
| gaattggtat | taacgttggt | atgattcgtg | ccgaaggttc | taagattggc | atgggtgaag | 133200 |
| tacgccatac | tggtgttatt | ccttttgga | aacatttca | gactgcagtt | aaatcatgtt | 133260 |
| cacagggtgg | aattcgtggc | ggcgctgcta | ctgcttatta | tcctatttgg | catttggaag | 133320 |
| ttgaaaatct | tctcgttttg | aaaaataaca | aaggcgtaga | agaaaccgc | attcgtcata | 133380 |
| tggattatgg | tgttcaactg | aatgatttga | tgatggaacg | attcggaaag | aacgattaca | 133440 |
| ttactttgtt | cagtccgcat | gaaatgggtg | gagagcttta | ttattcttat | tttaaagacc | 133500 |
| aagaccgttt | ccgtgaatta | tacgaagcag | cagaaaaaga | ccctaatatt | cgtaaaaagc | 133560 |
| gtattaaagc | ccgtgaacta | tttgaattgc | tcatgactga | acgttcagga | acagcaagaa | 133620 |
| tttatgtaca | gttcattgat | aatacgaata | actatactcc | gtttattcgt | gaaaaggcac | 133680 |

FIG. 17TTT sequence.txt

```
ctattcgtca gagtaacttg tgctgtgaaa ttgctattcc aacaaatgat gtgaatagtc    133740
ctgatgctga aattggattg tgtactctct ctgcattcgt actagataat tttgactggc    133800
aagaccaaga taaaattaat gaattggcag aagttcaagt tcgtgctctt gataatcttt    133860
tggattacca aggatatcca gttcctgaag cagaaaaagc taaaaagcgt cgtaacctcg    133920
gtgtaggtgt taccaactat gcagcttggc tggcaagtaa ctttgcttct tatgaagatg    133980
ctaacgattt aacacatgaa ctatttgaga gattacagta tggactcatt aaagcatcca    134040
ttaagctcgc caaagaaaaa ggaccttgcg aatattattc agacactcgt tggtctcgag    134100
gcgaattacc tatcgactgg tacaataaaa agattgacca aatcgcagct ccaaaatacg    134160
tttgtgactg gtcgtcgctg cgggaagacc ttaagctctt tggcatccgt aatagcacac    134220
tatcagcact tatgccatgt gagtcatctt cccaagtttc taacagtaca aacggtatcg    134280
agcctccacg tggaccagtc tctgttaaag aatcaaaaga gggttccttt aatcaagtcg    134340
tgcccaatat tgaacataac atagacctat atgattatac atggaaatta gctaagaaag    134400
gtaataaacc ttatcttacg caagtagcta ttatgctgaa atgggtatgt caatcagctt    134460
cagcgaatac atactatgac ccgcagattt ttccaaaagg aaaggttcca atgtcaataa    134520
tgattgatga ccttttgtat ttttggtatt ttggcggaaa aaatttctat tatcataata    134580
cccgtgatgg ttctggtact gatgattatg aaatagaaac tccaaaagct gaagattgtt    134640
catcctgtaa attatgatat aatttgactc acggacgagt caccaactat taactaagcg    134700
gaaaatttat gagcacagtt tttaatacaa atccagttga tgtttttaaaa gaacctatgt    134760
tttttggttc aggtcttggt attgcgcgtt atgatattca acgccataaa gttttgaag    134820
atttgaccga aaagcaatta tcattttttct ggcgtcctga agaagtaaac ttaatgatgg    134880
atgctgcaca gtttaataag cttcctcaat atcagcagaa tatttttact aataatctga    134940
agtatcaatc acttctagat agcattcagg gtcgtgcacc gtctgctgta cttatgtcat    135000
tgatttcaga cccaagcctt gatacatggg ttgctacatg gacttttagt gaaactattc    135060
acagtcgttc atatactcat atcatgcgaa atctttatac tgatccatcg aaggtatttg    135120
atgaaattgt attagatgaa gctattatga acgtgctgaa atcattgga cgttattatg    135180
atgatgttct gattaaaact cgttattggg aaaacgctaa agctgatatc gaataccaaa    135240
aagaaattaa tgcagacgaa gacgttattg aagatgctat tgagcatgag acatattgga    135300
agcgtgagct aatgaaatct ctttacctct gtttgcatgt aatcaacgca ttggaagcta    135360
ttcgttttta tgtatctttt gcatgtacct ttaacttcca taagaacatg gaaatcatgg    135420
aaggtaatgc caagattatg aagttcattg cacgtgatga gcagcttcac cttaaaggca    135480
cccaatatat tattcgtcaa cttcaacttg gcactgatgg cgatgaatgg gttaaaattg    135540
ctcaagagtg tgaacaagaa gcagttgata ttttcatgga agttaaccgc caagaaaaag    135600
```

FIG. 17UUU sequence.txt

| | | | | | |
|---|---|---|---|---|---|
| attgggcagt | tcatttattt | aaagatggtg | atgttcctgg | attaaataca | aatagcatgt | 135660 |
| ggagctttat | tgattactta | actgtatctc | gtatgaagca | gtgtggtctt | ccatgcccaa | 135720 |
| ttaccgatgc | tccggttaaa | catccatatc | cttggattcg | tgaatatctt | aattctgata | 135780 |
| atgttcaatc | tgcgccacaa | gaagtagaat | tgtcatctta | ccttgttgca | cagattgata | 135840 |
| atgatgttga | tgataaagtt | atgatgagtt | ttaaaaaata | cttttaagga | gtgggccgca | 135900 |
| aggcccattt | tattatgaaa | gaaattgcaa | cagaatattc | atttattaaa | tatactgagc | 135960 |
| tagaattaga | ctacaacgga | agtataaaac | aattatctat | tccaaacaag | tataacgtaa | 136020 |
| tttatgctat | tgctataaat | gatgaacttg | tttatattgg | aaaaactaaa | aatttacgca | 136080 |
| aaagaataaa | ctattataga | actgctatta | accgtaaaga | caaaacgtct | gattctacta | 136140 |
| aatctgcatt | aattcatgct | gcgctaaagg | aaggaagcaa | agttgaattt | tacgcccgcc | 136200 |
| aatgttttaa | tctttctatg | acaaatgagt | taggtacaat | gacaatcgcg | acgattgacc | 136260 |
| tagaggaacc | actattcatt | aagctgttta | acccgccttg | gaatattcaa | cataagaaaa | 136320 |
| aatgatgctt | ccacatggag | tgtggtacta | tattcaaaac | acaaagagg | atacacaatg | 136380 |
| caagaacttt | ttaacaattt | aatggaacta | tgcaaggatt | cacagcgtaa | gttttttttac | 136440 |
| tcggatgatg | taagtgcgtc | tggaagaact | tacagaattt | tctcatataa | ttatgcatct | 136500 |
| tattctgatt | ggttacttcc | agacgcattg | gaatgtcgtg | gaatcatgtt | tgaaatggat | 136560 |
| ggagaaaaac | cagtaagaat | tgcttctcgt | cctatggaaa | agtttttttaa | cttgaatgaa | 136620 |
| aatccattca | cgatgaatat | cgatttaaat | gatgttgatt | acattctaac | aaaagaagat | 136680 |
| gggtctttgg | tatcaactta | tttagacggt | gatgaaattc | tgttcaaatc | aaagggttca | 136740 |
| atcaaatccg | aacaggcttt | aatggctaat | ggtattttga | tgaatattaa | tcaccatcgg | 136800 |
| ttgcgtgata | gacttaaaga | attagctgaa | gatggattta | ctgctaactt | cgaattcgtt | 136860 |
| gctccgacga | atagaatcgt | tcttgcttac | caagaaatga | aaattatttt | actgaatgtt | 136920 |
| cgtgaaaacg | aaacgggtga | atacatttca | tatgatgata | tttataaaga | tgctgctctt | 136980 |
| cgtccatatc | tagttgaacg | atacgaaatc | gatagcccta | aatgggtaga | agaagctaaa | 137040 |
| aatgcggaaa | acatcgaagg | ctatgttgct | gtgatgaaag | atggttctca | tttttaaaatt | 137100 |
| aagtctgact | ggtatgtgtc | tcttcatagc | acaaaaagtt | cattagataa | tccagaaaaa | 137160 |
| ttgtttaaga | ctattattga | tggtgcatca | gatgatctta | aagcaatgta | tgctgacgat | 137220 |
| gaatattcat | acagaaaaat | tgaagcattt | gaaacgactt | atctgaagta | cttagaccga | 137280 |
| gctctgtttt | tagttcttga | ctgtcataat | aagcattgtg | gtaaggatag | aaagacttat | 137340 |
| gcgatggaag | cgcaaggtgt | tgctaaaggt | gctggaatgg | atcacttgtt | cggtatcatc | 137400 |
| atgagcttat | accaggggta | tgatagtcaa | gagaaggtta | tgtgtgaaat | cgaacagaat | 137460 |

FIG. 17VVV sequence.txt

| | | | | | | |
|---|---|---|---|---|---|---|
| tttttgaaaa | attataaaaa | atttatccca | gaaggatact | aagctgttta | caagtccctc | 137520 |
| gtgttgtgtt | acagtagtct | tactgacata | acatgaggac | tttatgatgg | atttgcagct | 137580 |
| cattactact | gaaatggtcg | ttgaagcata | cggtgatact | acagatggga | tttctgtatt | 137640 |
| taaaggaaac | cgtcgagttg | gatatatcac | cgatcttaag | aaagatttag | ctaagcaagt | 137700 |
| caagcggaaa | acgaccatta | aagaatatcg | aaatcgtcgt | cttgagcaag | cccgtgatat | 137760 |
| gcttcctgat | gcggttgaag | agatgaaagt | cttttagaa | aatcagcttg | cgaaatatga | 137820 |
| ttgtgatgta | tttattaatc | agactcaacc | taatgttcat | atcaatagtt | gtaaatgcta | 137880 |
| tatcatcgtt | aatcctttga | ctggaaagca | tcgtcttgga | attagtaatc | caaatcgtag | 137940 |
| tgcatcggat | atggcagaag | atgttgaggc | atgctttaaa | atttctaaat | ctccagctga | 138000 |
| acatcatatt | ttaattaacg | gtctttctca | agacgatatt | atagaggtta | ttaaaacttt | 138060 |
| atgcatgtaa | gtaattttac | agctggattg | ctattacttg | taatagcatt | tggcggaaca | 138120 |
| tctattattt | taaaaaataa | ggtagaaaga | ttagaaacat | cagttactga | aattacaaaa | 138180 |
| acagccaatg | aaaacgcctt | agcattaaat | aatttgcgaa | ttcagtataa | ttatattgat | 138240 |
| gcgatgaata | ataaaaatcg | tgaggcaatt | gctgctattg | agcgtgaaaa | tgaaaaactg | 138300 |
| cgcaaagacg | caaagaaggc | ggatgtggtg | gctcataagc | caggattggt | tgaaaaacaa | 138360 |
| atcaacaact | ccttcaacaa | gttcgcagaa | gacatccagg | accttctaa | atgattaaac | 138420 |
| tatcagcagt | aatattatct | attggtcttc | tagttggttg | ttcgacaaag | cctctagaag | 138480 |
| taaagaaaga | aacagttcat | cctaattggc | ctgtgcaaat | aaagtcatat | gacgaagcta | 138540 |
| aactatcttg | gcaagttaaa | gttattgatg | gtaaagcttg | ggtaggtatg | ccatttgaag | 138600 |
| attctcagga | atttcgtatt | tggcttaatg | atgtaaaacg | atatgtacat | gaccagaaaa | 138660 |
| ctatgatatg | ttattatcgt | caagagctaa | aagaggataa | atgtaaatga | tttcatggta | 138720 |
| tcaatttgaa | catctaaaag | gattaattta | tgaatccgag | atggctgcaa | tgatttatgg | 138780 |
| acgacagatt | caacgattag | aatctttacc | tccaactaat | gatgttttat | tagctcaatc | 138840 |
| acgtgctaat | ctcaaaaatg | aatatcaaaa | taagtggggt | aaagcatcta | aagacttgca | 138900 |
| tgattatatt | caatcattag | ttgagaaaaa | taaatgaaaa | ctctgctaga | acgttatatt | 138960 |
| gaatgctcgg | accgttacat | tgatgtatgc | catgacaatg | catcaagcat | tagcgaagac | 139020 |
| attgaacatg | ctaaagcttt | agatgatgct | ggtaaagccc | tacgaaaaga | agcaaaagct | 139080 |
| cgtgggtttg | atatgtatca | gcttaaaaat | cacatgataa | aatttatttc | atctaatgtt | 139140 |
| cagagcaaat | cggtgaatca | atcaacagct | gaattatata | aagggcggcg | tgagcataat | 139200 |
| attcgtattc | ttgaagtttt | cttaggaatt | aaatgatgaa | aaagattatt | ttgactattg | 139260 |
| gctgtcctgg | ttctggtaag | agtacttggg | ctcgtgaatt | tattgctaaa | aatccagggt | 139320 |
| tttataatat | caatcgtgat | gactatcgcc | aatctattat | ggcacatgaa | gaacgcgatg | 139380 |

FIG. 17WWWW sequence.txt

| | | | | | |
|---|---|---|---|---|---|
| agtacaagta | taccaaaaat | aaagaaggta | tcgtaactta | catgcagcat | gatgttgcta | 139440 |
| acatgattct | ctgccaagac | gcaacgaagg | gtgtaattgt | ttcagatact | aatctgaatc | 139500 |
| ctgaacgacg | taaggtttgg | gaagagtttg | ccaaagagct | tgggcatcaa | attgaatata | 139560 |
| aagtgtttga | tgttccttgg | actgaattgg | ttaaacgtaa | ctcaaaacgc | ggaactaaag | 139620 |
| cagtaccaat | tgatgtttta | cgctcaatgt | ataaaagcat | gcgagagtat | ctcggtcttc | 139680 |
| cggtatataa | agggactcct | ggtaaaccaa | aagcagttat | ttttgatgtt | gatggcacgt | 139740 |
| tagcaaaaat | gaatggtcgt | ggtccttatg | accttgaaaa | atgcgatatc | gatattatta | 139800 |
| atccaatggt | cgttgaacta | tccaagatgt | atgctcttat | gggttatcaa | atcgtagtcg | 139860 |
| tttcaggccg | tgaaagtgga | accgaagaag | atccaacgaa | atattatcgt | atgacccgta | 139920 |
| aatgggttga | ggacattgct | ggtgttccat | tagtcatgca | gtgtcaacgc | gaacaaggcg | 139980 |
| atacccgtaa | agatgatgta | gttaaagaag | aaatttctg | gaaacacatc | gcaccacatt | 140040 |
| ttgatgtgaa | attagctatt | gatgaccgaa | ctcaagtagt | tgaaatgtgg | cgccgcatcg | 140100 |
| gtgttgaatg | ctggcaagtc | gcttcgggag | atttttaatg | gcttggcacc | atgaaacttg | 140160 |
| ggctttgtta | ttgtaaatag | cggtttagtt | ggtactagta | atgggcaatt | ttgtgtatt | 140220 |
| actagtgaaa | atagagcatg | ggaggaatgc | cttaaattaa | gagaaaagaa | tcctgatgtt | 140280 |
| gaactagtag | taaagaaaac | taaactgcct | ttaccatgga | aaacgtatga | ataacctaga | 140340 |
| aaagatttat | cgtctttgtg | ataaaattga | aaaagaaaag | aaatatctat | tttgtctatg | 140400 |
| gcctattgtt | gacggaagag | taggcctaga | tgttcttgat | tatgaaacag | aagacaaagt | 140460 |
| agatggcgca | acttttgata | cgctttggga | tgttattgat | tggctcgaag | aaaattatgt | 140520 |
| gaggtaaata | tgtttccgac | ttactctaaa | atcgtagaag | tagtgtttag | ccaaattatc | 140580 |
| gctaataaca | tgtttgaaaa | gcttgataat | gcagctgaac | ttcgaatcca | cgctcaagtg | 140640 |
| actcatgtat | tgaacgcttt | gcttccagac | caggtggatt | ctattgccat | tacgttgtat | 140700 |
| ccaggttccg | cgcatatcat | tgttgtattt | ggtcttgatg | ctgagctagt | tatcaaaggc | 140760 |
| gacattcgct | ttgaatcaca | gacatcagaa | ttcaaagcaa | tttaatagtt | tactttacgg | 140820 |
| tagagttgtg | atattatagc | tctaccaaaa | caaatgagga | aattgaaatg | agcgaatggt | 140880 |
| ttgaagaaga | taaggtttat | cgcttaaaag | ctggatataa | agatatttt | aatgaaactt | 140940 |
| gcggggctaa | taaacgaatt | gcccagttta | ttggggaaaa | ttcatttaaa | gtaaaaatag | 141000 |
| atcctgcgaa | aaatgttatt | agcattaaac | gtgaaattga | tgattgttgg | tataaagctg | 141060 |
| ttgatgtaat | gggtgaatcc | tataaagtta | gcccgttatt | ttcaattgct | tatatgttag | 141120 |
| aatattcttt | tttcgaagaa | gttcaaaaag | atgattctgt | aagtaaattt | gaaattaaaa | 141180 |
| ctgataaaga | aattaagtgg | aaagtagtag | gtattactgg | ttgtatgttc | tatatctatg | 141240 |

FIG. 17XXX sequence.txt

| | | | | | |
|---|---|---|---|---|---|
| ctcaaactga | tacgaaggaa | gaagctaaaa | agaaagctct | agaatatctt | gaagagcatg | 141300 |
| aagaaggtcc | ggtaatgatt | acccaagatg | ctgaattagt | ttctgtcaaa | ttagttaaaa | 141360 |
| atgttgaaag | taaggagcta | ggatcaacat | gctaagcgaa | aaaccaatta | ctgttaaaga | 141420 |
| attccaagaa | aaagttaaac | tatttgctca | agaattggta | aataaggttt | ctgaacgatt | 141480 |
| tcctgaaacg | tcggttcgtg | ttattaccga | aactcctcgt | tcagtattag | taattgtgaa | 141540 |
| tccaggtgat | ggcgatcaaa | tatcgcatct | taaactggat | tttgatggat | tagttgaagc | 141600 |
| acaaagggtg | tatggcgtac | tatgatgaat | ttaactgata | taattgataa | ttgtcttgaa | 141660 |
| aatgatactg | gcgatcatag | agcgcttgat | tctgaaacag | cacagttcat | tagaataact | 141720 |
| ttaatgaatg | atactctggt | gaatagtatt | catccttctg | tgtatgatgc | tattattgtg | 141780 |
| acgaagtatc | cggttgagct | tcacaaaaag | atgactggcg | cagtttttat | tgataagaaa | 141840 |
| aaccgcttta | aagatgggca | gaatataact | agttctgtta | ttaaaagtat | aactaaactt | 141900 |
| cgtcacgaaa | tttatcgtgt | tgaaactgct | aaatctgctt | atctggtgat | tatgaaatga | 141960 |
| aagcgagtac | agtacttcaa | attgcatatt | tagtatcaca | ggaatcaaaa | tgttgctcct | 142020 |
| ggaaggtagg | agcagtaatt | gaaaagaatg | gacgtattat | ttctactggg | tataatggtt | 142080 |
| cacccgcagg | cggtgtgaac | tgttgtgatt | atgctgctga | gcaaggttgg | ttgctgaata | 142140 |
| agcctaaaca | cactatcatt | caaggccata | agcctgaatg | cgtatcattt | ggttcaactg | 142200 |
| atcgctttgt | cttggcgaaa | gaacatcgta | gtgctcactc | ggaatggtca | tctaaaaatg | 142260 |
| aaattcatgc | tgaactaaat | gcaattttgt | ttgctgcacg | aaatggttct | tctattgaag | 142320 |
| gcgctactat | gtatgtaaca | ctttctcctt | gtccggattg | cgcaaaagcg | atagctcaat | 142380 |
| ctggtattaa | aaagctggtt | tattgtgaaa | catacgataa | aaataaacct | ggctgggatg | 142440 |
| atattctgcg | aaatgcaggt | attgaagtgt | ttaatgttcc | taagaaaaac | ttgaataagt | 142500 |
| taaactggga | aaatatcaac | gaattctgtg | gtgaataatg | aaatttcgtt | tggtaaagct | 142560 |
| cacagcaatt | agttcttatt | ctaacgagaa | catctcattt | gctgtagagt | ataagaaata | 142620 |
| tttttctct | aaatggaaac | agtattataa | aactgattgg | actagtattg | ataggccata | 142680 |
| tagttggaaa | tctgatttag | aaaaatgcca | aaaattactt | tccactctta | aagaacgtgg | 142740 |
| aacaactcat | attaaaactg | taataggtaa | atgaatgaaa | ctgacgactg | aacagaaagt | 142800 |
| agcaattcgt | gaaatttga | aaactaaatt | gtccatgggt | atttcaaacg | tagttttga | 142860 |
| aaagtctgat | ggtactattc | gtattatgaa | atgtactcgt | gatgcagact | ttatgccaac | 142920 |
| catgcaaact | ggtaaattga | ctgaatctac | tcggaaagaa | tctactgata | tgattccagt | 142980 |
| atttgatgtt | gaacttggtg | cgtggcgagg | tttttctatt | gacaaattga | tttccgttaa | 143040 |
| tggtatgaaa | gttgagcatt | tgctccaatt | tattggtaaa | taaatgcttt | aagaattatt | 143100 |
| tgttattatt | aattcatctg | ttaacaaaaa | ggaaaaacga | tgtctgaagt | acaacagtta | 143160 |

FIG. 17YYY sequence.txt

| | | | | | |
|---|---|---|---|---|---|
| ccaattcgtg | ctgtcggtga | atatgttatt | ttagtttctg | aacctgcaca | agccggtgat | 143220 |
| gaagaagtta | cagaatcagg | acttattatt | ggtaaacgta | tccaaggcga | agttcctgaa | 143280 |
| ctgtgtgtag | ttcactctgt | cggtcctgat | gttcctgaag | gtttctgcga | agttggtgat | 143340 |
| ttgacttctc | ttccagttgg | tcaaattcga | aatgttccgc | atccttttgt | agctctgggt | 143400 |
| cttaagcagc | caaaagaaat | taaacaaaaa | tttgttacct | gtcactataa | agctattccg | 143460 |
| tgtctttata | agtgatataa | ataataatat | gaattgggtg | tcggaataat | aagttaaccg | 143520 |
| aacaattcta | tgtggtagtc | tacaactgag | agatctgtcg | aaagaagatg | aaattcagaa | 143580 |
| gaacgtgact | accgagtttt | aatctctaac | gagaattttt | aaatgattaa | acaattacaa | 143640 |
| cacgctcttg | aactgcaacg | aaacgcatgg | aataatggtc | acgaaaacta | tggcgcatct | 143700 |
| attgatgttg | aagccgaagc | tcttgaaatc | ctgcgttatt | tcaaacatct | gaatcctgct | 143760 |
| caaactgcat | tagctgctga | gcttcaggaa | aaagatgaac | ttaaatatgc | taagcctctg | 143820 |
| gcttctgctg | cacgaaaagc | agttcgtcat | tttgtggtaa | cactgaagta | atttattgga | 143880 |
| gattcactgc | cttagtgtga | gctaaatcga | ggagccgtcg | aactgtctga | ttaatgattt | 143940 |
| gcgaatcatt | atagttttaa | gaccccggca | gttttacggt | gtacctcttg | aatgttattt | 144000 |
| tatagcggca | agtgcatgct | accccgaggt | gatggccaat | cgggagtacg | cctcaaggcc | 144060 |
| tatatatcca | tcagtatata | tcttatcctc | gagtaatcgg | acccggaacc | tttaagctaa | 144120 |
| cggtgtgcaa | cagataagag | ctataaggta | tgttgacgag | gtttatggtt | atcctgtcgg | 144180 |
| taaatattca | aaacctaagt | accccttga | gggattgcgc | aggcaatgcc | aataagtcct | 144240 |
| gcattttcat | ttaaaagaga | atttataatg | gcaaaacaag | ttaaagcaaa | gaaagcagtt | 144300 |
| gaaaagaaag | ttggtgattc | taaacgcgct | ggctacaagc | gtgggtcgaa | ctctcgtatc | 144360 |
| aatcaaactg | ttgagaagat | catgcgccga | gcacgtgcgg | ttcttcgaga | tgatgcttct | 144420 |
| cgttttggta | agcagaaagc | ataagttgag | gactccttcg | ggagtccttt | tttattttcc | 144480 |
| aaagattgca | caaagttgtt | tacagtacgg | ttcctttgtg | atagtattat | cttacacaaa | 144540 |
| caaaggagaa | taaaatgaac | tacatcaact | ttgaacgtaa | atatgtttct | aatggtattg | 144600 |
| caggttctat | tgatactatt | tgtctctgga | aacatcaaaa | cggatcagta | tgcgaaatcg | 144660 |
| atcagtatat | gactcctaat | tacgtttata | tgcgatttga | aaatggcatc | acggtttcaa | 144720 |
| tcactaagga | aggttccaac | tttaaaatcg | ctctagatga | tgatttccgt | gaacgcgatt | 144780 |
| tagggactca | tccttgttgg | aatggcgttc | atcgcaagct | tctgattaaa | acttggattc | 144840 |
| gtcatattct | gagtaacaaa | gctaaacctg | agcatcttga | agcaatcttt | gatgtagttc | 144900 |
| ttaacgaatt | tgatatttaa | gcttcggccc | cttactgagg | aaaatattat | gtttatgact | 144960 |
| acttattttg | atacccgcaa | aaatttctgt | gaagttgttt | tctcaaaggc | gcctaaagac | 145020 |

FIG. 17ZZZ sequence.txt

| | | | | | |
|---|---|---|---|---|---|
| cttcctgcac | atttgcaacc | taccagtgaa | tcgattaaaa | actacgttaa | tgtagtctgc | 145080 |
| cctttagagt | tccgtactgt | aaatgggcgc | gatactttag | ctatcactaa | actcaatcgc | 145140 |
| gaaattgaca | ttgatccctc | aattgcacgt | gaaattaata | gttctgatat | taatggcggt | 145200 |
| aatgttaaat | cgcacggttt | tcagatgagg | ttttaatgaa | attcttttta | ggtcaaactg | 145260 |
| ttgaattaaa | gggagttggt | atacctggat | taatttctaa | ggttctacct | ccgtttaaat | 145320 |
| ggagtggtat | tcaaataaaa | gaggcttata | ttgtttcttg | ggtagatgga | aatgaagacc | 145380 |
| ttcgtatggg | cgatgaatta | tctcctatct | acggattaaa | ggaattagta | tgaatataat | 145440 |
| taataagatt | tttggaattc | agtacattaa | ggtcacatat | aaagtaacag | ataaaaatcc | 145500 |
| gtatactgat | gaacacgaag | aaccgcaagt | taagtctatt | atattagaaa | aaggcagtga | 145560 |
| ctggccagtt | gaatttcgtc | taccaaacta | tggtcattgg | gctgatgttg | aaattataag | 145620 |
| cattgaaaat | gtctgagtta | gagattagaa | gcaattttaa | atggccatca | tgtgcattaa | 145680 |
| gtaatttcgc | ccaatggcct | ttcgttatgg | atggtattca | atttggaggt | cttgaaggat | 145740 |
| tcctccaagg | atgcaaggtg | aaaaatgttg | aacaacaacg | tcgtatattt | gggttatccg | 145800 |
| ggcttgccgc | ccaacaagct | ggaaggtctt | atgctagagc | tcaggaccgt | gggaccctct | 145860 |
| tctggcttgg | agttccgttt | tcaagatact | ccccagcatg | gaaagaatta | tacacaaatg | 145920 |
| catattttga | agcagcgatc | caaaacaagg | gctttcgtga | tgcattacac | gcctcgaaag | 145980 |
| gaaaagtttt | gaagcacagc | atggctagtg | gtctaacaaa | agatgataca | atattaaccg | 146040 |
| aagctgaatt | tattgatgtg | ttaaacctat | taagagactc | tctatgaagc | ctactatttt | 146100 |
| aactgatatt | gatggagtat | gtttaagctg | gcaatcaggc | cttccttatt | ttgctcagaa | 146160 |
| atataatctt | ccgttagaac | atattttaaa | aatgatccaa | gatgagaaat | ttatttctcc | 146220 |
| aggtaaactc | tttaattgtg | acgaagaact | tggcgtcaag | ttaattgaaa | aatacaatcg | 146280 |
| ttcagatttt | attcgttact | tgtctccata | taaagatgct | ctgtgtgtaa | ttaacaaatt | 146340 |
| aaaagaagat | tataatttttg | tagctgttac | agcattgggt | gattctattg | acgctctgct | 146400 |
| gaatcgtcaa | tttaatttga | acgctctttt | tcctggtgcc | ttctcagaag | tactgatgtg | 146460 |
| tggtcatgat | tcttcaaaag | aagagttgtt | taaaaaggca | aaagagaaat | ataacgtgat | 146520 |
| ttgttatatt | gacgatctcg | ctcaccattg | cgatcatgcg | agtgaaatat | taaatgttcc | 146580 |
| tgtttattgg | atggctcgag | gggaacgtga | cagtattcca | aaaactgcac | agcgagttta | 146640 |
| tacatggaat | gatgtagaaa | ataagctttt | ttcaccaaag | gaaaataaag | aaagtttgta | 146700 |
| tagtgaaaaa | gctataaaag | atgtaattga | gaagatgatc | aaaaacgatt | cttttccttg | 146760 |
| gaacactacc | tggagaactc | ctggatttaa | tccttataat | catctatatc | atccatatca | 146820 |
| gacacatccg | tttcagacat | ggaactatat | taaacctggt | ggcatagagt | atttgtataa | 146880 |
| tagacctact | agtggtgata | atattttcca | aggagcattc | taatgtttgt | tgttcatact | 146940 |

FIG. 17AAAA sequence.txt

| | | | | | | |
|---|---|---|---|---|---|---|
| atttatgaaa | atgaaggtaa | tactacacgt | gattacggtc | acgtaaatca | attttttaga | 147000 |
| tgcaatccag | aattccgagc | tcaaaaagac | gaacgaattt | ttaaaaaatg | tgtagagcaa | 147060 |
| ggtttcattt | acgtcaagca | ctggatgcaa | ggaaataaag | ttagaaccac | gtaccacagg | 147120 |
| tctttgactg | agcttaatga | tgaattgatt | tataatagag | ctgtaaacca | aactctaaag | 147180 |
| gatgaacaat | gattcttaaa | attctgaacg | aaatagcatc | tattggttca | actaagcaga | 147240 |
| agcaagcaat | tcttgaaaag | aataaagata | atgaattgct | taaacgagta | tatcgtctga | 147300 |
| cttattctcg | tgggttacag | tattatatca | agaaatggcc | taaaccgggt | attgctaccc | 147360 |
| agagttttgg | aatgttgact | cttaccgata | tgcttgactt | cattgaattc | acgttagcta | 147420 |
| ctcggaaatt | gactggaaat | gcggcaattg | aggaattaac | tggatatatt | actgacggta | 147480 |
| aaaaagatga | tgttgaagtt | ttgcgtcggg | tgatgatgcg | agaccttgaa | tgcggtgctt | 147540 |
| cagtatctat | tgcaaacaaa | gtttggccag | gtttaattcc | tgaacaacct | caaatgcttg | 147600 |
| caagttctta | tgatgaaaaa | ggcattaata | agaatatcaa | atttccagcc | tttgcccagt | 147660 |
| taaaagctga | tggagctcgg | tgttttgctg | aagtcagagg | tgatgaatta | gatgatgttc | 147720 |
| gtcttttatc | acgagctggt | aatgaatatc | taggattaga | tcttcttaag | gaagagttaa | 147780 |
| tcaaaatgac | tacagaagct | cgccagattc | atccagaagg | tgtgttaatt | gatggcgaat | 147840 |
| tggtatacca | tgagcaagtt | gaaaaggaac | cagaaggcct | agattttctt | tttgatgctt | 147900 |
| atcctgaaat | tagtaaagct | aaagaattcg | ccgaagtagc | tgaatcacgt | actgcatcta | 147960 |
| atggcatcgc | caataaatct | ttaaagggaa | ccatttctga | aaaagaagct | caatgcatga | 148020 |
| agtttcaggt | ctgggattat | gtcccgttgg | tagaaatata | cggtcttcct | gcatttcgtt | 148080 |
| tgaaatatga | tgtacgtttt | tctaaactag | aacaaatgac | atcaggttat | gataaagtaa | 148140 |
| ttttaattga | aaaccaggta | gtaaataacc | tagatgaagc | taaggtaatt | tataaaaagt | 148200 |
| atattgacca | aggtcttgaa | ggtattattc | tcaaaaatac | cgatggattg | tgggaaaatg | 148260 |
| ctcgttcaaa | aaatctctat | aaatttaaag | aagtaattga | tgttgattta | aaaattgtag | 148320 |
| gaatttatcc | tcaccgtaaa | gaccctacta | aagcgggtgg | atttattctt | gaatcagagt | 148380 |
| gtggaaaaat | taaggtaaat | gctggttcag | gcttaaaaga | taaagccagt | gtaaaatcgc | 148440 |
| atgaacttga | ccgtactcgc | attatggaaa | accaaaatta | ttatattgga | aaaattctag | 148500 |
| agtgcgaatg | caacggttgg | ttaaaatctg | atggccgcac | tgattacgtt | aaattatttc | 148560 |
| ttccgattgc | gattcgttta | cgtgaagata | aaactaaagc | taatacattc | gaggatgtat | 148620 |
| ttggtgattt | tcatgaggta | actggttat | gaaagcttac | ttagaaacaa | ttgtcgtggc | 148680 |
| tcaaaaagaa | ggtggagatg | tttctacttc | tgtatcacaa | gtcattctcg | aatttgtaga | 148740 |
| tgcatacgct | tataataaat | ttacagaaac | atttgatgcc | tatgaaaaag | gaccaaagtt | 148800 |

FIG. 17BBBB sequence.txt

| | | | | | |
|---|---|---|---|---|---|
| tgaaatatat | cgtactctct | taccactaga | ttactaaagg | ccttcgggcc | tttaatttta | 148860 |
| taaatagaat | aaacactaga | gaggctatga | tggaacttat | tacagaatta | tttgacgaag | 148920 |
| atactactct | tccgattaca | aacttaaatc | caaagaagaa | aataccgcaa | attttttcag | 148980 |
| ttcatgttga | tgatgcaatt | gaacagccag | gctttcgttt | atgtacatat | acatctggag | 149040 |
| gtgatactaa | tcgcgattta | aaaatgggcg | ataaaatgat | gcatattgtt | ccttttacat | 149100 |
| taactgctaa | aggttcaatt | gctaaattaa | aaggtcttgg | tccaagccca | attaattata | 149160 |
| tcaattcagt | ttttactgtt | gcaatgcaaa | caatgcgcca | gtataaaatt | gatgcttgta | 149220 |
| tgcttcgtat | tcttaagtct | aaaaccgctg | gtcaagctcg | acaaattcaa | gttattgctg | 149280 |
| atagacttat | ccgtagccgt | tcaggtggca | gatacgtcct | tcttaaggaa | ctctgggatt | 149340 |
| atgataaaaa | gtatgcatat | attcttatac | atcgcaaaaa | tgtatcacta | gaagacattc | 149400 |
| caggagttcc | ggaaattagt | accgagctct | ttactaaagt | tgaatcgaaa | gtcggcgatg | 149460 |
| tttacatcaa | taaagatact | ggagctcaag | taactaaaaa | tgaggcaatt | gcagcatcta | 149520 |
| ttgcacaaga | aaatgataaa | cgttctgacc | aagctgtaat | cgttaaagtt | aaaatttccc | 149580 |
| gtagagcaat | tgcgcaaagt | caatcattgg | aatcttctag | atttgaaagt | gaattattcc | 149640 |
| agaagtatga | atctacagca | gctaatttta | ataaaccagc | tactgcacct | ttaattcccg | 149700 |
| aagcagaaga | aatgaaaatt | ggaattaatt | cattagcttc | taaaacaaag | gcagcaaaaa | 149760 |
| ttattgctga | aggaacggca | gatgaacttc | actatgatta | taaattcttt | ccaatgagtc | 149820 |
| aagtcggtga | agtttcagaa | aaaattaaag | aagtaatttt | taatgcaatt | aaaaatgaac | 149880 |
| caactacttc | aataaaatgt | ttagagaaat | acgcagcagc | tgctaatcaa | ctctttgaag | 149940 |
| aatataaaga | taattggctt | gataaacata | ataaaactcg | taaagggcag | ccagatgaag | 150000 |
| tctgggaaga | aatgactaaa | aattcctgga | acgcagcaaa | aactaaattc | ctcaaaagaa | 150060 |
| tgatttatag | ttttttctgga | attggtgcag | gtccaatgat | tgatattact | attgcccgtg | 150120 |
| atggttctaa | atatactcca | tcacaaaagc | gcggcattag | agagtattgt | ggttcagggt | 150180 |
| atactgacat | caataatctt | cttttgggtc | gttatgatcc | agaacgttat | gaagtaatga | 150240 |
| gtgaaaaaga | aattgaagct | gctataacta | atttagattc | tgcttttgaa | aatggtgatc | 150300 |
| gtataccaga | aggcattaca | gtttatcgtg | ctcaaagtat | gactgctcct | atatacgaag | 150360 |
| cactagttaa | aaataaagta | ttctatttca | gaaattttgt | atctacttct | ttaactccta | 150420 |
| tcatttttgg | acgttttgga | attacacatg | ctggtattgg | tcttttagaa | ccagaagctc | 150480 |
| gcaatgaatt | aacagttgat | aaaaatgaag | aaggaataac | tattaatcca | aacgaaataa | 150540 |
| gagcgtataa | agaaaatcct | gaatacgtta | agttcaaat | aggatgggca | attgatggag | 150600 |
| ctcataaagt | taatgttgta | tatccaggaa | gtctcggaat | agcaacgaaa | gctgaagtta | 150660 |
| ttctaccgcg | tggattgatg | gtcaaagtta | ataaaataac | tgatgcttct | aataatgacg | 150720 |

FIG. 17CCCC sequence.txt

| | | | | | |
|---|---|---|---|---|---|
| gaacaacatc | taataataca | aaactcattc | aagctgaagt | tatgaccacg | gaagagctca | 150780 |
| ccgaatcggt | aatctatgat | ggagaccatt | taatggaaac | tggtgaattg | gttgcaatga | 150840 |
| caggtgatat | tgaaatagaa | gacagagttg | actttgcatc | atttgtttca | tcaaacgtta | 150900 |
| aacagaaagt | agaatcatct | cttggaatta | ttgcgtcttg | catagatatt | acaaacatgc | 150960 |
| cttacaagtt | cgttcaagga | taaatcatgg | aacttattac | agaattattt | gacggcgctt | 151020 |
| cggcgccggt | tgttaactta | aatcctaagc | ataaaatacc | tcaaattttt | gctattcaag | 151080 |
| ccggtgaaga | aagcgtgctt | cctggattta | gattttgtac | atacacctct | ggcggtgata | 151140 |
| caaataaaaa | cgttaagccg | ggcgataaaa | tgatgcatat | cgtaatgata | ggtgtcaacg | 151200 |
| agaaattatc | gttagtcaag | cttagaaact | tgggtggaaa | tccaattggc | gtcattaatg | 151260 |
| ctgttttga | tactgctctt | caaacaatga | aacagtataa | aatcgacgca | tgcctattcc | 151320 |
| gcgtactaaa | aagtaaaaca | aatggcgcag | ctcgtcaaat | gcaagttatt | gctgaccgtt | 151380 |
| tagtacgtac | taaaggagca | ggtcgatatg | ttcttttaaa | ggaaatctgg | ggctatgata | 151440 |
| agaaatatgc | atatattatg | gtttaccgta | aaaatgccaa | tttagaagac | attccaggtg | 151500 |
| tacctcctat | ttcaactgag | ttattcacaa | aagttgaatc | aaaggttggt | gatgtttatg | 151560 |
| tagacgttaa | aacaggtaat | gctgttccta | aagctgtcgc | tgttgctgct | tctattgctt | 151620 |
| tagaaaatga | taagcgcacg | gatcaagctg | ttattcagaa | aactaaaatt | agtcgtcgat | 151680 |
| tagcagcaca | agctcaatat | tctactgttg | atgcttcact | tcagggtgat | agcttcgctg | 151740 |
| ctaagaaata | tcaagagttt | gaatctaaag | ttccggtata | taaagcagaa | ggtccgatga | 151800 |
| actctggcgt | tattcagatt | ggttcaaact | ttagcaaagg | agctatcggt | ggtatgagaa | 151860 |
| gtgcttctcg | ttttaaatct | aacgattatg | aactagaaag | tttccgaaat | catattgcat | 151920 |
| tagcccatgc | acgtttacgt | gatccatcta | tcaagttgca | gagcgatata | acatatcaag | 151980 |
| gttctcaaga | atatttaaag | aataaagaat | tctttgatta | taaaactgat | aaaattttaa | 152040 |
| gcgatcttgc | tgacattaat | atttctaata | gctttgatgt | tattaagaaa | attatcaatg | 152100 |
| atttagttaa | aggttctaaa | gctacaccag | atgaaaagac | agctattatt | caatttgtca | 152160 |
| tgaatggcat | ttataaattg | attaatgaat | ctgccgctca | ggcatatgaa | tacgcaagca | 152220 |
| ctgaagtaac | tccaaaagga | ttaactcagg | ctgagtctga | tgtaattgaa | gattattgtg | 152280 |
| cagattcata | tgttgaaatg | aactcgttcc | ttttaggtaa | acctgattct | acccgtgaag | 152340 |
| aatatatgga | acgagctatt | aaacacatcg | agacgttgga | ttctgcattt | gctaaaggtt | 152400 |
| cagttcttcc | tccaggaact | actctttatc | gtgggcaaga | agttaccttt | aaaactttgc | 152460 |
| gtcataacat | tgaaaataaa | atgttctatt | tcaagaactt | cgtatccaca | tcgcttaaac | 152520 |
| caaatatctt | cggtgagcat | ggtaaaaact | atatggctct | agatgattct | ggcgcagtat | 152580 |

FIG. 17DDDD

```
                                sequence.txt
tttctggtga aggagaaggt tccattgatg cagaagattt gatgcatatg ggtagtcatt    152640
ctacatatgt taatgaagat gctgaaacta gcgtgggtat ggtaattaaa ggagctgagc    152700
gaatcaaagt tatcgttcca ggtcatttat caggatttcc atcagaagct gaagttattc    152760
taccacgtgg aattttactg aagattaata aagtaagtac ttactttatg aaagaaactg    152820
cttataacaa gtatctaatc gaaggtacaa tcgttcctcc ttctgaacaa ttagaggaat    152880
cagtatatga tggcgatcat ttgatggaaa ctggtgaagt tcgtccaatg actggattta    152940
atcaattcct tgtagaagaa tcaaaagaag aggaaaacga agtttctcaa atcttagctt    153000
ctttggttaa catcaacgga atgtctaaaa agttcaaaat gtagtttaca agtccctcat    153060
gttgtgttat agtagtctta ctgacataac atgaggaaca caaatgaaa tcttctttgc    153120
gcttttttggg tcaagaactt gtagttgaag gcgttattcc tgctgataat gcttttaatg    153180
aagcagttta caatgaattt atcaaaattt ttggaacaga taaaaagttc ggaattttc    153240
cttctgaaaa tttttcaaag ccagaacaga ctgaaagtat tttccaaggt gtagtaacag    153300
gtaaatttga gtcagaagct ccggtaaaaa ttgaggttta tattgaagac agtttagttg    153360
cttcagttgc tgcttttatt tcattccgta ataaaaata tggggaccga aaggtcccca    153420
ttgttatatt gctcctaata ttttactttg cgaattgaca attcctgtca tagtattaat    153480
gtttgaaatg cttcctgcag ttccccctaa tctactgagt cgtgaaagcg aattagatag    153540
tccagtaaca cctccactat ttccgagaac gctttgaata ccatttatag cagcagattc    153600
aagccattca agcgcagctt gcctatcaac tgctccagcc tgcatcactc tatacgcaaa    153660
agtaacgtca aatgtagtta tttggttatc tccatcatat gataactcag gagcgctcac    153720
tgatattgga atgcatccag tgaacatcac cgcagtatga ggcaatccat tacgagaatg    153780
aagattaacc tgaatatctg cctcgacatc ctgtggcaaa gcacgcagtc cagttactgg    153840
gtcttgaacg gagttaaccc agtcttgcat tgcacgatag ttacaagctt ctgaatccat    153900
tctaaatgaa ataaccaaag ggtctaattc tctcccagtt atacgaatat taggagaatt    153960
atagttccag tcagtttcat aggataatct attctctggc attttacag agtatatcat    154020
caatccagat gagttatatg ccatgttaaa gaagtcaatt aaatatgtac caactgtaaa    154080
tgagcctaat aaactttgaa ctgtacgttg actcatggca ccaataagat atttactaac    154140
ccctgatttt cttatcagtt tttgtgtgcc agcagtaatt agcgtggtaa ttccctgatt    154200
aatatcacct tgagtcaatc ctaaccaatc tgaatttagg cccaagttat tataagaaaa    154260
gttgctaatt gaacttatca acgaagagct tttagttgat ggagttgttg caaaaacgca    154320
gctaaacata ttattacgtt ggaaatctgc gtttattgct tgattattaa attcctctaa    154380
agaatacatt aaaaagtccc cgcatataaa gaagcacggt ttaacgtgat aatttctctc    154440
atagtaatct cgagagtaaa tgtactaggg aggtttggag caatagctaa tccgttaaag    154500
```

FIG. 17EEEE sequence.txt

| | | | | | |
|---|---|---|---|---|---|
| ttaccattag | gtgttttgtc | aaatctgata | ctctggattt | gacatggacc | gaatatttcc | 154560 |
| gtttttccat | caaacttaga | tgttgcacca | aagtttttca | ccatccaaat | tgtcgggttt | 154620 |
| gaaactacaa | gaacgttagt | taaactcgat | gtcattttct | caaataacgt | cttattttta | 154680 |
| actgcatctt | ctggagttaa | cggctcaata | aaagtagaac | ggtaccactc | atctaaatat | 154740 |
| ccttttattt | cagcagcata | ttgagattta | ccagtttcac | cgtaagaaaa | atagttaaaa | 154800 |
| tactgataga | tattaataat | agccattaaa | tcttctgttg | agcgcggagt | caaatcccaa | 154860 |
| gtgaacactt | tagttctatt | ttcagcaccg | ccgtacatgc | ttctggctgt | cgtataaatc | 154920 |
| tgttcattat | tatcagccat | tataccttgt | gttatacttt | ccagcgctcc | aaatactgcg | 154980 |
| gttgaagcca | tattgcttag | cacaccagta | gcagtacctc | cacctttgt | aataagacta | 155040 |
| tcttgaacat | cattaaatct | atgtgatgac | gtatcgacgt | cagatttaga | tctaggtaaa | 155100 |
| agaatatttg | caacaggaac | tttacttatt | gttcctgaat | tattatctga | tattagtcca | 155160 |
| tttgatagtt | ttgatactgt | attactgata | gtgtttctgg | ctgtacgtaa | aatactcgaa | 155220 |
| gatgaagaag | agtagttaga | tctcatcgtt | ctaagacttc | cagaatccct | agatgacata | 155280 |
| ttgtatgcag | taaataataa | tccattctta | tatagatctg | ttacctggaa | gtcccctgta | 155340 |
| gtgtcattac | cactagcacg | cccagttgga | aactgggcag | tgtatgtttt | agttgctact | 155400 |
| tctgatttag | tactctgtcc | ggctgaaatt | ttctcaccgg | acttttaat | taaatcagca | 155460 |
| gttatttctt | taacaattgc | catattattc | cttaattaac | tccagtcgca | tcaaatacac | 155520 |
| caggagcagt | cgtgctcgtt | acgggtgtca | tattatgaac | gacagtattt | ttcttaataa | 155580 |
| cattattagt | attattgatt | gaaggagatg | cttgttgaat | aggagcttgc | tgtgctttgt | 155640 |
| tctttctat | tacctggact | tgttttgctt | ctggcgattt | agcagaagtt | tgaggtttgg | 155700 |
| cattaggctg | attttcttg | agctcttgat | aagtagcatc | aatttagaa | aatctagcag | 155760 |
| caagttcttt | tttaactgcc | ggtgaattat | ttaaatccgg | gtcatccatt | cgttttttaa | 155820 |
| ggtcttcata | ggcagcttca | actgatttaa | ccgttgagtc | tttactcata | tcagctgaat | 155880 |
| tagcgtattc | atcaaaacga | ttcatagcag | cacgagcttc | attagctttc | attaaagcaa | 155940 |
| ttttagcttc | ctccggagaa | agttgcttta | atttttcttc | ttcctctgct | ctctcttcat | 156000 |
| cagtcgttag | tgcttcttta | ttatcaacac | cacgaatcca | gttagatgca | cgagttttcc | 156060 |
| agttcgcaat | tttgtctagc | ccttttgcta | ttggaccaag | atcgtcattc | attcttttat | 156120 |
| attgataatt | tgcaactttt | tcttggtctt | ctttgctaag | agaagcattt | gtagtatttt | 156180 |
| ggaaattttc | tagtgctctt | ccttctactt | catcagcagt | atccttcata | ccaggaataa | 156240 |
| ctcgaagaat | tgccgcagat | aatttagcca | ttccaagttg | aataagctct | cctaaattaa | 156300 |
| aaagaacctt | tccaagtcct | tcgacaatag | ctactgtcaa | tccgccccag | tctccagctt | 156360 |

FIG. 17FFFF sequence.txt

```
cccacagctt cttaatttta tcaatagaac caaagatgct ctgtaataaa ggaccccacg    156420
ttccggtttc gctagagaat ttggtaaagt ttgtactaaa caaatcccat gcctgcgaaa    156480
atttatctga ccaatatttg aagtgaacca tcaacagatc tattccaaca acaacagcca    156540
atatcattgc agtcatttta gcagcttcaa tagcagcact aacggtatac ttaaataaca    156600
tgcttgatat tttatcacta attgaaatag atttcttaaa tccaaaatca acagtctttg    156660
ttaatttatc taaagcttga gataatttta agttaaatgc ttcttttttc tgtttttctt    156720
ctggcgattc ttgtttaggt tcaactggct gaggggtagg gaaaaaatca gcatcaggat    156780
cattattaac tgcttcagga gctggtaata aaggacccac ggattcagct gtatcgtcct    156840
caacaacttt aacaggaata gcgctttcaa ccgtagctaa actagttcct gtttgttgaa    156900
ttccggctgt ctggattttt tgctcgagta aactcgttaa tttatctaat ttacttccga    156960
gcgattcacc gatttcttta ttaatattat tgccaatttc gacagtttca gcaattaact    157020
cagaaccagc agtagtatca ctcactgcgc tttctacatt gtcaattgct ccaattattt    157080
cattcgattt ttcttcaaca gtttgagcaa ttaattcaga agcagcttga gcatcatcca    157140
atttcgtaga tatatcgtta agtccagata aagtgttaga agcggattta gccgcttcct    157200
gtgttggttt attatctgaa ataacttttc tacgcatcgt ttgcatttct tgtggctttt    157260
tcattcaaat aatccaataa tattgccaat tccggttatt ggaccattag ggccaggaat    157320
tgctaaagtt gtaaaaatat catttgccca ttttaaaacg aatgctggca tctcaagaaa    157380
attaatttct ttaacttcat cattgacctt aagcaagcat ttggataaca tatcgctcac    157440
cgttaaaaat tgttcaaatt ttccaggagg tctaaaataa aatgtatttc cttggtattg    157500
aaattctaat ctttggcaca cataaacatc attaatgtca taagtataac catctatttc    157560
tttacgagat ttaatctttc cattaaattc caataaatga atggaaacga atcaacttc    157620
tgccggtgat aaatttggac aaatagaatc aataagaagc tttaaatttt catcaggacc    157680
tttaacatct tttaaaatgt tataatgttt aagacccatc ttaggaatag aaacttcttt    157740
attacttatc ggaagaacta ctttcttcag tggtagtatc agtttttaaat tcatttttaa    157800
ccttaactgg gtcgattgtt tccagtttcg ttgcattagt gaacatatat agatgagtta    157860
cggaattatt atttgataat tcgtgaataa cttcatcaac gtaaaattct gttttaaatt    157920
ggttttact atcattaaaa ataattttaa cgccaggagt caagttaaaa ttaccgacag    157980
tagaacattt agcatagccg tcatattgcg ccatagtctg aagacgaata gcttcttcat    158040
atccatttct ataagtcatt tcagaataag cacctgacct tgacactaca atagagtttt    158100
caccctttcc tgtagtaatc attggtaatg aagaatctaa aaatgaatga gcatagatag    158160
tagcattttt cattggatca cgtttatgcg ggtttgattt agtcaaccaa acaaaatcat    158220
atgctaatgg atatttcaat tcttggacga attgacctat taaagttggc tcacctacaa    158280
```

FIG. 17GGGG sequence.txt

| | | | | | |
|---|---|---|---|---|---|
| tcattggata | tggttcttga | tttatcatca | tatcatagtc | catcatgtta | actcccatga | 158340 |
| tgtcttgcca | tacaaatacg | aacttatcgc | ttcctaccgc | tagagcaact | tctcttacat | 158400 |
| atgacaaata | gttttcaaat | gtgctagtcc | atggaatatc | aggaacataa | gcattaatag | 158460 |
| catttatcgc | tggagttaat | aatgtacgat | cttgataaat | tacgccaagc | atttccttta | 158520 |
| tagattcacc | ggcatcaggg | aaaaatggtc | taccaaattt | aagatttttct | atagaatgaa | 158580 |
| tagttcccaa | ttcaatagca | atgatgttat | caccttttga | atctacagat | acagaaaaat | 158640 |
| gcttacatcc | ataaattctt | gttttaacat | tattaatatc | gtttgcatta | gctacagaaa | 158700 |
| tctgaattat | ttcatttcca | tccattttg | tatggatatt | tttagaatca | taaaattgta | 158760 |
| gcattccttc | atttcgacca | taaagagaat | cccgcatagt | taatgtggta | atagtagcag | 158820 |
| ctaattcaac | aaatctatta | ttactccaag | cgtcataact | ctcaaataat | ttaacgctga | 158880 |
| gatttggata | tccaggacgt | tgtaacatac | tcattgatgt | ttatccttct | caatcagttt | 158940 |
| taatacgaat | ccgcgctcgg | caggaatcat | tttcattatt | gaatttaagc | tataattact | 159000 |
| ttttacaagc | gtgtgattaa | tttgataaaa | agtaaatatc | tcatctggat | taactaatag | 159060 |
| cttaaacaca | tctactatat | cagtgtattt | tttaatgtac | ttatcacaac | acgacatgtg | 159120 |
| caatgttaaa | ttaataggat | tcattgcatc | gagaattttt | tctaatgttt | ctatctcgat | 159180 |
| ggcgtcaact | agttctattt | gactggactc | gctaatttcc | ttccaatcat | accatatttc | 159240 |
| atctacttga | acagaatgaa | tattttcagt | aatcatcttt | gctttatttt | cataaaactc | 159300 |
| agaaggaaac | tttaatttaa | ttttaacatt | agctacatca | aaaacaggtt | cctttaattc | 159360 |
| ttttgatat | atttcaaatg | gaactgtctt | ttcttttta | cattttggac | atacaaatgt | 159420 |
| gactggtact | ttagttttac | ctattgaacc | tacaaatacc | tgcaaaaata | taaatggttg | 159480 |
| ccaagtcttc | ggatagtctc | caaaataatc | atcaattaaa | tcagtaatta | tttctttttg | 159540 |
| ttcttgtggt | gaccgatgtt | ctatatcgtt | tcgaactaac | aaaaaatctc | gataatcttc | 159600 |
| taccgtaaat | ggtttaaaac | gatgaacacc | atctggtaat | ttacaacgaa | taatgtttgc | 159660 |
| catagatgct | cctttattc | tatttataaa | tatgataaat | aaaggagcta | aatatgtatg | 159720 |
| aatacaaatt | tgatgtgaga | gttggttcta | aaataatcaa | ctgtcgcgca | tttactctta | 159780 |
| aagaatatct | agaacttatt | actgccaaaa | ataatggttc | tgtagaagta | attgttaaaa | 159840 |
| agctaatcaa | agactgtaca | aatgcaaaag | atttaaaccg | ccaagaatca | gaactattac | 159900 |
| tgattcattt | atgggcgcat | tctcttggtg | aagttaatca | cgaaaactct | tggaagtgca | 159960 |
| cctgtggaac | tgaaatacca | acccatataa | atctattaca | tacacaaata | gatgcaccag | 160020 |
| aagacctctg | gtatacactg | ggtgacatta | aaattaaatt | ccgatacccct | aaaattttg | 160080 |
| atgataaaaa | tatagcccac | atgatagtat | catgcataga | aacgattcat | gctaacgggg | 160140 |

FIG. 17HHHH sequence.txt

| | | | | | |
|---|---|---|---|---|---|
| aaagcattcc | agttgaagac | ttaaatgaaa | aggaactaga | agatttatat | tctatcatca | 160200 |
| cagagtcaga | tattgtagct | ataaaagata | tgcttttaaa | acctaccgtt | tatttggctg | 160260 |
| ttccaattaa | gtgtccagag | tgtggaaaaa | cccatgctca | tgtaataaga | ggcctcaaag | 160320 |
| agttctttga | gttactataa | tggcaaatat | taataagctt | tattctgaca | ttgacccaga | 160380 |
| aatgaaaatg | gattggaaca | aagatgtttc | cagatcgctt | ggattaaggt | caattaaaaa | 160440 |
| cagtcttttg | ggaattatta | caacaagaaa | aggttcaaga | ccgtttgacc | ctgaatttgg | 160500 |
| atgtgattta | tcagaccagc | tttttgaaaa | tatgactcct | cttactgctg | atactgttga | 160560 |
| gcgtaatatc | gaaagcgcag | taagaaacta | tgagccacgt | attgataaat | tagcagttaa | 160620 |
| tgtaataccg | gtttatgatg | attatacttt | gatagtagaa | atacgctttt | cagtcatcga | 160680 |
| taaccctgat | gatattgagc | agataaaact | acaactggct | tccagtaata | gagtataatg | 160740 |
| cttcacgtat | aaacgtggta | taatgaatct | aagtccatcc | aataacaatt | gaatagagaa | 160800 |
| caatatgaga | ttagaagatc | ttcaagaaga | attgaagaaa | gatgtgttta | tagattcgac | 160860 |
| taaattacag | tatgaagcag | ctaataatgt | gatgttatat | agtaaatggc | ttaataagca | 160920 |
| ttcaagtatt | aaaaaggaaa | tgcttagaat | tgaagcacag | aaaaaagttg | ctcttaaagc | 160980 |
| taaattagac | tactactcgg | gacgaggaga | tggtgatgaa | tttagtatgg | atcgttacga | 161040 |
| gaaatcagaa | atgaagacag | ttctatcagc | tgataaggat | gttttaaagg | ttgataccsc | 161100 |
| gttacagtat | tgggggattt | tattagattt | ctgtagcgga | gctcttgatg | ctattaaatc | 161160 |
| acgtggattt | gctattaagc | atattcaaga | catgcgagca | tttgaggctg | gaaaataatg | 161220 |
| agatataaca | ttgatgatgc | ttttaattat | gaagaagaat | ttgaaacgga | aattcaattc | 161280 |
| ttaatgaaaa | agcataatct | taagcgtcag | gatattcgta | tcctggccga | ccacccgtgc | 161340 |
| ggtgaagatg | ttctttatat | taaaggaaaa | tttgccggat | atcttgatga | atatttttat | 161400 |
| tctaaagata | tgggcattga | tatgcatatg | agagttgtat | aaatagatat | ataattcaga | 161460 |
| ggagacaatc | atgtcagata | agatttgtgt | tgtctgtaaa | actccaatcg | attctgcatt | 161520 |
| ggttgttgaa | acagacaaag | gtcctgtaca | tcctgggcct | tgctataatt | acattaaaga | 161580 |
| actaccagtt | tcagaaagtt | cggaagaaca | attaaatgaa | acgcaacttt | tgctatagtg | 161640 |
| tgacctttag | tctatagttt | tggcccttcc | tttttggttg | ggcctttttt | aatttaaaag | 161700 |
| cttcttccta | cttcatcgtc | tgaatcttct | aattcagctc | tttttcctgc | caaagcatct | 161760 |
| ctgactgaga | tgtcatcagt | atcttttaat | tcagtttctt | taactctttt | cttataataa | 161820 |
| gcttcaagtt | cttctaaacc | ttctaatgtt | tgacaagagg | caattttacc | cataaattca | 161880 |
| tcaatagaag | cttcataaag | aaattgttta | aattctagta | acatcttttt | ctccaaaggg | 161940 |
| ccgaagccct | tataaattaa | ctgttttcat | tacgtaatta | aattttcat | ctgcgtagcg | 162000 |
| ctgaatacga | tcaatgccgt | gttttaaaag | atagttcaag | tgaacatatt | tcttttagt | 162060 |

FIG. 17IIII sequence.txt

```
attagcagat tttggcttga caccacagtc atctatgagg tcccagactg ttgcgattgt    162120
tttagaacca tgcttacgta atacacgacc gattgtttgt aatacaatga tttttgattt    162180
aacaccgtgc gctaaaacaa cgtgatgcag atttttaact gaaataccag tagaaaatac    162240
accataacta gctactataa ttattccttt accattttca gctaaggttt tcattatatt    162300
gcgggtttcg gtatcaactt ccctgatac gtaataaact ttatcgtatt catttttaat     162360
taaatcgaaa atagctttac catgtgatac atgtttaaac atgacaaaag cgttttcatc    162420
tttttgtgca agcttaatag ccaatttagc gatccattta tttcttttac taagccccgt    162480
aataattttt atttcttctt gataagtttt tccctttaat ttagtagtga actcatcggg    162540
atagcgaaga aaaatactat taatttttag ctcagttact tgtccatctt ccattaactt    162600
agaagtcgtt actggcttaa atatttcacc aaacattcca acatactgca tgatattggc    162660
tttgccatca cgtaatgaac cagatagacc aaatttgaac atgcagttat taaacctga    162720
tatgatagat gaaatacttt ttcctgtagc aagatggcat tcatcattca tcatcattcc    162780
aaactgtgag aaccattctt tcggttgttt tactacagtt tgccatgtac caacaacgac    162840
tggtgcatca tttttatatt tatcatcttt tgatgctccg ccaccaattt tctttatcat    162900
tgcatgactg aataaacgat agtcaacgaa gtcatcagcc atctgagttg ttagagcagt    162960
tgttggaaca atgataagaa ttttaccttc ataattttcc aaataatatc gcgcaagcaa    163020
agcttgaatt aacgatttac cagcggatgt tggaagatta agaattctac gacgattaac    163080
taatccttcg aacactgcat ctttttgata ccaatgcggt tcaattcttt tatttcctga    163140
atagatttct aatttagaaa gccattcatc aaaatctttt cttgataatt cttctttttc    163200
gttaatctgt gggtcaatcc aggctttata gccaaagtta tcgcagaact ttttaatttg    163260
cccgactaaa ccgaatggaa gaaggcgatt ataatctaaa agacgaattc gtccatccca    163320
gtggccatat ttgtacttcg gattaaaacg atacccatca gcttcaaagc taaagaaatc    163380
acggagttca tgaaatgtac tttcttcgca atcaattctc acgtgactaa aatcataaaa    163440
atgtacttta atgtcagtca tgtctaaata ccatgtaata aatatatcta tatttatact    163500
gaggaaatat tatgatagat aaagattata ttgcagagct gaaggctctt gatgataata    163560
aagaagctaa agctaaatta gctgaatatg ctgaacagtt tggtataaag gtcaaaaaga    163620
ataaatcttt tgataatatc gttaatgata ttgaagaagc tctccagaag ctcgctagtg    163680
aacctatgcc ggagactgat gggttatcta ttaaagactt aattgatgct gctgatgctg    163740
cagagggggtt aaaatatgac gatgaagaag tcaatccaga agcagcactt ttgattgatt    163800
ctccggttaa atctgacatt aaaattgaag tagtagaaac agataaaatt cctgaaaata    163860
ccgatgtttt gattgaagat actccatttg ttgaagaaaa atttgaacag gctgtagctg    163920
```

FIG. 17JJJJ

```
                                    sequence.txt
agattattga atctgaaaag ccgtctgtat ttactcttcc ggaaaacttt agcccgaatc    163980
ttcagttgat tggaaaaaat ccaggattct gtactgttcc ttggtggatt tatcaatgga    164040
ttgctgaaac tcctgattgg aaatctcacc caactagttt tgaacatgcg tcagcacacc    164100
aaactttatt tagcttaatt tattatatta accgtgacgg atcagttcta attcgtgaaa    164160
cacgcaactc ttctttcgta acattaaaat aaggataact tatgactttt acagttgata    164220
taactcctaa aacaccgaca ggggttattg atgaaactaa gcagtttact gctacaccca    164280
gtggtgaaac tggaggcgga actattacat atgcttggac tgtagacgac gctccacagg    164340
aagaaacgtc agcaactttt agttatgtac taaaaggacc tgccggtcaa aagactatta    164400
aagtagttgc aaccaatcaa gttgcagaat ctgaacctga aacagctgaa attagtacaa    164460
ctatcacagt tcaaaataag acacaaacaa ctactttggc agtaactcct ggtagccctg    164520
atgctggagt gattggaact ccaattgaat ttaccgctgc cttagcttca cagccatcag    164580
gtgcaaacgc tacgtatcaa tggtacgttg acggttctcc tgtgggcgaa gcaactagca    164640
ctacattcaa ttacactcct gacgcaagcg gagttaaaac aattaagtgc gtagctcaag    164700
taaccgcgac agattatgat acaaaggaag ttacttccaa tgaagtgtca ctgactgtta    164760
ataaaaagac gcagacaact actttggcag taactcctga tagtcctcca gcgggagtaa    164820
tcggaacccc agttcaattt actgctgcct tagcttctca acctgatgga gcgtctgcta    164880
cgtatcagtg gtatgtagat gattcacaag ttggtggaga aactaactct acatttagct    164940
atactccaac tacaagtgga gtaaaaagaa ttaaatgcgt agcccaagta actgctgaaa    165000
attacaatga aaaggaagtt acttctaatg aagtatcatt gacagttaat aagaagacaa    165060
tgaatccaca ggttacattg actcctcctt ctattaatgt tcagcaagat gcttcggcta    165120
catttacggc taatgttacg ggtgctccag aagaagcaca aattacttac tcatggaaga    165180
aagattcttc tcctgtagaa gggtcaacta acgtatatac tgtcgatacc tcatctgttg    165240
gaagtcaaac tattgaagtt actgctgtcg ttactgcaac tgattacgat agcaaaacta    165300
ttacagcaga aggtcaagtt caggtaactg ataaagttgc tccagaacca gaaggtgaac    165360
taccttatgt tcatcctctt ccacatcgta cttcagctta tatctggtgc ggttggtggg    165420
ttatggatga aatccaaaaa atgaccgaag aaggtaaaga ttggaaaact gacgacccag    165480
atagtaaata ttacctacat cgttacactc ttcagaagat gatgaaagac tatccagaag    165540
ttgatgttca agaatcgcgt aatggataca tcattcataa aactgcttta gaaactggta    165600
tcatctatac ctatccataa tcataagggg cttcggcccc tttcttcatt ttgaaagcac    165660
acaaaacaca atcagaaaat gatgtatata atggcaccaa ctcgataaca tgagattgat    165720
tatgagaact gaggttgtgg tgtttactct tcatgagtct ggaaagtcat tcattgaaat    165780
tgctcgtgaa ttaaacttac aggcaaaaga agtggctgta ttatgggctc gagctatgac    165840
```

FIG. 17KKKK sequence.txt

| | | | | | |
|---|---|---|---|---|---|
| tgctaaaaat | aaatttgaaa | ctcgagaaaa | agtcgtctat | agaaaaagac | atatcaataa | 165900 |
| aaaggtgaaa | aatggaacag | tatgatcttt | atgaaaatga | atcttttgct | aatcaattgc | 165960 |
| gcgaaaaagc | acttaaaagt | aaacagttta | agctagagtg | ttttattaaa | gattttttcgg | 166020 |
| aacttgctaa | taaagcagct | gaacaaggta | aaacacattt | tagttattat | tgtattgctc | 166080 |
| gtgataaatt | gattactgaa | gaaattggtg | attggctgag | aaaagaagga | ttcagcttta | 166140 |
| aagtcaatag | tgatcagcgt | gatggtgatt | ggttagaaat | tacattttga | ggattaatta | 166200 |
| tgtttaaaaa | gtatagcagt | cttgaaaatc | attcaactc | taaatttatt | gaaaaacttt | 166260 |
| atagcttggg | attgactggt | ggggagtggg | tagctcgtga | aaagattcac | ggcacaaatt | 166320 |
| tctcattgat | tattgagcgt | gataaagtaa | cttgcgctaa | acgtactgga | ccgattcttc | 166380 |
| ctgctgaaga | tttctttggg | tatgaaatta | ttctaaagaa | ttacgaagat | tctattaaag | 166440 |
| cagtacaaga | tattatggaa | acctcagcgg | ttgtatctta | tcaagtcttt | ggcgaattcg | 166500 |
| ctggacctgg | cattcagaag | aatgtcgatt | atggcgataa | agattttat | gtatttgaca | 166560 |
| ttattgtcac | tacagaaagt | ggtgatgtga | cttatgtcga | tgattatatg | atggaatcat | 166620 |
| tttgtaatac | atttaaattt | aaaatggctc | cacttttagg | tcgcggtaaa | tttgaagagc | 166680 |
| ttattaaatt | gccaaatgat | ttagattctg | tcgtccaaga | ttataatttt | acagtagacc | 166740 |
| atgctggatt | agttgacgct | aacaaatgtg | tttggaaagc | tgaagccaaa | ggcgaagtat | 166800 |
| ttaccgctga | aggatatgta | ttgaaacctt | gttatccttc | ttggcttcat | aatggaaatc | 166860 |
| gtgtagccat | caaatgcaag | aattccaaat | ttagtgaaaa | gaaaaagtct | gataagccta | 166920 |
| ttaaagctaa | agttgaacta | tcagaagctg | ataacaaatt | ggtgggaatt | ttagcttgct | 166980 |
| acgttacact | gaaccgagta | aataacgtta | tttctaaaat | tggtgaaatt | ggtccgaagg | 167040 |
| attttggaaa | ggtgatggga | ctaactgttc | aagatatttt | ggaagaaact | tctcgtgaag | 167100 |
| gtattactct | aactcaagca | gataatcctt | ctttggttaa | aaaggaatta | gttaaaatgg | 167160 |
| tacaagatgt | acttcgtccg | gcttggattg | aattggtaag | ttaaataaaa | agggaccgaa | 167220 |
| aggtcccttt | gttttattca | tcaacgataa | tttttggtag | cttaacacct | aataaaacag | 167280 |
| acaaa | | | | | | 167285 |

FIG. 18A sequence.txt

<210> 4
<211> 43313
<212> DNA
<213> Unknown

<220>
<223> Description of Unknown: Bacteriophage F510/08

<400> 4

| | | | | | | |
|---|---|---|---|---|---|---|
| cctactcaac | gaggccgtgg | ctagcaaggt | gctaaactcc | cgcctgggct | ggtccgcagt | 60 |
| cggcgagtat | gtcgaactgt | tcaaccgcac | gcaatcccgc | gtggccgggt | tgattcccga | 120 |
| gtagctcaag | ccgagtacct | gcatagtcgg | gtgctccact | ggaactactg | gaatttttat | 180 |
| tgagattggc | tggaggttgg | ctgtctgtgg | ctgggggggg | tagttactcc | gggtctaatt | 240 |
| ttggtatcgt | cgtgtgagaa | ccctcccgac | tctgatcagc | ccaccctttcc | cccgtaggcc | 300 |
| ctccgcctgg | tgggccatcc | ctcgcattgc | ctgggtgttg | cttcctagcc | tcctgggagc | 360 |
| ttccagctcc | gctgggtggc | gtgggcttcc | ctgccctgtc | gccgaccatt | ctacgcatcc | 420 |
| tgtcgggagt | gtcaaccctt | gggctggccg | tagtgcctgg | agcgctccag | cgcttccctg | 480 |
| tgcttggtca | gcgctaccgc | gtactcctgg | gatgcctggc | gcttccgcca | cggtgctgcg | 540 |
| tagtgccggt | ggtcctgcgc | tgcccacgtc | gctatctgcc | tctgccatgc | tgcgtcctgc | 600 |
| tggtgccagg | ctcgctcgcc | tctgtcctgt | ctgctcagca | tcctgtgcct | cctgtggcct | 660 |
| ctgctggtcc | tgtcgggtgg | tggtgcggga | gtggctggcc | ttgcctcttg | tggtattgcc | 720 |
| tcctggctgt | acctggcgtt | gcctgggtgg | tcccggctct | gctggggcc | tacctggcca | 780 |
| ctccctctag | gccacgtact | ctacccgcct | gcctctgcct | tgtctagtcc | ctcctggctg | 840 |
| gtgcctgggt | gctggtctgt | ctcaccctgg | ctcactctgt | ctctacctgt | gccctgcctg | 900 |
| gctctgtcct | ggctaccgct | ggtcctgctg | tcttgcctcg | ccgctccctc | gcatgctcgg | 960 |
| tcgcacctgc | ggcgctgatg | gactcctgtt | tgtccattgt | gtgtgacata | accgcagccc | 1020 |
| tagtgccacg | cggggttccag | ggcggtgggt | cgggtgcctg | ggtggcggct | gtcgctccct | 1080 |

FIG. 18B sequence.txt

```
ggtaacgcaa atcctggcta gctagactaa gcctcgcacg tgggtctcta tacgtgtggg    1140
aaggctccag ggagcgccct gggagggttg acacgtgggc agtaggtctg tagagttcgc    1200
cctgtcttca cgcaacaacg cctctacagg cagcctggag acggggttga cacactgcca    1260
gggcatcggt agagtacgca gccagaacga cgggagattg caaccttcca agcgcggcac    1320
aagccatagg cgcaagggac acggcaaact cttagggcag gaaccgcagt gtgtaaggcc    1380
ggcaggcatc actgagggga ttgacacggt gcaggacacg cggtacagtt cgcaccacct    1440
gatggccact cagcaaaagg gcctatgcca gagaactgga cgaactaatc cccgacagag    1500
gattgacaag acaagcgcaa gtctctaaca tgcgcagcaa gacgaaagga tggttcagcc    1560
atctggcggt agaggttcga agcttcacca gcggtacatg gactggtgcg gtaggttgac    1620
cgaagctgca actggttagg cagggtccca gggaatacct gtcgggtgct gaagactcac    1680
ccaaaagagt ctgagcggga agcctccccg tccacggtta agcaaaggca cgttagtgcc    1740
ggtgggaacg aacagagtgt cagtgggatc gagaactaga aacctcggtt aatcgcgact    1800
gacagtatgc tgggtagtat cggcggggcc attgaacaag gccaggcaga tagcgcaaag    1860
ggtacggggg atgagtgctg acgatcccga agagtatgcg caggacaagc cagaaccgct    1920
gatactacag ggactatgcc aatgccaagg tttgtccctt gaggcccttc caccgagggg    1980
attcaagaga cagacctagt gaggattgcc gatggcacac ttcaaggcta aggctcccaa    2040
gtcgcccttt gctgctcagg tagcgtactg gcgggactgg gaagccaaac gtactaagct    2100
catcgcacag gataacgtcg aagggcgtaa agagcttcgc aagatgcgtg acgtgcgcta    2160
cgccaccgac ccggagccag cgccaggacg ctaccataac cctgaacaga aggctttcgt    2220
gaagggtagc gaaggcaagg cgcggaacat cctgaaggga tggaacgcta agaagtcgca    2280
agggaagggt ttgtaatgcc acgtgtgaat gaactgacgc cgcgtcaacg caaggccgcc    2340
aaggctcgcc gcgacaaggc tcgccggatt gatctagcgc acaggatgcc gaaaggtgcc    2400
gactgcccga tcttccgcaa ggctgagcag gcgcaagcta agcagccacg agtcgatacc    2460
ctgaccactc cccgcagtgc tggctacctg gccgccgctg cttacctgaa caaatccatc    2520
tgaggtacat accatgacca acgcaatctc caaaaccgta atcgcattcc gtggcaccga    2580
agagatcaac cgcgctatcg acgccatccg tgtccgtggc aaggaactcg acgaagccat    2640
ccaactgacc ggcctgtcga tcatccacca catcgaccag tgcggcgacg tgaccgtagt    2700
caaggcgctg tatgaagcca tgccgaaggg cagccgccgc aatgcgctgg tcgagtggct    2760
ggtgctgcac ggcaaggtac aggttaacac tgacaagaaa tcgaacaagg acctgccctt    2820
cctgtacaac aagttcggca agaccgatct cgtcggcgcc accaacagcc cgtggtacag    2880
cttcaagcct gagaaagcgc tggaccagga gttcaacctg gctgctgccc tggccacgat    2940
```

FIG. 18C sequence.txt

| | | | | | |
|---|---|---|---|---|---|
| caaaaagcag | gtgctccagg | ctcagaccaa | gggcaaggtg | atcgtcggta | tggaactgct | 3000 |
| gggtgacttg | gaagcgctgg | ccgccaaggc | tgcacccatc | gccgagcaga | gcaagcgcgc | 3060 |
| tgccgcccat | tgactcaagt | cgaacgcctg | ctaagcgggc | gttccgctgg | aatcaatgac | 3120 |
| aactggagaa | acacgatgag | cttcaaacaa | cgcctgcaac | gtcaaatcgc | cctggcacag | 3180 |
| tacagccgcc | cggctcagtt | cccgtatggc | gagcaagccg | tccaggcgaa | ggggagtga | 3240 |
| ccatggactt | ctggatcgcc | cttcccttcc | tcgaactcgg | cctcaacctc | ggcgaggatg | 3300 |
| aactgcgcat | gttgtggttc | agcggcctga | cgatattctt | catccacctc | ctgaagcggt | 3360 |
| gactcaagtc | atggccctgg | cgggcgaccc | tcgcctactc | cggggccatc | gctggactca | 3420 |
| tcacaagcga | gaactaaacc | atgcaagctt | tgaataccct | gttgattgca | atccccaagg | 3480 |
| acccgaccgc | aggcatgcac | gccgccgaca | aggtgctgtg | cgcccacgga | ttccgcatgg | 3540 |
| gtgacctgaa | taccgcgcac | gtcctgaccc | caggcgggtt | cgtggtagtg | ggcgccggcg | 3600 |
| tgactgtgaa | ccgctatgac | gaagcgtatc | gtatgagccg | gaacctcgac | tccgaaggct | 3660 |
| tcgacgtgct | gctggtccag | ggcagcccgc | tgtccgggcg | tgtcacctgc | caggcgtacg | 3720 |
| gatggatcaa | cgccgagtac | cacaagggct | gtgcgaatgg | ccgtcccatc | ttcgacatcg | 3780 |
| caggaacctc | gtaccatgtc | atcgcgtgac | ccgtaccgca | tcggccaccg | cgttgggctg | 3840 |
| gtgaactaca | gcgaccgcta | cctgggtgcc | gacgcggcag | gcaccaaggg | catcatcgag | 3900 |
| gccataaccc | gaccgtcgcg | ctgtatgacg | gtctaccacg | ttcgctgcga | gcggaccctg | 3960 |
| cgcctgatcg | aggcagaggc | ccgcaacgtg | cgattcatcc | gacagcgggc | ggagcggtga | 4020 |
| gctggcgcat | cgtggtagtg | acgccaggca | acgggtgcgc | cttcgtgtgg | acccgtcgca | 4080 |
| agcgcgtccg | gcctctgaga | ttctactccc | gcaaggccgc | taaacgctgg | ctccgtaggc | 4140 |
| accgccgccc | ggcgatcctc | ggtagccagt | acctgatcgt | gaactggagc | aaacgtatat | 4200 |
| gaccctcgtg | gccaccgtag | tagacagcgc | gcacaacctg | gaagtcgacg | acctcaccgc | 4260 |
| cggcaacctg | tatgccgcca | gctcgcccag | cgggaacatg | ttcatcgtgg | tagtgggtaa | 4320 |
| tcacaatggg | cgcaggcttc | ccgtagtcct | gtcatccacc | gatacccgca | ccatcgggga | 4380 |
| cgtgataagc | aacactgggt | tccggtacag | tgagatcgcc | gggttctccg | taaacctggc | 4440 |
| acagggagat | tatgactgat | ggtcacccgt | actgtatacg | tcacgcctga | agacccgacg | 4500 |
| ccgccgatct | tgtccgtggg | ccgactggct | ccgggagaac | tctacaaggt | ggtggcaccc | 4560 |
| agctcggcgg | aaggtatcat | tgtgctggcg | accaagcaga | cgccggcgct | agcccaagca | 4620 |
| gccgtcgtac | tgcacagcat | gaaccctgcg | cagtatcccg | caggttcggc | tatcctcaac | 4680 |
| acggcctgga | agtgccgccg | cctgggagtg | ggcgagtacg | tcaagctcgt | ccaaggggag | 4740 |
| gaggactgat | ggccgtggca | atactcatcc | tggccgtgtg | gttgatcggc | ggcgccctgc | 4800 |
| tattcctgcc | gttcgacctt | gtggtctcac | cgcgcttgcc | gctatcagac | gaggccctca | 4860 |

FIG. 18D sequence.txt

| | | | | | |
|---|---|---|---|---|---|
| accgaaccgc | actgtacacc | gtgctttggc | cggtaaccct | acctaccctg | atcgccataa | 4920 |
| ccgtggttgt | catgctgcat | tccgcgtaca | ggggcgccat | cgaactctac | caggagatga | 4980 |
| aatcatgatc | cgtacccata | cccacaacgt | cgagcgcaca | ccgcaccgac | tgtaccggca | 5040 |
| cactgagctg | cgtctggcg | agctgtaccg | tgtagtgcag | cccgactcca | agcgcggcac | 5100 |
| gttggtggtc | ggcgtagcgg | cctgggacag | ccagggccgg | cccgcagtgc | tgcccgtggt | 5160 |
| catccatgac | gatggtgacg | ccaaggtgac | ctgcgcacgt | cctaccgtac | tgcgcaacga | 5220 |
| cgggtggcgc | atggtcctcg | ccgacaaggg | gacccaggtg | acactcaccg | ccgagtgacc | 5280 |
| aaggcgaagg | ctggtgcgcc | agccttccac | cgtggccatt | ccctgccgcg | aaccaactca | 5340 |
| actgaggagc | tacaacatga | ccaacgtcaa | caccaccacc | gaaaccacca | ccgctgctgt | 5400 |
| cctgggtgcc | aagctgatca | agaagccggc | caccgtcgag | gacttccgca | caacgtggt | 5460 |
| cttccaccat | agcgccctga | ccaaactgac | cgaggtctac | aacgaagcgg | tcgccgccct | 5520 |
| gcaaaccgcc | gagcgcctgt | ccagcctcgt | cgccggtgac | gtgatcacct | tcgaccacgg | 5580 |
| caagggcgag | aaagccgaag | tgctgagcgg | cgaagtcatc | agcgtggtcg | ccggcgtcta | 5640 |
| tcaggtgctg | gtccgcttca | gcgacagcgc | accggccaag | ctgctggacg | tgaaggccag | 5700 |
| cgccatccgc | gccgtccagt | cgtcggcagc | ccaggctgca | accctcgacg | aagccatcgc | 5760 |
| ccagggcgag | taaggcccgc | acgtaatagg | cccggccctc | cgggcctatt | gcgagctagc | 5820 |
| cataccatag | gaggaatcac | catgagcaag | cgcaaccccg | aacacatcaa | cggcaccgtt | 5880 |
| cgtagcgtca | gcgtccagaa | gttggcggcc | acccaggaac | tggaggatcg | tctggaggct | 5940 |
| gccctggccg | tgtgccagca | gcgggcagag | gacatcgacc | tgctgagccg | ccgtctccag | 6000 |
| gccgccgagc | gcgcccgtcg | ctgggagatc | gacgagattc | gcaaccacca | ggcgaccatc | 6060 |
| cgcctgttgc | aaaacgatct | gaacgctgcg | catgatgccc | acgaggcaca | agagcgccgc | 6120 |
| gctcgcaagg | caaccatcat | ggcctgggta | tgcctgctga | ccgcaggttt | ggccgtcacc | 6180 |
| ctgaagctgg | caggagtctg | accatgcagt | gcaaagacct | ttacacgaac | ctcgcgtcgg | 6240 |
| gcatgttcaa | cgtgccgtgc | tcccaggtga | ccccggagat | gcgacgggta | gccaagagcc | 6300 |
| gggcattcgc | ccacgcctat | acgcccaaga | aacaggcttc | gggcgggact | tacaccgccc | 6360 |
| gtgtgagcgg | cgtcacctgt | gacggtggta | aggtggaggt | gcgcctggat | aacgtggagc | 6420 |
| gcgtcagcac | cttcgactat | gccgagctgg | agacgcgggt | agcggccagt | ctgtgccagg | 6480 |
| ccgacgcgaa | gcgcgccgct | gaatacgaaa | agctactgct | gaaagcgttc | ccgtcggtat | 6540 |
| ccccgaagga | tggcccgctg | tccgccaagg | acttcgaatt | gcgcctgcat | gatctgtgct | 6600 |
| caaccaagct | ggtagtgctt | cgtgccttgc | gtgatgccgg | gatagagatg | gacggtccgc | 6660 |
| tgcgcagccg | ggtacggaag | ctggcggatc | ggaataacgt | gatgggtgct | gagttgttca | 6720 |

FIG. 18E sequence.txt

```
gcctcaagca ggagttggca caactggtcg cggtcggcca aaaggctgga ctgaattggg      6780
acggggcgga gactcagcgc ctgctgacgg tggccccgac caaggctctc tgtcgactca      6840
tcagcgcgct gaccggcgtg cggtataccc accacaccgt cgtagccaag gccgaggctg      6900
aggcgcgcga gcgggcaaag gccgaggcca aggattcatt gcaggcggca accttcgcag      6960
ccgccatcgc tggtggcgtc gtcggcagcg ccctgatgtt cctgctcggc tagggcgacc      7020
agggcctact ccggggtcaa atccgagggc gttcctagag cgccctctcg tgtgagtctg      7080
gaggatcacg aacatgcaat accacttcac gcattacaac ggataccgct tcggcgtcga      7140
gctggaggac gaggctgtct tcccgtgcat cgacggtaag cgggcgacct gggacaaggt      7200
ggcggcatgt gccggtagcc ttgtgcatta catggcgcag gacctgatcg actttggcca      7260
gcgcaagtta agggagtttg aagatgagca agacgagcct gtatccgctg aacctgcatc      7320
ccggcctgat tcaaatcagg acgattcacg tattcagcat ccaagccccg agcaacgccg      7380
agaactggtg gcagtggttc ctctggcagc ggaagtacca cccgctccgg gaaagcctga      7440
gtccagccgg ggagctgagt gcgagtatcg ccgagtgtgt gctccacctc cgccggaatg      7500
gctggcaaga tagcgacatc tggcgcaaga agggaggcgt gctggccctc ggtgccttcg      7560
acctgtccgg cctgatggta ggttcctgcc tcgtagtagg tggtgagctg aaggccctgt      7620
gcgttgatga ccggcacagc aggcagggta tcggcgctga gctggtgcgg gccgctgagc      7680
tggctggtgc cgagtatctg acctgcttcg agttcctgga gccgttctac gccgacttgg      7740
gctggagcac cacccaccgc gaggcgaact ggacagcagg agagccggac gtgctgcaca      7800
tgagggcacc cggtcatgac gtatgaggtg atgacatggc ttatcgagaa caaaccgctg      7860
gtcatcggag tcgccttcag tctggtggcc ctgggcgtgc tgctcacaca gaacaacggc      7920
ggcccgccta cggcgcccgc atgacctggc acctccagga catgttcgag gcccgaggcg      7980
ggctgcggcc tttgtgggag gaatggtacc aatggcactg cgccgtgact cctggctaaa      8040
gcaagcgcaa tccctggcgg tcggtcaggc gggtcgattc cgccacgtcc tgggatgcca      8100
gagcatgagc cggggcggga ccaacatgac ctgcaagaac cttcctgacc gctgggtggc      8160
ttactgctac tcctgtcagg agggtggcgt ggtcgagaaa acgcatgtgc ggagggtaca      8220
atgcgcggat caagaacgct tcatgccctg gcccgaggat gcctcggact ggacgcaagc      8280
cgactgctat caatcgcttt atggtttgct gctgtccaag ggcatagact acaacgtgat      8340
gacgccaggg ctgccgctgc tgtacagcga aaggcagcat cggcttatct tccctaccga      8400
cgcgggctgg attgggcgcg ctactgccga ccaaaatccc aagtgggtgg gttacgggta      8460
tcctgccccg gattaccatg gatggcccca ggaattatca atgggcaggc catgggtgct      8520
gacggaagac tacttgtcgg cgctgaaggt gcggtgggcc tgtcccgaag tctttgctgt      8580
cggtctgaac ggtacaaggc tgcgcgacag gctggcggcg atcatgttgc agcagacctg      8640
```

FIG. 18F sequence.txt

| | | | | | |
|---|---|---|---|---|---|
| caagcgcgcc | ttcatcttct | tggatggcga | ccgggcaggt | gtccgtggta | gtgcaggcgt | 8700 |
| gatgcgccgg | ctccggtccc | tgcttatcga | aggccaagtc | ataccaacgc | cggacgggtt | 8760 |
| cgaccccaag | gacctgaccc | gcgagcagat | aaggagccta | gtaattggac | gtattgacgc | 8820 |
| ttcacgcact | gagtgaccgg | gaccgcttcc | gcacattgcg | gagtgtggtg | cccgaaggaa | 8880 |
| tgatggggcc | ggagacgtgc | ttcgtcatcg | actggatcga | gcagtattgg | aaggtctacc | 8940 |
| cggcgcatca | gaaggtagac | ccgcaggcac | tgcgcgaact | gatcaagctg | cgaggtggct | 9000 |
| accagccgga | gcaactggcg | gtggtcctga | acctcgtcaa | ccaactggac | aagccggtgg | 9060 |
| acccggactc | gctacagggc | gtcgtgtccc | agctcaacga | actggatttc | tcagggcggg | 9120 |
| tggatgccct | cctggcgcag | tacaaccagg | gcgaggacat | cgacctggcg | tatgagctgc | 9180 |
| gccggctgag | cgacgaggcc | ctgcgccgcg | gaggggtcag | cacgccgacc | gactacgtga | 9240 |
| cggacgacgt | gtttgatatc | ctcgcggagg | agcagggtga | ccacggcatc | aagctgccgg | 9300 |
| ggctggtgct | accggcgtac | atgaagggcc | tccacgccgg | ggcctcggtg | ctggtggcag | 9360 |
| cgccgccgga | tgcgggcaag | acctcgttca | tggcctggat | cgctgtccat | atcgcgccgc | 9420 |
| agctcaagcg | gtacttcgac | cccggacgac | ccatcctgtg | gctgaacaac | gagggcaagg | 9480 |
| gccggcggat | caagccgcgc | ctgtactcgg | cagccttggg | catgaccgtg | ggcgagattc | 9540 |
| ttgccctgga | cccggaggaa | gttcgcagga | tgtacgccga | gaaaatcggc | ggcgactctg | 9600 |
| agctgatccg | catcaaggac | ttccacggcg | ggtccctggc | ccaggccgag | caggtcattg | 9660 |
| acgcgatgaa | gccgtcggtg | gtgtttggg | acatgatggc | tcacgtcaag | ggtggacagc | 9720 |
| gcaaggacca | gaaccgcacc | gacgagatgg | agtacaaggt | ggccgaggtc | cgcgagatgg | 9780 |
| cggtgcgcca | cgacttcatc | agcttcatga | cgtggcagat | tagcaacgac | ggccacgacc | 9840 |
| agttgttccc | accgcagtcc | tgcctcaagg | attcgaagac | agcagtgcag | ggtgcggtag | 9900 |
| atgtgcaaat | ccacctgggc | cgtctcaacg | gtgcggatca | acaggtcatg | cgtggcctgt | 9960 |
| ccctgccgaa | gaacaagttc | cagatggacg | ggaagccttc | gaacgtggag | gctatgatta | 10020 |
| acttcgacgc | cgcacggtgt | cgattcttcg | agagtgtaga | ccatgcaagc | taagcatagc | 10080 |
| cgggtgctcg | aaggcaccaa | agaaattccg | ctgggtagca | tcgagccgtt | actgggcagc | 10140 |
| gtcgcgggcc | tgctgttgtg | cctgtactcc | gacgcaactc | acgaggaggg | cgtcgccttg | 10200 |
| gccggtgggt | tccctcgcga | cttgatgcac | ggcgccactc | ccaaggacgt | ggatgtggcc | 10260 |
| ctgtatagca | tgacctgggg | gcgggcagag | cacctgatcc | agaaggcact | cccggtcctg | 10320 |
| aaccccatct | tcgtccggga | tggtgggtgg | cgctcggact | acgctgatgg | tggtgacggt | 10380 |
| ggtatcttca | agggcgtgat | gtccctcgtg | ggctgccgtg | ggttgaatgg | catggacttg | 10440 |
| gactttaact | actacgacgc | cgacagcctc | ggtcgagtga | tggagtcgtt | cgacttcacc | 10500 |

FIG. 18G

```
                            sequence.txt
atcaaccagg taggcatcgc gtacaactgg cccgacccccg agggtgggcc gcgcctgggt    10560
gcgtacctgc acaaggacgt tacctggggc gtgaacaagg aagtcggtgc cggctcacgt    10620
ctgccggaac gatgcgagaa aatgcgagcc aaggccgcgt actacggatg ggagaacgtg    10680
tgatgagcaa gcgcgacgtg gtactggata tcgagaaagg catctggcgt ggtgttgacc    10740
agaacgacaa ggccgtcgag gccatcatca agaagaacgg gtacgtgatc gtcgagccta    10800
agatcgacgg gtgccgtgcc atcgtcggtg cgcatggcgt ggtgtcccgc agtgggcgcc    10860
gcttccccggc cctggatggc ttggaagacc gcatcatcga gcgactggcc cgaccggggc    10920
tggactccgg cctggtgctg gactgcgaga tgtacctggc cggcatgccc ttcagcgagg    10980
cgactggccg catgtcgagt aagacccccgc tgaccgagga agagctggag tgcctgcact    11040
tcgcggtatt cgacgccacc catatcgacg tgctccgaaa ggcgcgcacc tcacacctgg    11100
tatacgaaga gcgccgagcc atggccagca gcctcctggc agcctgtcgg ctcagcgaca    11160
ctccgacgtt cttccaggtg gggttcaccg tctgccggag aatgtctgac gtttaccgcc    11220
agtacaagtt caaccgggag gtgggctacg agggatcaat ggagaaagac cccagcctgg    11280
tctaccgcaa cggcaaggtc gccggctgct acaagcgcaa gccgggcatc accgtagatg    11340
gccgcatcgt cgggtacgtg atgggcaaga ctggcaagaa cgtgggccgc gtcgtgggct    11400
accgcgtgga gctggaagat ggttccggca ccgtggccgc caccggcctg agcgaggagc    11460
acatccagct cctgacctac gcccacctca cgcccacat cgacgaggcc atgccgaact    11520
acggtcgtat cgtcgaggtc tccgcgatgg agcgctcagc caacaccctc cgccatccca    11580
gcttcagtcg cttccgcgac ctggccagta atccaggagt caaggtatga agattcgaaa    11640
gtcccgtaac cgcaactacc cggaagatat ggtgtaccac gccaccaacc gggattcact    11700
gctgtatccg aagtacgtca tgggttccgt gttcatcagc caggacggaa cattccgcat    11760
ctgcgtcatg gcagggacct gggaccacgt tgggtccgaa gttctgcatc atgcacggga    11820
catccaatcc cttggcgccg gtcgccgtaa gttgcaccgg gtcatgcgac ggctgcgccg    11880
caatctgcaa caggtaggag tcaaggtatg agaatgccaa ccgaagaaga acgcacgatc    11940
cgctgcctgc tggcagatat ccacgaaccc ttgaacctgc tgttccccgg tatccgtgta    12000
aaggccgaga caatgcccctt gggctgggga gatagtatct gtgccctggt actccgggtg    12060
agctacgaac atctcacgct ggggcgcctg gagtacatgc acgaggtccc catcctgcac    12120
ctgtcgcagt ggggccggga cggcctgcta cagcacctga tgaacagagat tccccgtcgg    12180
gtgctggatg gcatgctacg tcaggcacag aaatacagcc agagtaactg gtacagcaaa    12240
tgacgactat ccgaatcctc gacctcgaaa ccgagagcta cgagcacaaa gggcgcaagg    12300
cgtcgccctt tgacccccgc aactatatcg tcatggccgg ctggcgtgac gatgttgacg    12360
gcaaggtcgg ccagaaggtg gagcatcgct tccgcagccg ggccgaagcc gaagacccga    12420
```

FIG. 18H sequence.txt

```
acaaccgctg gttcaacctc gacggcgtgg acgtgatcgt agcgcacaac gccatgttcg    12480
aatcgaactg gttcttcacc cgctaccggg acgagtacct ggccttcctg cgacgtggtg    12540
gccgggtctg gtgtacccag caggccgagt atctgctgag tcatcagacg tggctgtacc    12600
cggcgctcga cgagctggcc ccgaagtacg gcggcaccca caaggtggac ggcatcaaga    12660
tgctgtggga ccagggtgtg ctcacctcgg agatggacca ggacctgctg agcgaatacc    12720
tgtctggccc gtgcggcgac atcgagaata ccgccctcgt attctacggt cagttgatga    12780
agctccaggc ccgtggcatg tgggctggtt acctggagcg ctgcgaggcc ctgatcggtt    12840
tctcggcgat ggagtgcgcc ggcctgaagg tggacctcga agtcgccaag gtgaaccacg    12900
ccaagcaact ggaagaggtg gccgggatcg aggccgagct gaagaagctg atgcccgact    12960
tcccggaata cttcgagttc aagtatacca gcctctacca tatgagcgca tggctatacg    13020
gtggcgaggt gcggtacaag ggccgggtgc cctacgaaga tggccggatg gagaaagccg    13080
acttcgtgcg cttcggcaca gccaagcggg ggactcctat cgagagtacc tcggtacggg    13140
tcccgatcca cgaagtgacc gaccagggtg aatggcactg gcccaccatc accgagctgg    13200
cgaccaagca cggtccggtc atcacgttct ccgccggcaa gaacaagggc agcgtcaaag    13260
tgttccgtga ggatacggac atcccggcga ccaagtggga cgatgaccag cgattccggt    13320
tccccggcct gatcaacctg accaacctgc cggaagtagt gcgtgagaaa ttcctgggca    13380
agcgcccgga gttccagtgc gccctcaccc tggcggatgg atcgcccgtg ttcagcacca    13440
gcggcgacgc cctcaaggct ctggagaaac agggcttcga ggcggccaag ctgttgatgc    13500
gcctggccga gctgcacaag gacaactcct cgttctacat cacccacacc tacaacaagg    13560
atgggacgat taaggacacg aaggggatgc ttcagtacgt ggacgatgat ggtatcatcc    13620
accactcgct gaatacgacg gcgacggcga caacgcgtct gtcgtccagc cgcccgaacc    13680
tccagcagct cccgtcgaag gacgaggacg acccggaagc cggcagccgc gtgaaggaga    13740
tgttcgtgtc tcgcttcggc gcagacggga tgatcggcga gaccgactat accgccctgg    13800
aggtggtgat gttggcggcc ctgtcgaagg accggaacct cctggcgaaa ctgatggccg    13860
gcactgacat gcacttgtac cgcctggcag ggaagcacaa caactggaac gggttcgact    13920
acgaccagct cgtggccatc aagaaggacc ccaaccaccc gtggcacggt cgcatgatgc    13980
aggctcgaaa gaacatcaag cccaaggcat tctcggcgca gtacggcgcg agtgcggctg    14040
gtatcgcatt caacaccggc tgtaccgtgg aagaggccca ggaattcctg acaacgaggc    14100
cggccctgtt cccagagtcc atcgcattcc ggcagatcgt ccgagacagt gcagaggcca    14160
ccagcctcgt catgtacaag gccgaggacc agatgccggc aggcgccttc agcgagatgg    14220
ggccggatgg caactggcgc cagtaccgcc ggggattctg gcaagcgccg ggtggcacct    14280
```

FIG. 18I sequence.txt

```
gctacagctt ccgccaacag gagcgctggg acaaggaaca gcgcaagacg gtcatggact    14340
tcaaggacac gcagatcgcc aactactgga accagggcga ggctgggttc atgatgaccg    14400
tgagcgtagg gcgcatcttc cgttggatgc tgcatcgccc aggattcatg gtcaccgagt    14460
tcctgatcaa caacgtacac gatgccgtgt acaccgactg ccacaaggac accgccgccg    14520
aggtcaacaa gggcgtgcgc gacatcatgg ccgacgctgc ccgctacatg agcgagcgcc    14580
tgggctacga catcgccgac gttccgttcc cagcagtggc tgagatgggg ccgaacatgt    14640
tcaatatgga ggtgatccag tgaaagaact gcacccgctg cacacgcctg agttcgtcaa    14700
gacattcctg gaccagaccg ggtgcctgcc gggagtacgc cgtacgggtc gcaccaccgg    14760
cattgctcta caggccattg gcatggcgct gtcccatccg agggaaaccc tgacgttcgt    14820
ggaccacccg gacggcagcg cggcagcact ggtggccagc attgaaacca tactggcgac    14880
cctgggctac aagaacgtcc tcgttcgacc cacaacccgt gcggatgggc gcagcgtgag    14940
catcgtcttc aagacgctgc cgaacgcctg acgacccttc cctactccgg ccttaaatct    15000
tcatccgaca cgagagagac cacgcatgac tcaacaactc aacgctctgc aagccgccct    15060
cgccctggcc aacaaggctg ccgagaccgc aaccatcgac atgtccgaaa cctccaccgg    15120
cggtggcggc ggtcgcatct tcccggcggg caccgccatg ggccgcttct gcatctacat    15180
cgagctgggt gaccacgcca aggaattcca gggcaagctc aagaacccgg cgcctcaaat    15240
ccgcctgggc ttcgcactgt ggggcgacgt gaacccgcag gccggtaacc cgcagagccg    15300
cccggacgac ctgttccaca cttacgaggc cgacggctcg atcaagcccg gcctgttccg    15360
taccttcgag atgaccctcg gcaacaacga aaagtccaag accaagctgg ccttcgacaa    15420
gatgaactgg agcgggcagc atacccactt cgctcagatg ctcggccagg cgttcatcat    15480
cccgatcaag cgcaccaaga tcaccaaggg caacaacgcc ggcaaggaac gcaacgacat    15540
cgattggggc ggcatcatga agccctacaa cccggtcgat ggcagcccgt acaacgtgcc    15600
ggaactgccg atggacctgt tgcagtattt cttcttcgac gcgccgacca aggagacctg    15660
ggacgccctg tatatcgagg gcacctcgga caacggcaag tccaagaact tcctgcaaga    15720
gaccattcgc tcggccacca acttccccgg ctcggccctg cacatcatgt gggcggcgg    15780
cgacgatctg atcatcaagc caacgagcca ggccgcaggc agcaacctgc cggcagtgcc    15840
caacgtggcc gccgatgcag gcgtagcagc agcccctgcc gtcccggcag tcccgcaggc    15900
agtggctcag acggccccca gcgtgcccca ggtggcgaat gtggctgccc ctgtggtagg    15960
tactgccgag gcgcagaacg tgctgcctga cgtgccccag gtggctcaga cggcggctcc    16020
ggcagcggtc gaagtcccgg cggtcccggt agtgccggca gtaccgcagg tctaatgcgc    16080
ctgccatcgg aagagttcct ggcaggacta tccgcgcagt tcgaccgcag catggcaggc    16140
gggacgttgg tgtgtgacgc cgatggaccc gcctacgtgg ctgcggccac tgctaagacc    16200
```

FIG. 18J sequence.txt

| | | | | | |
|---|---|---|---|---|---|
| ctggacactg | cactccgaag | attctggaag | ctcattttgg | agcagcagtt | cctagcgcac | 16260 |
| tgcacaggga | cacgggttca | cctcacggca | gcaggtgggg | cgaaggcgta | ccgcgacacg | 16320 |
| tatccgacca | tgaaaccgta | ccagggccag | cgcaagggca | aggcaaagcc | cgcgctgctg | 16380 |
| gagccactgc | ggcgggccgt | ggcggacgtg | catgagcgag | gcggggcgcc | ggaggggatc | 16440 |
| gatgtcatcc | tgcacacgtt | cttcgaggcg | gacgacggca | tgatgatgga | cgcctacgcc | 16500 |
| atgcaggaca | aggccatcat | ccggtccgac | gacaaagacc | tgcggatgac | gatctacccg | 16560 |
| tattgggaga | tcgatacggc | gtgtgtgagc | aggatcgaag | gcggcttcgg | ctacctcaag | 16620 |
| gaagcgtaca | cgccttccgg | ccagttcaag | ctcaagggcc | atggacggaa | gttcttcttg | 16680 |
| gcgcagtggc | tcggcggcga | caccgctgac | aacatccgag | ggatcgatcg | attcaacggt | 16740 |
| aagctctgcg | gtatgaagac | ggccttcgac | atcctccatc | cgatcacgga | tgaggacgag | 16800 |
| gccatcgaca | tgatcctgga | ggcgtacgcc | aagatcaagc | aaaacccgct | ggcagaggcc | 16860 |
| gaggtgctgt | ggatgcgccg | aacgcctacc | gacaacgcag | cgcagtacct | gttaagccgc | 16920 |
| gaccttcgtc | cggccttccg | ccagtggatc | atcgagctgg | acgcctacca | cgaggcgctg | 16980 |
| ctccagaagc | ggagggagag | cgattatgac | gagtgagccg | aaggtctacc | agataccgcg | 17040 |
| cagtcaacag | cgcaccttca | ccctgaagct | atgggccgag | cagaacaagc | tgtgcccgct | 17100 |
| ctgcggcaag | cccatcgata | tcagcgtgaa | gggcgaagcg | gtgatggacc | acgaccacga | 17160 |
| aacggggctg | gtgcggggcg | tcctgcaccg | gtcctgtaac | accgcagaag | gcaagataac | 17220 |
| gaatgcggca | ggttcctggg | gatgcaagtc | gatgaagtat | tcagacatca | tcccctacct | 17280 |
| tcgtgccctc | ctgacgtatc | tggaggggcc | gaagcatccg | ctgatctacc | ccctgcacaa | 17340 |
| gaccgacgag | gagaaacacg | aagcgaagct | ggccaagcgc | cggcaggcag | ccgccaaacg | 17400 |
| caaggcggcg | atggccgtcg | caaagcacaa | cgcgaggaac | gtatgagcaa | actccgcaag | 17460 |
| caattcacca | atgagtacct | gcgaaacgtc | tatgtcgagc | tgggcctcaa | gaagggtgcc | 17520 |
| gagcacctga | ccgagcattc | gcgcttcggt | gaggtgagcc | gccagtgctt | ccgcaactgg | 17580 |
| tgcatcaagc | tgggcttcca | cgacagcagg | acgcgcggca | tgtacgccaa | gaagggcgcg | 17640 |
| atgcactggc | tgggccgcaa | ggctgccgag | gtagtgcgca | agttccctgg | cgccgtgggc | 17700 |
| aacgtggtag | gccagggtcc | gaaggtgctg | agcctggaca | tcgagacctc | gcctatcgag | 17760 |
| ggctgggtct | ggtcgctctg | gaagcagaac | gtgggcctca | accagatcaa | gcgggactgg | 17820 |
| accatcctgt | cgttctgtgc | gaagtggatg | cacagcgacg | aggtgatcta | catggactgc | 17880 |
| cagggtgatc | ccttggacga | catgcacctg | ctggtcgcgc | tgcacaagct | gttggacgag | 17940 |
| gccgacatca | tcatcgtcca | gaacggcaag | cgcttcgacg | tgcccaagat | caacgcccgg | 18000 |
| ttcttcctga | acaagatgcc | gccgccgcga | ccgttcaagg | tgatcgacac | cttgatcatc | 18060 |

FIG. 18K sequence.txt

| | | | | | |
|---|---|---|---|---|---|
| gccaagcagc | aattcgcgtt | caccagccgc | aagctggagt | acatgaccca | caaggcatgc | 18120 |
| accatcaaga | agcgactgca | cggcaagttc | cccggattcg | acctgtgggc | ggcctgcctc | 18180 |
| caggacaacc | cggaggcgtg | ggaagagatg | cgcctgtaca | acatcgacga | cgtacggtcg | 18240 |
| atggaagagc | tgtacatcct | gatgcgtcca | tggttcgtcg | gccaccccaa | cgtggccgtg | 18300 |
| tacttcaatg | acgccgaacc | gaccatccgc | tgcccgaagt | gcggcgacac | ggatgttaag | 18360 |
| caagaaggct | gggtgcatac | gcagaccggc | aagtacgagc | actatcactg | cggtggctgc | 18420 |
| ggtggctgga | gccgagggcg | gtacacccgc | aacacctcgg | aacagcgcaa | agccctgctg | 18480 |
| agcaactaag | gaggtagcat | gagcctagca | ttcccggact | cttacgagtc | gacgatcacg | 18540 |
| actgaaccgt | accgcaaagg | tgcgagtctg | gaagaacgca | aggtcggcaa | gcttcccatg | 18600 |
| cacctggtag | tcgaggggtt | cccgctgctg | aagcgggagc | ttgctcgaat | gatgcaatgg | 18660 |
| gctgccgagg | tcaaggggta | tctgccgcac | gactggaaga | agatgacggt | gggcgagttc | 18720 |
| aagtccgccc | aacacaggca | cgagtccaag | cggctgatcg | acgggccgct | ggatgacgag | 18780 |
| tccaacctga | tgcacctggt | gcatgaggca | ttcaacgcaa | tggccgccgc | cgaggtggcc | 18840 |
| ctgatggacc | gggagaaagg | caatgagtaa | aatctgttgg | tgtacccgac | cgcacgagac | 18900 |
| cgatgaaggt | gttcgggtca | tctgggcctt | caacgagcgg | ggcatcgggg | tcaactacgt | 18960 |
| cacagcgtac | atcacgccgg | cgatggtcag | ccatcgggac | tggagcgatg | tcatactccc | 19020 |
| ggacattctc | cgggagatgg | cggagcgcct | ggagcgggaa | gtgaagctgg | tggaactgcg | 19080 |
| ctggttccgc | gctgagattc | tgagctgcgg | ggaatggcgt | gactaccgag | cgatgacgct | 19140 |
| ggaggggggcg | gttagcctgg | ccgaggccga | gtggggtccc | gaggatatcg | ggcgcgtaat | 19200 |
| cgaaagacga | taggagatgg | aatggacctg | atacagcagc | agatcgccca | cgaagaggcc | 19260 |
| ctggtcgggg | cggcgcagaa | tgacgcccgc | attgccttgg | aaaaggcgat | tgcccaaggg | 19320 |
| tccatcgacc | gcatcccgag | ggcgcgcatc | atgttgatgc | ggatgctccc | catcgtgacc | 19380 |
| gaagcgatct | tcgcccacca | ggaagcgaag | gcggcggggc | cggcagcgaa | gcttcggcac | 19440 |
| ctgctgcgga | tcatcgacgc | ccaggacctc | gcggtcatgg | cgctgcgggc | tgggctgtcg | 19500 |
| atgctcatca | actacccaac | gatcacagcg | acgaagtatt | acacccacat | gggtaagata | 19560 |
| ctctgtcgag | agatcgaagt | gcggttggcc | ttcaaggtca | accaaccta | ttacgaccgg | 19620 |
| acgctggact | acctcaagac | cagcaggact | cgcagcgtcc | ggcacatcca | gaagacgatg | 19680 |
| gacgctcttc | tggacgcggt | actaccggaa | gaggcacgta | tcgacctgcc | ggatggcgac | 19740 |
| tacctgcgcc | tcggcaagtt | catcggtgat | ccgctgatac | agtgcggcct | gttcgagccg | 19800 |
| aaccgcttca | caggtcgtgg | aggtactagc | gtccacctgg | agccgtcgcc | ggaagccaag | 19860 |
| gagttcctgc | aagacccttc | ggcggcgatg | acctggggag | gcccaggccg | tagcgtgatg | 19920 |
| ctggcaccgc | cgcgaccatg | gaacgactgg | tgcgatggcg | gttactacag | cgctaaggcg | 19980 |

FIG. 18L sequence.txt

| | | | | | |
|---|---|---|---|---|---|
| cagaaacacc | atgtgctagt | gcgccgtacc | aagcaccaga | ccaagcgggc | gcgccagatg | 20040 |
| cagctacgcc | acctgggccg | ggacaagatg | cccagggtgt | atgaggcggt | caacgcgctg | 20100 |
| caatcagtgg | cctacgagat | caaccacgac | gtgtacgaga | tcatcgagcg | cgtcttcact | 20160 |
| tccggcggcg | gtgtgctggg | catccctcag | cgcacctacc | cggacaaacc | tgagttcccg | 20220 |
| ctcggcgacg | agtgggccaa | ggagaacgcc | agtgaacaag | agctggaagc | cttcaaccgc | 20280 |
| tggaagcgat | ccgtccaccg | atggtacacc | ggcgagcggg | agcataccgc | caagcttcgc | 20340 |
| gagtttgctg | cactctaccg | agttgttcga | gagcatcatg | gcaaggcagt | gtacttcccg | 20400 |
| atgcacgttg | actcccgtgg | ccgcatgtac | tattggggca | caccgaatcc | ccaggggtcc | 20460 |
| gacatcgcca | aggcatgtct | gcgattccac | gaaaagcgtg | ccctcggtaa | gcgcggactg | 20520 |
| tactggctca | aggtccacgt | cgccaactcc | ctcggatgcg | acaaggtgta | cttcgacgac | 20580 |
| cgagcagcct | gggtcgatga | gcgctgggac | gacttccagc | gagcgctcga | cgaagggccg | 20640 |
| gagaactatc | cgaatctctt | ccccgaagac | gagtccccac | tgtgcgccat | cgcaggtctg | 20700 |
| ctggagttgc | gggcggccta | cgcttccggc | aatcccgagg | gctacgccag | tggtttcatc | 20760 |
| gtccacatgg | acgccacctg | ctccggcctc | caacactact | cggctattct | ccgcgacgag | 20820 |
| atcggcgggg | cctacgtcaa | cctgctgcca | cctggacttg | caaaagctga | tatctactcc | 20880 |
| cgagtgctcg | gactcgttaa | tgagtctctg | gagagagacc | gagcggaagg | cgcggatggc | 20940 |
| gaggcgcggg | gttatgccat | tctatgggat | aaagctggtc | tgacgcggag | cctgaccaag | 21000 |
| aagccctgca | tgacgctggt | gtacggcacc | acgttcaagg | gcgtcgtgga | ccactgcctg | 21060 |
| gactacctcg | acgagtccgg | tgtggagatt | cccgagggtg | tgccgtcata | ccgcctagga | 21120 |
| agctacatgg | cgacgctcat | actggacgca | atccgcgaga | cagtaccatc | ggcagtcttc | 21180 |
| gccatggagt | ggctccagcg | gcttgctagg | gcccttcctg | acgcatccaa | ggatttgcac | 21240 |
| tggaccacgc | cgctcggcat | gcaggtcttc | cagtcctacc | gaagaccga | ggaggtgcga | 21300 |
| gtacggctgc | gcgccgaggc | tgtcgagtac | gtcaccctgt | acgaggccaa | ggacgagctg | 21360 |
| gacccggtac | gcaacgccaa | cggcatcgct | ccgaacttcg | tccacgggct | ggacagcagc | 21420 |
| cacctgggcc | tgacggcctt | ggcatgcgcg | gcagagggaa | tcccgatcca | ggccatccac | 21480 |
| gacagcatgg | gcacttatgc | ggcagacgtg | gaccggatgc | acgttcacat | cagggagcag | 21540 |
| ttcatcgcca | tgtacagtgg | cccctgtgtg | ctcgtagagc | tggcaaagca | gcttggtata | 21600 |
| gaggctaccc | cgccccggag | aggatcgttg | aatctggagg | ctgtacggga | ctcctgggcg | 21660 |
| ttcttctgct | gaggcggatt | atgtcaccca | cataggagca | agtgcatccg | tccaaggccc | 21720 |
| tcgtagaggg | agcggggggag | aggagaggtc | agggaagacc | tggtagagga | gaggtgaaga | 21780 |
| tgagaatgga | tgactacgaa | ggattctaga | tagaatagac | taaccagcat | aggagatatg | 21840 |

FIG. 18M sequence.txt

| | | | | | | |
|---|---|---|---|---|---|---|
| atagatggct | actatgaaga | cccaccgccc | tacggttatg | tcacccacag | tggaaggatc | 21900 |
| gagaacaggc | aagggtacgg | cccgtcctgt | cacgttcacc | tctcagcaga | tcgagtggtt | 21960 |
| agaacagacc | ttccccgaac | atcagatcgg | tcctggaacc | acgatggaag | acatccagtt | 22020 |
| ccaggccggt | aggcgagacg | tggtgcgagc | agtacgcctg | cgccgacgcg | atgccatcgc | 22080 |
| agtggagctg | aagtgatgaa | caagtccatc | tggcgagtcc | acgcaaaggc | cggcactccc | 22140 |
| tcggaactcc | agggcctgtg | ctggctggcg | atacaggagt | tggaggagtt | caccctcttc | 22200 |
| cgctcgaaag | acgacgccct | gaatgcgatg | ctggacagta | tcgagggcaa | tgatcgaacc | 22260 |
| gagctgttgg | tattccgcga | tggccagttg | gctggcggtg | cctgcattgt | gttcgaggac | 22320 |
| gatccccacg | tcggcccgtg | cgtcacagca | cagtggcagt | acgtcctacc | gcgctaccgc | 22380 |
| aatacaggcg | tggtccggga | gttcatccgc | gaactccacc | gtcaggccgg | ctggggtcaa | 22440 |
| atcccctcg | tgtgctggag | ccatcgtgaa | agcgatagcc | ggtacacgat | ccactaccgg | 22500 |
| agagccaagc | cttatgggca | agaaagtaaa | gaaggtgctg | ggcaagacca | tcatcggcaa | 22560 |
| actcgctgat | ggcctgctgg | gcaccgacct | gagcggcgca | caatccgatg | cccgcaagat | 22620 |
| ggaagagcag | aaccgcctaa | tgcagcagca | ggcggaccag | ctcgcacgaa | accagcaggt | 22680 |
| tgacctcacc | gccgagaacg | tggcgcaggt | tgacctagga | gcgatggccg | atgccactgg | 22740 |
| caccggcacg | cgacggcgcc | ggaatcaggc | gggcacaggc | gtatcgcaaa | ccctcggtat | 22800 |
| caactactga | cgaggtacgc | catgaaaacc | accgcagcta | tgctgtggga | gaaacttcgg | 22860 |
| gatgggagcg | tggagagtcg | agccatcgag | ttcgccaaga | ccacgcttcc | ctacctgatg | 22920 |
| gtcgatccca | tgtccggcag | ccggggagtc | gtagagcatg | acttccagtc | cgccggtgcc | 22980 |
| ctcctggtga | acaacctcgc | cgccaagctg | gcgagatcgc | tgttccccac | ggggattccg | 23040 |
| ttcttccgat | ccgaactcac | tgatgcgatc | cgccgcgagg | ccgacagccg | ggacacagac | 23100 |
| attaccgaag | tgaccgctgc | cttggctcgg | gtggatcgca | aagcaacaca | gcgcctgttc | 23160 |
| cagaacgcct | ccctggcggt | cctgacgcag | gtgatcaagc | tactgatcgt | gactggcaat | 23220 |
| gctctgctgt | accgagacag | cgccgccgct | acggtggtcg | catggtcgct | ccgctcctat | 23280 |
| gcggtgcgtc | gagatgcgac | tggccgctgg | atggatatcg | tcctaaagca | gcgctacaag | 23340 |
| tccaaggacc | tggatgaaga | gtacaagcag | gacctgatgc | gcgcaggccg | caacctatcc | 23400 |
| ggttcgggca | gcgtggacct | gtacacccac | gtacagcgca | agaagggcac | ggcgatggaa | 23460 |
| tacgccgagc | tgtaccacga | gatcgacggt | gtgcgtgtgg | gcaaggaggg | ccgctggcct | 23520 |
| atccacctgt | gcccgtacat | cgtgccgacc | tggaacctcg | cacctggcga | gcactacggt | 23580 |
| cgaggccacg | tcgaggacta | catcggcgac | ttcgccaagc | tgtccctgct | gagcgagaaa | 23640 |
| ctcggcctgt | acagctgga | gtcgctggag | gtcctgaacc | tcgtggacga | ggccaagggt | 23700 |
| gcggtggtcg | atgactacca | agacgccgag | atgggtgact | acgtgccagg | tggcgcggag | 23760 |

FIG. 18N sequence.txt

| | | | | | |
|---|---|---|---|---|---|
| gccgtccgtg | cttacgagcg | tggcgactac | aacaagatgg | ctgctataca | gcagagcttg | 23820 |
| caagccgtag | tcgtccgcct | gaaccaggcg | ttcatgtatg | gtgccaacca | gcgcgacgcc | 23880 |
| gagcgcgtta | ctgccgagga | agtccgcatc | actgcggagg | aggcagagaa | cacgctgggt | 23940 |
| ggtacatact | cgctcttggc | tgagaacctc | cagtcgcccc | tggcctacgt | ctgcctatcc | 24000 |
| gaggtggatg | acgcgctact | ccagggcttg | atcaccaagc | agcacaagcc | ggctatcgag | 24060 |
| acgggcctcc | cagctctgtc | ccgctccgcc | gctgtgcaga | gcatgctcaa | cgcttcccaa | 24120 |
| gtcatcgctg | gcttggcccc | gattgctcag | ctcgatcccc | gcatctcgct | accgaagatg | 24180 |
| atggacacga | tttgggcagc | cttcagtgtc | gatacgtcgc | agttctacaa | gagcgccgac | 24240 |
| gaactggaag | ccgaggcaga | acagcagcgc | cagcaggccg | cacaggccca | ggcagcgcag | 24300 |
| gagaccttgc | tggaaggcgc | ttccgacatg | accaatgcac | tcgcaggagt | ctgatagatg | 24360 |
| acccaaccga | acgatcagca | actgccaccg | ggcctcgcta | acctggttgc | caacgtaccg | 24420 |
| cccgccgccg | cgccgacccc | gagtcatgtg | caggtgttgc | cgaacccggt | gatccagccg | 24480 |
| caggctccgg | tccagcccgg | ccaggtaggt | gcgccgcagc | aactggccat | cccgacccag | 24540 |
| cagccgcaac | ccgttccgac | cagcgccatg | acgccccact | accagccggt | agcggtgccc | 24600 |
| gtcgccggtc | aacccgttgt | tccgcaagca | cccgctcagc | cggccccggt | agctccgccg | 24660 |
| gctgcgggtg | cagttcttcc | cgagaacctg | gaagtccgc | cgcctccggc | cttcactccc | 24720 |
| aacggggaga | tcgtaggcac | cctggcaggg | aacctcgaag | gcgacccgca | gttggcgccc | 24780 |
| tctatcagct | atctggaagc | attctctgac | aagctggata | ccgtccgtgc | cttcggcaag | 24840 |
| gccgccgaga | accgcgatcc | gcgattcatc | gacgagcact | atctgaagga | agtcctgggt | 24900 |
| ccggcccagg | cacagcacgt | catcaacgtg | gccaagggcg | tcctgaccta | tgtcgatgcg | 24960 |
| cagaccaagg | ccgtcctgaa | tcagacctat | gccgccgtcg | gcggtgaggc | cgtcctgaag | 25020 |
| caggctgccg | gagtcttcaa | ccagcacgct | gacccggcca | ccaaggccgc | catcggtcgg | 25080 |
| ctgatggact | cgggcgatgc | ccaggccatg | cagtacgcag | cgaagcaaat | tgtggccttc | 25140 |
| gcacaaggct | cgggtgccgt | ggtacaggct | accggccaac | ccctgggtgc | tgcggcacct | 25200 |
| gcactggcag | ctctgagcgc | tgagcagtac | cgcttggaag | tatctaagct | gccgctgaac | 25260 |
| gcatccgaag | ccgagatggc | tgcgctgcgc | gagcgtcgta | aggcaggcat | ggcgcagggt | 25320 |
| atctaacgac | cctgccctac | tccggcctta | aacccacatc | caaaagagag | agaatcgcat | 25380 |
| gagctttctg | aacgacctga | ctcgtccgaa | ctacgctggc | aagaacgcgg | acgttgacat | 25440 |
| ccacctggaa | gagcacctcg | gcatcgtcga | taagcacttc | gcctacacct | ccaagttcgc | 25500 |
| accgctgatg | aacatccgcg | acctgcgtgg | ctcgaacgtg | gtccgcctgg | atcgcctggg | 25560 |
| taacgtcgag | gccaagggtc | gccgcgccgg | tgaagagctg | gagcgcagcc | gagtcgtgaa | 25620 |

FIG. 180 sequence.txt

| | | | | | |
|---|---|---|---|---|---|
| cgacaagtgg | aacctgaccg | tcgacaccct | gctgtacctc | cgccaccagt | tcgaccacca | 25680 |
| ggacgagtgg | acccaatcct | tcgacatgcg | caaggaagtc | gccgagctgg | acggccagga | 25740 |
| actggctcgc | aagttcgacc | aagcctgcct | gatccaggtg | atcaaggctg | ccgcgatgga | 25800 |
| cgcgccggtg | gacctggaag | atgcgttctc | gccgggcgtg | ctggagaaac | tggacctgac | 25860 |
| cggcctgacc | gccaagcagg | ctgccgacaa | gatcgtccgc | atgcaccgcc | gcgtagtcga | 25920 |
| gaccttcatc | gaccgcgacc | tgggcgatgc | ggtttactcc | gagggcctga | ccccgatgtc | 25980 |
| gccgcgtgtg | ttcagcctgc | tgctggagca | cgacaagctg | atgaacgtcg | agtaccaggc | 26040 |
| aaccggcgcg | accaacgact | acgtgaagtc | ccgcgtggcc | atcctcaacg | gcgtcaaggt | 26100 |
| gctggagact | ccgcgcttcg | ccaccaaggc | aatcgcagcc | cacccgctgg | gccgtcactt | 26160 |
| caacgtgagc | gccgaggagt | ccgagcgcca | gatcgccctg | ttcctcccga | gcaagaccct | 26220 |
| gatcaccgcc | caagtggcgc | cggtccaggc | caagctgtgg | gaagacaacg | agaaattctc | 26280 |
| gtgggtcctg | gataccttcc | agatgtacaa | catcggtgcc | cgtcgtccgg | acaccgctgg | 26340 |
| tgccatcgaa | ctgaagggta | tcggcgcctt | cgacatcacc | gcgtgatgcc | acgaaacccc | 26400 |
| gcacttcggt | gtggggtttc | ttcaaagcct | aacgacccgc | gcagattccc | tgcgtgggtt | 26460 |
| tttgcgcttt | aggagaaacc | ctatgctact | actcgacgca | gtgaatgtca | tcctgcgcaa | 26520 |
| gatcggcgag | ctgccgattc | cgagcatgga | tgagacgtat | cccaccatgg | ccattgccct | 26580 |
| cccggagttg | gaggaccagc | gcatccagtt | gctgacgcaa | ggctggtggt | tcaacacctg | 26640 |
| gtggaagcac | aagctgacac | ctgacccgca | gggtcgcatc | aacctgccca | aggatacctt | 26700 |
| ggcattctac | cccgactccc | cggacctcca | gtgggacggc | ctgggagtac | gggatgccaa | 26760 |
| caccggcgac | gaccgtatcg | gcaagtcggt | cgagggtcgg | ctggtgctgt | cccgcgagtg | 26820 |
| ggaccgtatc | ccggagattg | cgcagcgcgt | cattgcgcac | caagccgccc | ttgcggtata | 26880 |
| cacccacgag | attggcccgg | acgagaccgc | ccaggtcatc | gcccaggaat | gcaggcgta | 26940 |
| tcagaacgaa | ctgtctcgca | tgcacactcg | atcccgtccg | ctgaacaccc | aggccaagcg | 27000 |
| tagcttcagc | cggtggcggc | gtagcttgag | gacctgagca | tgagctacaa | gcaatccgcg | 27060 |
| tatcccaatc | tgctgatggg | cgtgagccaa | caggtgccct | tcgagcgcct | gcccggccag | 27120 |
| ctcagcgagc | agatcaacat | ggtatccgac | cccgtgtcgg | gactgcggcg | gcgcagtggt | 27180 |
| atcgagctga | tggctcacct | gctgcatacc | gaccagccct | ggccgaggcc | gttcctctac | 27240 |
| cacacgaacc | taggtggccg | cagcattgcg | atgctggtgg | cccaacaccg | tggcgagctg | 27300 |
| tacctgttcg | acgagcggga | tggacgcctg | ctgatgggcc | agccgctggc | ccacgactac | 27360 |
| ctcaaggccg | acgactatcg | gcagctacgg | gccgctacgg | tggcagatga | cctgttcatc | 27420 |
| gccaacctga | gcgtgaagcc | cgaggccgac | cgcaccgatg | tcaagggtgt | agaccccaac | 27480 |
| aaagcgggct | ggctgtacat | caaggccggg | cagtattcga | aggcattctc | tatgaccatc | 27540 |

FIG. 18P sequence.txt

| | | | | | | |
|---|---|---|---|---|---|---|
| aaggtcaagg | acaacgccac | gggcaccacc | tacagccata | ccgccactta | cgtgacgccg | 27600 |
| gacaacgcca | gcacgaaccc | caacctcgct | gaggcgccat | tccaaacgag | cgtaggctac | 27660 |
| atcgcgtggc | agctctacgg | caagttcttt | ggtgcgccgg | agtacactct | gcccaactcg | 27720 |
| acgaagaagt | acccgaaggt | ggacccggac | gccaacgcgg | caaccatagc | cggctacctc | 27780 |
| aaccaacggg | gcgtgcagga | cgggtacatc | gcgttccgtg | gtgatgccga | tatcgtggtc | 27840 |
| gaagtgtcca | cggacatggg | caacaactac | ggcatagcct | ccggcggtat | gagcctcaac | 27900 |
| gccacggcag | acctgccagc | cttactgccg | ggcgcgggtg | ctcctggcgt | gggtgtgcag | 27960 |
| ttcatgggcg | gcgctgtcat | ggccaccggc | tccaccaagg | ccccggtata | cttcgagtgg | 28020 |
| gattccgcta | accgccgctg | ggcagagcgg | gccgcctacg | gcaccgattg | ggtcctgaag | 28080 |
| aagatgccac | tggccctgcg | ctgggatgag | gctaccgaca | cctacagctt | gaacgagctg | 28140 |
| gagtatgatc | gacgtggctc | cggcgacgag | gatacgaacc | ccacgttcaa | cttcgtcacc | 28200 |
| cgaggcatca | ccggcatgac | gaccttccag | ggtcgcctcg | tcctcctgtc | gcaggagtac | 28260 |
| gtctgcatgt | cggccagtaa | caatccgcac | cgctggttca | agaagtcggc | agccgcgctg | 28320 |
| aacgacgatg | atcctatcga | gatcgcagcc | caggggagcc | tgactgaacc | gtacgagcac | 28380 |
| gcggtcacct | tcaacaagga | cttgatcgtc | ttcgccaaga | agtatcaggc | cgtggtcccc | 28440 |
| ggtggcggca | ttgtaactcc | ccgcacggcg | gttatcagca | tcaccacgca | gtacgacctc | 28500 |
| gataccaggg | cggcacctgc | cgtgactggc | cgcagtgtgt | acttcgctgc | ggagcgtgcc | 28560 |
| ctgggtttca | tgggcctgca | tgagatggcc | ccgtctccgt | ccacggacag | ccactacgtc | 28620 |
| gccgaagacg | ttaccagcca | catcccgagc | tacatgccgg | ggcctgctga | gtacatccag | 28680 |
| gcggcggcct | ccagcggcta | cctggtgttc | ggcaccagca | cggcggacga | gatgatctgc | 28740 |
| caccagtacc | tctggcaggg | caacgagaaa | gtgcagaacg | cgtttcatcg | ctggacgttg | 28800 |
| cggcatcaga | tcatcggcgc | ctacttcact | ggcgacaacc | tgatggttct | gattcagaag | 28860 |
| ggccaggaga | tcgccctggg | acggatgcac | ctgaacagcc | tgccagcccg | tgagggtctg | 28920 |
| caatacccta | aatacgacta | ctggcggcgt | atcgaggcga | ccgtcgatgg | tgagctggaa | 28980 |
| ctgaccaagc | agcattggga | cctgatcaag | gatgcctctg | ccgtgtacca | gctacagcct | 29040 |
| gtggccggcg | cctacatgga | gcgtacccat | ctaggcgtga | agcgcgagac | gaatacgaag | 29100 |
| gtgttcctcg | acgtgcccga | ggccgtggtc | ggggcggtgt | atgtggtcgg | ctgcgagttc | 29160 |
| tggtcgaagg | tggagttcac | tccgccggtt | ctccgggacc | acaatggcct | gcccatgacc | 29220 |
| tcgacccgtg | cagtgcttca | tcggtacaac | gtaaacttcg | gctggaccgg | cgagttcctg | 29280 |
| tggcgcatca | gcgacacggc | tcgacccaac | cagccgtggt | acgacacgac | gccccttcgg | 29340 |
| ttgttcagcc | ggcaactcaa | tgccggggag | cctctggtgg | atagcgctgt | ggtgccgctg | 29400 |

FIG. 18Q sequence.txt

| | | | | | |
|---|---|---|---|---|---|
| ccggcacggg | tcgatatggc | cacgtccaag | ttcgagctga | gctgtcacag | tccgtacgac | 29460 |
| atgaacgttc | gggctgtcga | gtacaacttc | aagtccaacc | aaacctacag | gagggtgtga | 29520 |
| tggctttctg | gctaccacta | ttggccgctg | gcggcatgtc | cgcccttcaa | cagggattgg | 29580 |
| ccaacaagga | agagcgcaac | aagatcaagg | ccgagaacaa | ggctcgactg | aagacggacc | 29640 |
| tcgacaacct | gggcgccgct | gcccgcgaca | tcgccaacct | cggagtcatg | gctgctagct | 29700 |
| accgcaagca | agccgtggcc | tcgcaggtgg | aggccaagcg | ccaggggatg | ctagccggcg | 29760 |
| gaagcgccga | ggctcaggcc | ggggcgttcg | gcgtcaaggg | tgcatccgtc | gatgcggtgg | 29820 |
| ccctggatat | cgagcgggag | gtcggcgagg | ccctgatcca | gattgacgac | aacctggaca | 29880 |
| atcagatgtg | gaacctcgcc | gagcaggcgc | actccatcca | ggctcaggct | aaggccggcc | 29940 |
| tgctgggtca | gaagagtacc | acggcggggc | aacggtcccc | gctggtggcc | ggtctgatgt | 30000 |
| cggcgggttc | cctgtacgca | agtcaatact | tcaagttcgg | cgccacgcct | aaaggaggca | 30060 |
| actgatggcg | gaatcgcaac | gtgcttccca | agagcttggg | atcaacgtcg | gacagacgca | 30120 |
| actccagccg | ggccagagtg | ctcggcgcgg | agtgcgcgac | tccgaggtca | actacagcgg | 30180 |
| tccgagcgta | ggctcgcaga | ttctcgacgg | catcctgggt | gccggtcagc | agatcgctgg | 30240 |
| caaatggttc | gagcacaacg | tgcagcagga | agttctgcgc | ggtgagcgtg | cccgtatggc | 30300 |
| cggcgaggcg | gaggaggcag | tagacagcaa | cgtactggcc | aaaccattcg | tgaagggtgg | 30360 |
| ttggcgtaag | caggactacc | gtatcgccca | ggcggacttc | agcctgaaga | tgcagcgatt | 30420 |
| catcgccaac | aagggccggg | agatgactcc | cgaggagttc | cgcaagtacc | tgtcccagga | 30480 |
| ggctacgcac | gtcctggact | cgaccgaggg | catgaacccc | aacgatgcct | acaggcgct | 30540 |
| ggcgcagcag | cagaaggccg | aggaacagct | cttcggcatg | caggctaagg | cgtacatgga | 30600 |
| ctggtccatc | gaccaggccg | cccgtggctt | ccgtacccag | ggtaacagta | tcctggccaa | 30660 |
| ggctgtgcag | gctcaggcca | ccggcgacga | actgtcccgg | cagctcagcc | tggaagaggc | 30720 |
| cggcctgttc | tataccaaca | tcatgacctc | cgaggatatc | ccgctggagg | tgcgcgacaa | 30780 |
| ggtaggcatg | cagttcctgg | cggccagcct | ggacatgaac | cagcggggca | tctatgaggg | 30840 |
| cctgcgcgat | gccgggttcc | tggacagtat | gtcctttgac | gaccggcgtg | cgctcaacgg | 30900 |
| cctctatgaa | aaatcgaagg | cacagacccg | tgccaaggaa | tcgatggcta | ccctgcgggc | 30960 |
| cgacgcggac | ttccagcagc | gggtggccaa | cggcgccatc | acagaccttg | ccgaggttga | 31020 |
| agcgtactca | cgaggcatgg | tcgaggaggg | ccgctggagc | gacgctcagg | ccatctcatt | 31080 |
| catgaccaag | gccatgaccg | gtctgggcaa | tgcccaacgc | atgcagggca | tcatggcggc | 31140 |
| cctggaagcg | ggggacatca | acgccctaca | cacgctgggg | acgaacgtta | ctgaggccct | 31200 |
| ggagcagtgg | gacaagatgc | aggccgccaa | cggctcaagc | ctgactgacc | gtctcgtgca | 31260 |
| gggcacacag | ctcggcctgc | gcctggggac | cttccccaag | acctacggcg | agtccgtggg | 31320 |

FIG. 18R sequence.txt

| | | | | | |
|---|---|---|---|---|---|
| cagcgcggtg | cgcatgatcc | aggccgccaa | agaaggcgag | gcaaacccgg | agctggtcaa | 31380 |
| cacgctgaac | agcatcttcg | agcaggtggc | ctcggcccag | gagatcaacc | cctccgccgg | 31440 |
| caacgtgatg | ctatccggca | tcccggaagc | cgagcaaggt | gccgtggcct | gggcactcaa | 31500 |
| gcagatgaag | atgggcatcg | caccagctca | agctctgcgc | gagttcagcg | ccaacgccga | 31560 |
| agtcgtgaaa | cagatggacg | agttcgagaa | aggccagaac | accaaggcat | tcaaggacaa | 31620 |
| cctcggcaag | caggtcaacg | acaagttcgt | gaacaacatc | ttcggtcggg | cctggaacat | 31680 |
| gctgaccggt | gaaagcgacc | tgagtaacaa | cgaggccgtt | ctcagcatgt | accgtcgagc | 31740 |
| aaccatcgac | gaggcgaact | ggctggccag | cgaccgcaag | catgcgggtc | tgctcaccag | 31800 |
| tgacacgggc | cgcgaggccc | tgctggagat | cgccgccgcc | aacgtgcgta | accgcaccat | 31860 |
| ccaggtaggc | gaaggtcgga | atctgaagga | aggggaccta | ttcagccgcc | gcgatagcgc | 31920 |
| gccgctgatc | ctgccgcgtg | gcaccaccgc | cgagcagcta | ttcgggacca | acgacaccga | 31980 |
| gaccatcgga | accgtcctgg | ccgagcagca | caagccgcat | gtcgaaggac | tcctcggcta | 32040 |
| caagtcggta | gtcgccttcg | agtacgaccg | caccaggggc | agcctcctcg | ccgtcgagta | 32100 |
| cgacgagaac | ggtgtggccc | tggaccgcac | gcgggttgat | ccccaggcag | tcggtaacga | 32160 |
| ggtgctcaag | cgcaacgcgg | ataagctgaa | tgcgatgcgg | ggcgccgagt | acggtgccaa | 32220 |
| cgtcaaggtc | agcggcacgg | acattcgcat | gaacggggt | aacagtgccg | gcatgctgaa | 32280 |
| gcaggacgtg | ttcaactggc | ggaaggaact | ggctcagttc | gaggcttacc | gaggggaggc | 32340 |
| gtataaggat | gccgatggtt | atagtgtggg | cctggggcat | tacctgggca | gtggcaatgc | 32400 |
| tggggcaggc | actacagtca | cgcctgagca | agccgcgcag | tggttcgccg | aggacaccga | 32460 |
| ccgcgcactc | gaccagggtg | tgaggttggc | cgacgagctg | ggcgttacga | caatgcctc | 32520 |
| tatcctggga | ttggccggta | tggccttcca | gatgggcgaa | ggacgtgccc | ggcagttccg | 32580 |
| taacaccttc | caggcgatca | aggatcgcaa | caaggaagcc | ttcgaggctg | gtgtacgaaa | 32640 |
| cagcaagtgg | tacacgcaga | cgcccaaccg | ggccgaggca | ttcatcaagc | gcatggcgcc | 32700 |
| ccacttcgat | acaccgagtc | aaatcggtgt | cgattggtac | agcgccgcaa | cagcggagta | 32760 |
| agacatggca | aagcaattca | agggccgcat | gacgcccaag | tatccccttg | accaagtaca | 32820 |
| gctcgacgag | gcccaagtac | agggccaact | cgacgcggtg | cctaccgtgg | ggttcgacgc | 32880 |
| cctgacgggt | ggtgagatcg | gagaacggaa | cgtggcagcg | ggccaacgag | ccaatgcgcg | 32940 |
| ggaactggaa | cgcatcgtag | cggaccagga | actgccggcc | cttgaccgtg | cttccgcact | 33000 |
| ctggaaccag | tccacccctcg | tcggacgctg | ggtcgatgcg | ctccagctcg | acgcagacct | 33060 |
| tgcggcgaac | agtaccggcg | aggtggaccc | taacttcgac | gctgggacct | atggggtcca | 33120 |
| ggcgctccag | gcggcaggta | tccagccgac | tgataactac | cttcagatca | tggcccgtgc | 33180 |

FIG. 18S

```
sequence.txt
cggcaatgcc gaggacgcgg cctacctcct atcgaggatt caacggtatg agcaggacga        33240
acaaatcgtg cgggacaacc catactggaa cttcgcggtt ggtatgctgg acccggcagc        33300
cctggcagtt gatgcggtta ctttcggcgc tggccgtgct ctgcggctcg gtcgtgctgg        33360
catggctgct gctggcggcg ctgggcaagt cgggtatgtt gctgggctgg atgccgcagg        33420
ggccgatgtg gatgctggaa cctacatcgt ggcgggtgct cttggcgctg gcgtgggtgc        33480
tctgctgggg tctggtgcgg gacgcattgc cgcagaggcc caacgcaac cgcatgtgcc         33540
cgaagtatcg gcgcctactg tcgggctgcc agaagtagcc atgaccgccg aggaggccgc        33600
agcacgcggc ttcaaggcag gtgacgtggt agacctgctg gacgagggca ctgtgctatc        33660
ccgtgtcagt gcccgcgtgg agcaggctga gataccggct attccgcgac gtgacactgc        33720
cttcggcgac gagctgcata gcctgtcggg ccggaagctg tctgaggtcc tggaccacat        33780
caagacccac gcagaggtgc ccaagccgct ccagggcatc gccgccaagg tggctgacac        33840
tatcaggacc ctggagggcc tggggcagcg taccgcgttc cgtgtggtgc agggcggtga        33900
cactgccagc tctgccttcc tcaaaccggg tacggcgggg attcactcca cccagggcct        33960
cgacaccctg gtccaggtac gcggcagcac cgcacctggt cgagttggca ccaacccggt        34020
gaccgtgctc cacgaggcgg ttcacgctgc caccgtgggc gtgatgaacg ccgccctgcg        34080
caaccccggt gcgatgagtc cgaaggtggc tcaggccatg cagaccctgg agaatgtccg        34140
gggtaacgtg ctcaacgccc tgaagcagga ccgcgccgcc ggtcggcaac tgtccgagtt        34200
cgaagagaca ctgctggccg gtaactccaa caccctggcc aacgtcaagg aactggtagc        34260
ctggggcctg acggataccc gcttccagcg gaccctgaat cgcctccgct acagcgacgg        34320
cgggccgggc ctgtggtccc gcttcgtgga gggcatccgc accctgctgg gtctgcggtc        34380
cgatgctgac acggccctga gccgcgtcct ggccgcctct gagacgatta tggaggccat        34440
gcccggttac actaaggcac aggccaagtg ggccaacaag ggcgctccgg taaccgagga        34500
ggccagcctg gagaccatcg tccggtccac cagggagcgc gcccgcgagg gtgccggctt        34560
cgtgaacagg ttcttcagcg aggcagacct cctggcacag cccggagagg gcgcacggcg        34620
actcctgagc cgtcttattg acgacccggt acgtcgggat gggttcagca cgaacgacaa        34680
cgcagcgagc tatctccgcc gctatcggaa cgagttcgag ggctacgtga agtcctacga        34740
cgagatgatg gccaaggcaa tggctgagca gggtgtgggc ctgacggcac gtgcgctgaa        34800
ctcccgccgc gccatggcag tccgggacca gctcaacgag caggtcaccc gcgagctgct        34860
gcgccgggac cgggagtgga ccgcctacgg cagcgtccgc gtggacccta acctacctcc        34920
gaccatcaag gccctggccg accgctcaga cgagattcat ggtctgatgg ccagcgtgc         34980
cagggaagct gggggtgcgcg ggttcgagaa cttcgcaccg cgaccgggat acttccaccg        35040
ctcgtggaac tggtcgaaga tggcgcagat ggacgaggcc gccctgccc tggcccgccg         35100
```

FIG. 18T sequence.txt

| | | | | | |
|---|---|---|---|---|---|
| tgccatcagt | gaggccgtgt | tccgtggcat | ccctgggctg | gagcgcgccg | acgccgatac | 35160 |
| catcgcacag | gccattgtgc | agcgggcgcg | ggatcgggcc | accggaatcc | gctccgagtt | 35220 |
| catgggcgcg | atgggcgtgg | cggacacggc | attcatccgg | caggcgctgg | aggaggccaa | 35280 |
| cgtgtcccag | gccaagttcg | acagcatcat | ggccaagatc | gagcagaagc | agtccgacca | 35340 |
| gggcaccgtc | aagtacggca | agggccggct | gtcgctggac | atgaccgccg | agatcaacca | 35400 |
| caacggcacc | gtgtatcgtg | tgcaagacct | gatcgaccgg | gacctcgacc | ggctgatgga | 35460 |
| gaactacgcc | ggcagtatgt | cgggccgctc | agcattggcc | cgcgcaggca | tgccggggga | 35520 |
| ctcggagatc | gaagccttca | tccgggagta | ccagcgagag | gcagcccacc | tgggcaccga | 35580 |
| taaggtgcag | gagctgacgg | ggcaactgcg | gggagtcttc | ggggacttca | ccggcaacgt | 35640 |
| gccgagggag | catcagctcg | gcccggttgc | tcagcgggcc | agcggcctaa | ccagcgccac | 35700 |
| catgctggga | ttctccggcg | tgtaccagct | cgccgaactg | gccacgatgg | cgcaccgtca | 35760 |
| aggcgtcttc | aacgtcatga | aggccatgct | gaactcccgc | ctgggagact | tcgtgggcgc | 35820 |
| catgcgtcgc | gaccccggacc | tcgctgacga | gatgcagacc | gtcctcggcc | tgaacctcgc | 35880 |
| caacgatatc | cggatgaagc | cctggaagcg | gcagttcgac | accttcctgg | tcagccaaga | 35940 |
| caccttcatg | gatcgcttcc | tccacgcagg | taagcaggct | gtcccagtgc | tcaacggcat | 36000 |
| gaagttcatc | cacaactggc | aatcccgtat | gaacgccaac | ctcaccttga | acaaggtggc | 36060 |
| gcgggcggcg | caggggggatg | aagcagcccct | tcgcgtgctc | cagcagtacg | ggaaggacgt | 36120 |
| ggactggacg | ccagtcctgg | cgcggggttcg | cggttatgtc | acatacagag | gaaggaacgc | 36180 |
| ccgatccatg | aattggggcg | cctggagcca | agcagacgtg | aacactgtca | tgaacaccgc | 36240 |
| actgcggatc | atggacgact | cactcctgta | cggtagggtc | ggtcagaact | cgggcttcgc | 36300 |
| tcggtctccg | gtcggtcaaa | tcctgggcca | gttccgcagc | tttgtggcct | tcgcacacaa | 36360 |
| caagctcctc | cggggaacct | atgagaactc | cggcgtgctt | ggcgtggcct | cgctcctcgc | 36420 |
| attccagtat | ccgctcaccg | cgctgatgat | gggtgccaag | gcagcgatca | acggcaagtt | 36480 |
| cgacacctct | gatgaaggca | tccgcaagat | ggccatcgac | ggcatcggtt | acactgccgg | 36540 |
| cctcggcttc | accgccgaca | tgtggggtgt | gatcaccggg | cactcccgga | tgtccgcacc | 36600 |
| ggtctttggc | ctggcggagc | actccaacga | ggtgttccgc | ggcgtcaagg | acctagtaac | 36660 |
| cggcgacgac | cccgcagccg | ccaccggcga | tatcgtcaac | ggcgccgcag | gggcactgcc | 36720 |
| tttcgtcaac | gtattcccgg | cgaccaagtt | gctgctggaa | tccatcaaag | gggaataacg | 36780 |
| tggctcggtt | caagaatccc | gagaccatcc | acgtcgcaga | tggggtcgag | gctgtcttca | 36840 |
| gtctcgactt | cccgttcctg | cggcgtgagg | acgtattcgt | ccaggtcgat | aagatactcg | 36900 |
| tcaccgacta | tacgtgggta | gacgacacca | acattcaatt | ggccgtggtg | ccgaagaagg | 36960 |

FIG. 18U sequence.txt

```
atcaagaggt ccgcatcttc cgcgacacac ccgcccaggt cccggacact cagttcagcc    37020
agggcatccc gttcctgcct cgatacatcg acgcgaacaa caagcagctc ctgtacgctg    37080
tgcaggaagg catcaacacc gcgaacctcg ctctcgacgg cgtactcgac gcgatccgca    37140
tcgccgagga agctcgtcgc ctggcacagg aagcactcga cgccgccaat gaggcgctgc    37200
gccgtgccct aggcttcgcc gagattcgca ccgtgaccga ggactcggac atcgatccga    37260
gctggcgtgg ttactggaac cgctgcatca cctccgagca gtccctgact ctgaccatgc    37320
agatggagga cccggacgag ccttggatcg agttcagcga ggtccacttc gaacaggcgg    37380
gcattcgcga cctcaacatc gtggccggcc ctggcgtgac catcaaccgc ttgcagaaca    37440
ccaccatgca gctctatggc gagaacggtg tgtgtaccct gaagcgcctc ggccctaacc    37500
actggatcat cttcggggcg atggaggacg actaatgcgt ggcattatcg caggtgtggt    37560
ggcgtcgcag attcgccggc ccaagccggt gctgaccacc atcacctacc cgcagtcttc    37620
ctcggatcgt gggggtatga cgtttcatgc catcgccggg atcatccaag ataccgtgaa    37680
gttcgcggat agtaaggacc tgggtagtta tgagatgctt gtgcgggacg ctaccctgaa    37740
gagcatggtc attacactca ctgaggttaa ggacagtagc gtctggagta tgggtgtgct    37800
gagtgcggca atcaaatccg tagttcagtt cttgacacca gtcgaggaga aatcctcgtt    37860
ggatatgagc atcatccacg gcgagcacaa gcaatcggtc attccatact cccgctgggc    37920
tgaggctggg tccctgtcca tgggtatcac agagggtaaa gtttatgtac catagcagca    37980
ccattcgagg tgagttcgat ctggagattg tacgtcctga cggtacagtc cgccagcacc    38040
tgcacttcaa gaacctgatc accgacttgg cccttgaggc catgagttcc aagggcgtcc    38100
cgagtggcgg ctggacgaac atgttcgccg gcactggcaa ccgtaccccg gtccccgctg    38160
acgtgtccct cgtggcgcct gtggctaatg ccagtgcctc gctgaactac ggcaaccgcg    38220
cagtgtggga ttccaccact ggcgagaaag tgcatactgg cacggggacc ttccgcgcag    38280
gttccttcca aggccagtcc ctggccgagg taggaatcgg tcgggtagtc tctgagctgt    38340
actcccgatc cctgatcaag gacgccaacg gcgatcctac cacgatcacg gtgctggtgg    38400
atgaggaact gcgtgtgacc tacactctgc ggattgctcc gccggcgtcc agtgaagtca    38460
agatcacgat gaagggtatc gagtacaccc tgagcatgcg ggaccgccgt accttccggg    38520
acttatcgcc cgagcctgcg gctgagtttg gcactcgcgg cagtctgtcg tggagcgcta    38580
tcagtgcgcc ggacagtaac ggccagacca agaccgccaa cttgagcggc gacgccggga    38640
ccgggattat ccaggttcct gcacagtctg cacagatcat gcgtatccag cccgccgatg    38700
ccaactggac ggaaggtatt cagtacctcc gctgggagac tccggcagga cgtgagctgg    38760
agatcaagct ggacccgcct ctggtcaaga acagcttgga gcgcgtggac atcaccgtaa    38820
cccacatctt caatcgggta tgattcagtt caagttcggt gactaccgga cccgtgtgcc    38880
```

FIG. 18V sequence.txt

| | | | | | |
|---|---|---|---|---|---|
| cttccagggt | gcgcgggacc | ggcgggatat | caacgaccgc | agcgactacg | tggacggtgg | 38940 |
| cgtcgccatc | caagaccta | gtcaaggtct | gttgtatcag | gagtggcacg | ccgagctact | 39000 |
| cgaagacggc | atctacctga | cacctgagaa | agagcgagtg | actacccgca | tcggaccagg | 39060 |
| tatcaatgaa | ggcgtggcta | gtatggcggt | cacgttcgac | cagaacatga | actatgtcct | 39120 |
| ggtgtatacc | aagcaaggcg | aaggcttcat | cgacttcttc | gattccgcta | ccgaagagcg | 39180 |
| caatgtgatg | aaccttgggc | cggtggacta | tatcaagaca | gacctagacg | atcggcggcc | 39240 |
| agagggcagc | gcctgggcgc | aggttctggt | ctgctacaca | cggcagggaa | acttctacgt | 39300 |
| ccgagccagc | tcaactcgct | ttactgaaga | ggagcttatc | gtcggtacgg | gcaaagtgac | 39360 |
| ccggcctatc | gtcaaatgcg | gaatggcagc | gaactggaga | ttccaggtcc | tgttccgagg | 39420 |
| gagaatgtaa | tgagcaagaa | gcagaccgcg | agtgctgagc | ggctgggcct | gctacatgag | 39480 |
| ctggtctgca | ccgccatcga | gcgtaacttc | aagtggtaca | tggacaacga | catcccgatc | 39540 |
| cccgcatcgg | atatcgctgc | cgccaccaag | ttcctcaagg | acaacgagat | cacctgcgat | 39600 |
| ccgtccgaca | ccatcaacat | cgaccgcctc | cgcgaggaga | tgcggcaggc | gcaggcggag | 39660 |
| aatcgccgta | tcgcgctgga | gggcttcatc | gccggtgaga | cggacgatga | gatggaacgc | 39720 |
| ctgtacaccc | actaaggagg | cagcatgacg | ccgcaagaac | gattccagat | agcccacgag | 39780 |
| gtgcgggaca | tgtacccgcg | cttccgggac | ttctgcctgg | acgccatgct | gttcctcggc | 39840 |
| ttcaagatga | cgtggatgca | gctcgacatc | gccgacttca | tgcaggactc | gcccaacaag | 39900 |
| gcgatggtcg | ctgcacagcg | cggcgaagct | aagtccacca | tcgcctgtat | ctatgtggtg | 39960 |
| tggtgcataa | cgcagaaccc | ggctacccgc | gccatgctgg | tatccggttc | cggtgacaag | 40020 |
| gccgaggaga | acggccagtt | gatcacgaag | ctgatcatgc | attgggacct | gctggcgtac | 40080 |
| ctgcgccccg | aggcccgcat | gggtgaccgt | acctcggcca | ccagcttcga | cgtgaactgg | 40140 |
| gcgttgaagg | gtgtcgagaa | atcggcctct | atcaactgca | tcgggatcac | cgctgccctc | 40200 |
| cagggctacc | gggctgacat | cctgatccct | gacgacatcg | agaccacgaa | gaacggcctc | 40260 |
| accgccaccg | agcgggccaa | gctgacgcgg | cagtcgcagg | agttcacctc | tatctgtacc | 40320 |
| cacggtaaga | ttctctacct | gggcacgccg | cagtcccgtg | agtcgatcta | caacggtctg | 40380 |
| ccggcgcggg | gcttcctgat | gcgcatctgg | ccgggccgct | tcccgacccc | ggatgagcag | 40440 |
| gaacgctacg | gtgactggct | cgcaccttcc | atcctagcgc | gcattgcccg | cctggaggag | 40500 |
| aaaggccaca | acccgcgtac | tggcaagggc | ctggatggca | ctcgtggctg | ggcggctgat | 40560 |
| ccgcagcgct | acaacgaaga | ggacctgctc | gacaaggagc | ttgaccaagg | ccccgagggc | 40620 |
| ttccagcttc | agtacatgct | ggacaccagc | ctcgccgacg | agcagcgtat | gcagctcaag | 40680 |
| ctgcgcgacc | tgctgttcat | cgacgccacg | catgagagcg | tgccggagca | agtggcctgg | 40740 |

FIG. 18W sequence.txt

```
gctgccgacg agcgcttcaa gctcaagttc gacgcccacc gattcccggt catcaagcct     40800
gagctgtacc tgccggcgct gatggctggc ggctgggcac cactccagca aatgacgatg     40860
ttcgtggacc ctgccggcga cggtggcgac gagctgtcgt atgccgtggg cgggactctt     40920
ggcccgtaca tccacgtcgt gagcatcggc ggctggaagg gtggctttgc tgaggagaac     40980
ctggagaaat gtattgccct agctgcgcgt tatggcgtca aggtgatcta tgtcgagaaa     41040
aacctcggcg ctggtgcagt tggccagctc ttccgcaacc acatgcgatc catcgacccg     41100
gacaccaaca agccccgcta tgaggggatc ggcgtagaag accgccagaa gtccggacag     41160
aaagagcgtc gtatcatcga caccctgcgg cccatcatgc agcggcaccg tctgatcttc     41220
cacgtatcgg cgatggattc cgaccacgtg gcctgccagc agtacccagc ggacaagcgc     41280
aatgagcgct ccgtgttcca ccagattcac aacatcacca ccgaccgagg ctcactgccg     41340
aaggacgacc ggatcgatgc ccttgagggc cttgtccgcg agctagcacc cacgctcgta     41400
aaggacgacg aagccgcaac ccgcgctcgt gaagaggctg ccaagaagga atggctgaac     41460
aacccgatgg gttacactaa gtctgtcctt cggtctctcg gcatgggccg ggagcgtcgc     41520
aagggccgcc caaaaggacg aagactatga tgctcgatac cgccaccgag gcgggcaaag     41580
gcaccctcgc cgtcactggc gtggggatcg ccgtttactc gccctatgag atcgccagcc     41640
tctgtgctgc ggtactcacc gcgctctatg tgggcgccca gctcatcacc ctgctcccga     41700
agatgctcga tagcatcgcg gagcttcgcc ggaggttcaa gaagtgaaca agccctgcg     41760
cggcgcagcc cttgcggctg ccctcgccgg ccttgtcgcc ctggaaggta gtgagaccac     41820
tgcctaccgg gacatcgccg gcgtgcccac catctgttct ggcaccactg ccggggtcaa     41880
gatgggtgac aaagccacac cggagcagtg ctaccagatg acgctcaagg actaccagcg     41940
cttcgagcgc atcgtcctgg acgccatcaa ggtgccgctg aacgtcaacg agcagaccgc     42000
cctgacgttc ttctgctaca cgtgggtcc agtctgtaca accagcacag cgttcaagcg     42060
cttcaaccaa ggccgcgcca ctgagggctg ccaagccctg ccatgtgga acaaggtcac     42120
gatcaacggc cagaaggtcg tatccaaggg cctcgtgaat cgccgcaacg cggagatcaa     42180
gcaatgcctc gaaccatcgt cgcaatactc gtccttgctg tggtagccct gggagcctca     42240
tacggcttcg tccagagcta ccgggccttg ggtatcgccc aggaggagat caagcggcag     42300
acggcccgtg cggaggccct ggaggtgcgt tatgccacct tgcagcgcca cgtcaaggag     42360
gtcgctgcca ggaccaacac ccagcgccag gaggtggacc gtgccctgga ccagaaccgc     42420
ccgtgggctg accggcctgt tcctgctgct gtcgttgaca gcctgtgcaa ccgccccggc     42480
gcccgctgtg ctgtgcgaac acccactgat tgaccctacc acccaggctg gcctgatccg     42540
cgctgtagcg gcctatcagg acgccctgga cctatgcaac gccttgaatc aaggagactg     42600
acatggcgaa cacccgtgag caataccctcg ctggccgtaa caccggcctg accttctacc     42660
```

FIG. 18X sequence.txt

| | | | | | |
|---|---|---|---|---|---|
| aggtctgcca | gcccggcacc | gacaaccgca | tcgccctgca | cgacatggac | gaggccgatg | 42720 |
| tcaaggccaa | ggccaccgcc | gtaatcgcag | cagccaccgc | cctgggcggc | gaaggtggcg | 42780 |
| ctactccacc | ggacccgctc | accgcctaca | aggtgaagaa | cggtgacacc | ctgcccgtgg | 42840 |
| acggcggtgg | ttccgtgaag | gtgaccgtag | ccaacggtgc | tatcaccaag | gtcgtgtaca | 42900 |
| ccgcaccggc | gggctgagct | acagcccgtc | ccacctgact | ccatccctaa | cacaaggaac | 42960 |
| tgaaccatgg | caaccttcgc | cgctgcaact | cagaaagacc | tccgcgcctt | cgccggcgct | 43020 |
| atcgagaacc | tgatccgccc | tctggaagaa | gcggccttgg | gttccggctt | caccgaggtg | 43080 |
| atcaccatca | ccaagggcac | cgatggcaac | gagactcgca | cctccgagcg | taaggtacgt | 43140 |
| cccgagctgg | tcgctaacct | cgacgccctg | atggccgctg | tcgagaccgc | caaagccgcc | 43200 |
| gtctacaagt | aaggggacac | catgagcaaa | gccaaactac | gagtcatcgc | cgacaccccg | 43260 |
| gagctggagt | cagtgctaaa | agcattgctg | accgccacct | acgctatcga | gga | 43313 |

FIG. 19A sequence.txt

<210> 560
<211> 137360
<212> DNA
<213> Unknown

<220>
<223> Description of Unknown: Bacteriophage F44/10

<400> 560

| | | | | | |
|---|---|---|---|---|---|
| aatttcatta | gaaaagaatt | tttttctttt | tctatagtat | ctttcttgtt | atcgtattct | 60 |
| gaatacatca | taaattctat | aaatatacta | tttctgtcag | atgaaaacat | atctatagaa | 120 |
| aacggacaat | caaaacttat | gtcatcttta | ttaatactaa | aacattcagt | aacatttaag | 180 |
| tcatttattt | catatacctc | aaagtatcca | tcaactcttt | taagttctat | agcactatta | 240 |
| tatctataat | aacgttgttc | ctctattaac | ttatcttttg | ttagataggg | atattcattt | 300 |
| ataaatatag | gattacttgt | tccatagtta | tttttaatat | attcagcatc | ttctaaggaa | 360 |
| tcagtataac | ctaaaacttc | gtaacttgtt | gtatacacag | tatcctcttc | ccacaagtca | 420 |
| tagtccattt | cctctatttc | ttcctctagt | atataaattt | ttttcatata | ttactcccaa | 480 |
| acaccaataa | gatttttaag | tttagctata | acttcttctt | ctgtttgata | agaaaatact | 540 |
| cctgtaatgt | gtccatagtt | acctataatt | tcataatcct | gtgtaccatg | tttgtctact | 600 |
| agatatgagt | tacccataac | atttaaacta | tcctccgagt | aactgaaatt | tatattatag | 660 |
| tctactaaaa | aattaataat | ttttttcatt | tacataacct | ctccatcgg | atattgtcct | 720 |
| aacattcttg | ttccattttc | gttatagaag | gtatattcta | ctacaataat | attcattata | 780 |
| tcgacatata | tagcttctat | ataaggtgta | atattctctt | cttcttgtat | gtgtttacct | 840 |
| ataatattat | ataataattc | agagtgtatt | cttttatctc | tcattataga | cctccgtaag | 900 |
| aaatgataca | gtcttatctt | ttaaagattt | ttctactagt | tccatagcat | ctttataatg | 960 |
| ttttatatta | gattcattag | acttcagttt | atcttttact | tcttgaatta | gaggttcaac | 1020 |
| tttagtaact | aaatcttttt | tattttctat | actcacattg | cttcttttat | tatctaatac | 1080 |
| ttcctttggc | atatacttaa | cttttgcaaa | gtctttatag | ctaacattta | agttatctaa | 1140 |
| atcatctaat | aaatcattat | aatattctaa | atgattatag | aatgtgtaaa | acttaacaag | 1200 |
| gtctttacct | gctagctctt | cttttttag | tatattattg | atattaccaa | taacagaata | 1260 |
| tgctataggc | ttaaaattag | ccctaacata | agttaaaaat | ataaaatcat | cataaaacaa | 1320 |
| gtctaaaaca | gttttattga | atctagtatt | tttagcttgc | tctaattgag | cacataaatt | 1380 |

FIG. 19B sequence.txt

| | | | | | |
|---|---|---|---|---|---|
| aagaacatta | tcaaacccac | tctttaatac | caaagagata | aatctttcca | ctgcatagta | 1440 |
| cctagatact | tcagtatgtt | tgcttgcttt | ttcactattt | ctaaaaatag | tatctgataa | 1500 |
| aggttgaact | actaaactca | tataatcttt | atctgaatat | tcatccgatg | ttccttgata | 1560 |
| agtacttcca | aattctattg | tagataataa | aaaactttt | tctaaattca | ttataacatc | 1620 |
| ctccttttac | ttgttattat | aatactaaca | catatgttta | ttaatgtcaa | acattaaata | 1680 |
| tcttctgttg | tgtcaacttc | atcttgtata | tacttaaagt | attcataaat | tttaaatagt | 1740 |
| ataactccta | gtgttattaa | tcctaaaata | tatttcataa | caatcctcct | taaaagtatt | 1800 |
| tatccttccc | atcctgataa | agcatccata | gccatatcat | actcttcttc | attttttagtt | 1860 |
| cttataattt | tctctatttc | tttttttgct | tgtttagagt | tcataaaatc | aatatctact | 1920 |
| gtatctaaat | ttgtataatc | aatattttct | ctaataaagt | tcttttgact | tggtgttata | 1980 |
| gaattaactc | gtacgttttc | gtgatttaaa | aattgataga | agtccatact | attcaccttc | 2040 |
| ttttaaacag | tctgccatat | cttttaaagt | attaagtaca | tatttcaaat | ctctataata | 2100 |
| actatcagaa | aaactaataa | cagcatatgg | tgtcatatca | ctatagtgtg | cacaatcaaa | 2160 |
| acctaatacc | ctatagtcac | cctcatgttc | atcgtatgtt | atacctccat | gggaacaatc | 2220 |
| ttctatacta | ttaaactgtt | ctttggttat | attcgtaggc | acattaatat | aaccatttag | 2280 |
| atgtcctgaa | tgagggtgac | gtttaacagt | taggtttatt | cccttataat | ctatatttaa | 2340 |
| agttaagtcc | tctcctaata | tattatcctc | tttatctata | atttccataa | tatgttctgg | 2400 |
| agcttttcca | aacatcataa | ttcctccctt | ttctttatac | tcttactata | cactactttt | 2460 |
| tctattttgt | caacaaaaaa | aggctactaa | ttaaagtagc | ctaagaatta | attatttagc | 2520 |
| attatatttc | cattgccaat | aaccattttt | ctgtgagaac | tcaaagtgaa | aaccgtcata | 2580 |
| gtcaaattca | atattatagt | ctccatcttg | aagtggtttt | gaatttagta | caggactatt | 2640 |
| actctttgcc | aattctgcta | gaaactcatg | atttactttt | tccatagggt | ttattcctcc | 2700 |
| taattattct | tacagtacta | atatatcaca | ggtcttttc | taggtcgttt | ttaaatttct | 2760 |
| cctcataaga | actagcataa | gttacttcat | aacctattac | cttagtataa | tctatgcaaa | 2820 |
| gtaatttata | attggacttt | attttaatat | cctctgattg | ttctatttta | ttgataactt | 2880 |
| catttagctc | attcgaagag | taatgtttat | tatcaacttt | tattgttttt | ccttgggtat | 2940 |
| agatatcaat | ttcttgtatc | atcatttcat | ccttttgatt | attcattatt | tgattataag | 3000 |
| tctctaaatc | atcaatgtta | tctgtatctg | aacctttac | taaccattct | cctctcttct | 3060 |
| taaggaggtc | atcaaatttc | tcatgttctt | taattatctt | ctctacttca | ctcggtatta | 3120 |
| gaacagctct | agcgtaattt | atatgccaca | tagacatatt | atcaataaga | taattaacca | 3180 |
| ttcttataag | ttccttctca | tttgccatat | accaacctcc | ttatatctaa | tactaatata | 3240 |

FIG. 19C sequence.txt

| | | | | | |
|---|---|---|---|---|---|
| agagaaaagc | agacttatta | aaagtctgct | tctgtaccta | attctaatct | tttattttc | 3300 |
| atatgaggaa | tcatttttct | atctcctgtt | aatagagata | attctctagc | tttttcttta | 3360 |
| gataatgtta | atagtccatt | ataattatct | actttcttat | tatattccat | aattaagcgc | 3420 |
| tctagctcat | atgatatatc | ttcgagttct | cctgatttaa | ctccaagtaa | ctttctatac | 3480 |
| atatcataat | cttcagaaag | actttctact | ttattttag | atacagaatc | ataaactgct | 3540 |
| tgtaaattac | cttcttcaat | aagtttaaag | ttatgttcac | ctatgattaa | ttcctcctca | 3600 |
| gaagaatcaa | gcgttactaa | tccgcttgta | ttacctgtaa | agtcaccttt | ataatctaca | 3660 |
| acaataccgtt | cagttacttt | gtcacctaat | tcaatagtcc | catcttcatt | ttctttaaat | 3720 |
| ttatgagcat | catatacttc | tactttgtca | cctaatctca | aatcttgagt | taagttatgt | 3780 |
| ttaccaataa | ttctatccat | tactcaatct | ctcctttatt | aatagggtct | tgtgttaaga | 3840 |
| acatttctag | attctctttt | gtaataggta | accaaaaata | tttactttcc | ggaattgtaa | 3900 |
| ttgtatagaa | atcctcatct | ttgttaactt | taatattaac | atctgtaaac | tcatcctgca | 3960 |
| ttaaccaatg | agttacagtt | aagttatatg | aaccatcact | aacatacccct | aaatcaatat | 4020 |
| catgtctaaa | agccaaatct | tctaaatgtt | ctaataaatc | gttcttttca | ttatgttttt | 4080 |
| cttcttctgt | attattttta | attgggttaa | ttaactctgt | gcaaacaata | tcgtacaatt | 4140 |
| caccatctgt | aacctcatag | ttcttttcaa | ttaatacatc | ttgtatttta | ttgattgagt | 4200 |
| ttgtaactac | tttcccatat | tcttcttctg | taaacttaca | tttatctaaa | tcaacatctg | 4260 |
| taattaattc | tgcaatccat | ttatttaaaa | ttgatactgc | cattgttcta | gaaataatac | 4320 |
| tgtcgtatac | catatttatt | taatctcctt | atttaggtga | atgtggtctt | ctaatgaaaa | 4380 |
| atcaaaggc | gctacaccat | ttctttatt | atttgtttct | tttttaagta | taacataagt | 4440 |
| tagtgaaaaa | gtcaagatag | ttactacaac | cattgataaa | aatttaatca | ggttttcat | 4500 |
| aattactcta | actccttaag | tttattttt | actttctctt | tatcgtactt | ataatcttta | 4560 |
| ctagagtttt | cattttttc | tttctcttct | tcattaagtt | ctctatactg | agcctcttct | 4620 |
| acctcttgtt | ctttattatc | attaccttct | tctgcttttt | gaatttctac | atttttacta | 4680 |
| ctaccaccat | ttaccttttt | tctaaaaaga | aaccaaagta | ttaataaaat | gatgagtaaa | 4740 |
| ataataatgc | ttaatacaac | agcccaaata | ttattaacca | ttacaaccta | cctccgaata | 4800 |
| gttttttac | ggctcttaag | ttttcagatg | aatcattatt | tatatcaata | cctatgctag | 4860 |
| aatcaaaaat | tacagcatta | tcaagtatat | gctctgtcaa | tttattaccg | taactacttt | 4920 |
| tacttaccac | actaccataa | ccatgattag | ttaggtcaac | catatcaggt | tcaacttcta | 4980 |
| gtactctaaa | agatattcta | cgtaagaatg | aaggatttac | caagtaaaag | gaagatttaa | 5040 |
| aaacatttaa | tctttgataa | gaatgtttta | tattaacaac | aaaccctgtt | aacttatttt | 5100 |
| catattctga | atttgataac | ttacctaggt | aaaggtttat | actatatcct | tttgtttcta | 5160 |

FIG. 19D sequence.txt

| | | | | | |
|---|---|---|---|---|---|
| atgtttgaat | agcacttaac | attatagccc | ctctataagc | aaggttttca | gggtcttcca | 5220 |
| tccaactaat | actagaatta | taaaatacat | caataacttt | cttctctgct | ttaactcttt | 5280 |
| gctgagacat | catagaatta | ggtaaccctt | ttatagcatt | aggtacgtga | ggttgatacc | 5340 |
| cttccggagc | tacgacaggt | tttcttttta | ctgacttatc | cattctaaat | aatgcatctg | 5400 |
| tcatttttt | aagtttaact | accatatcat | atgattctct | atcaccctta | accattaagt | 5460 |
| tataggcttc | ttgaaaacta | tgagttcctg | taaaatcata | gctacctgta | tctgatgaat | 5520 |
| tttctctacc | tgaaactcta | ttcttttta | aagcagaaaa | gaaatcaggt | agaccatcat | 5580 |
| atttaattac | atttaattct | gagttatcta | ttaatcgtct | acccattgat | tttcctccta | 5640 |
| ttctaatcct | aacttatcca | taattgtatc | aaagtccatt | gaatcttttg | atgtactatt | 5700 |
| agattttcta | ggttcctgtt | taggttcttg | ttgcatacct | aaaagctttc | ttgttgcttc | 5760 |
| tgtatatctg | ttaccttcag | gtaaagagct | aataaattga | ttaatctcat | ctttcggtac | 5820 |
| agatttaaag | ataatacttt | ctacaacaaa | ctcatcttcc | attactccat | ctaatttact | 5880 |
| accattaata | attgcacgca | ttgagaatac | ataaggtaat | cctttttcat | cattctcatg | 5940 |
| tcttaattgt | tgtacaaagt | ttactaagtc | ttcattgctt | gatagttgat | gttccacctt | 6000 |
| agtatcatag | tcaaattcaa | cttgagcaaa | gcggtctaat | gtagctccat | ctaattgttg | 6060 |
| tctacctaca | taaatatggt | ctgctcctgt | tcccatagta | ttacctgctg | acacaactct | 6120 |
| gaaatcttca | tgagctgtta | cacgtccaat | agggaagtca | aagtatttat | ttgcaatagc | 6180 |
| tgaattaaga | attaatagta | cttcaggaat | agatgcatcc | atttcatcta | agaagaataa | 6240 |
| cccaccttt | gtaaatgctt | tatagaattg | agtttcatga | aacttaccat | ttgcatcaat | 6300 |
| aaatcctgtt | aatttaaatt | cttgagtaat | tgcattacta | aaatagaaat | ctaaatctag | 6360 |
| ggcttctgct | acttgttcca | atacatggtt | cttacctgaa | cctgctccgc | cttttaaaaa | 6420 |
| tactggaata | ttttggttaa | ctaactttag | tatatcttga | tatctgtaat | ggaagattcc | 6480 |
| tgagatatct | ttaattgttt | ttccttcttg | ttgtaattca | attttaactg | gtaaattact | 6540 |
| aagttgttct | tctacatact | cttcaatttg | tttttttaaca | tcagtaataa | taatttctct | 6600 |
| actctcagtt | cctgctttct | caacaattgc | atctacaatt | gcttgttcat | acggattaga | 6660 |
| gttttctct | cctagttttt | ttgctaaatc | tgctgttgtt | tccatttgtt | gctctaccaa | 6720 |
| tctctctaat | ctttcaatag | tatcttgctt | tgccatattt | atcattctcc | tttgatttgt | 6780 |
| tatacattta | ttatattaca | agtatttgaa | tttgtcaaca | actttctaaa | acttttttag | 6840 |
| ttgctaataa | aaaaatacct | tacacctata | acttaacata | gggtaaggta | attgtcaaca | 6900 |
| cttttgttaa | aaatacatta | atttaaaaaa | atcatcaata | tctttagttc | catgtgtatc | 6960 |
| catatcatac | ataaacatac | aattatatgt | atgactattc | attatttcta | acatgttatg | 7020 |

FIG. 19E sequence.txt

```
catagaagtt gcattattga attcctctaa atcaatagtt accgtaagtt cttgaccttc    7080
ataaagtatg tttgctatat aatatttcct aacaccttcc attgttccat gggaagtttc    7140
attatgatta agtacttcta cacctagtga aggtaaatat tctgaaaagt aatatttaca    7200
gaaatatata aaattgtctg ttcttttaga cacgagtact atctccgtac tttatatttc    7260
tttctaatcg tacataatat gttttaattt tttgtacttc tttatctact gcatcctttc    7320
ttcctaacct tgtagtatat tttacaatat taaatatcat agaatcaaca aagccatcat    7380
aagaaaaatg ttcttctaga aaagaaataa catccttact acctttataa tgttcaggta    7440
aatgtgcatc tacttgtata ttataataat cttctaaaag acctatactc tcaccaagac    7500
tagataaagc gtaacctaaa tcatttgaat cattagacca ttctttagat actgatagtg    7560
catcttctat aattgttact tttaatttat ctaaataatc ttctacttga gcttgtgttt    7620
tcataaattc ttttgcgttc atgtaatacc ctcctaaatt atataaaaaa aacaccctgc    7680
ttggatacaa gcaaggtgaa aaaggaaaga tattatggaa gtgtactatc taagtacacc    7740
tcataatata acagttttcc ttgctagtta ttacttattt tttaaggtct tcttctttga    7800
caaacactcc gttaataagc ttacctttcc tttctttat ctcatcataa gccatatcaa    7860
tacactcttc aatatctata tctaactgta aacatagtac tgttaatact acaaaaatat    7920
ccccaacact atctcttgtt acatggtcat tacttttagc aatacctgaa gctaattctc    7980
ctgcttcttc taataatttt aacatttgac cctcgggttt acctgtttgt aagtttctat    8040
cttttgccca ttgtttaata agttctactt tttccattat tctatatctc ctttaatttc    8100
tgtatctttg ataattaggt tatcagagtc acttgttaca tttaagttat cttcaactaa    8160
ttcatgtaga ttattagtaa tatcttcttc ataccctataa cctacacgaa cataagcttt    8220
aactctgata tctatattaa cataatcttc ttggaatttt tccatttcta acttcctttta   8280
ttatatcata ttattatact attgtcaatt aatctgagta gtttcctttta gcaagttgat   8340
acttttgtg taattcttca tataattctc tcataccttc gtagtttctc atatcatctt    8400
ccaagaaact aagataatct aataatactt ttacatcctc aggttctaaa gttataactg    8460
gttttaccat taggcaacct ccttaaattc ttctttattt attttcttaa tatcttttc    8520
taatgcttct tttaattcat taggtaattt ataggcatca attgattgtt gttgacctaa    8580
tacatatcca ttatctgtga tacgtatttc cactgtaaac catgaattat ctaaatcttc    8640
ttctaatctt gctaataata ttaaacaact atttttaaa attctattag catcccgcc     8700
aacacaatga gataacattt taccttcatc tttaagttta cttacagtat ctgcaggaag   8760
gaatttact tttctaccat cttttaattt ataagttta tcaattattt tttctaattt    8820
attatcatat ttagctttaa gttccgcatc atctaattgt tgttgtatag attgtttctc    8880
atctgtaact atatcatgtt ctagttttaa tgagaatggt gttaggttaa cactttctaa   8940
```

FIG. 19F sequence.txt

| | | | | | |
|---|---|---|---|---|---|
| tgttctataa | ccttctctta | ttaatattga | taaatcatgt | aagtaatcta | agtaatagtt | 9000 |
| atctagtgca | tatcctgtta | tacgttgtct | gtcttgagca | tctacatcta | aatagtgagt | 9060 |
| catcttttg | tagttagcaa | aagatataga | taatatttca | tttacaatag | gttttacttt | 9120 |
| taaagcattt | gtaacatctc | ttgaatctct | aaccattaaa | aaggtatcgt | caaataattg | 9180 |
| gtgtaaatta | acttcattgt | gtaaatgatt | atagttctta | tagagagtat | tagcaaatct | 9240 |
| taagtaatta | ccttgctcaa | atttatttaa | agttagtagc | tttttataag | tctgttttgt | 9300 |
| aagattgaag | gcttcatgaa | ctttccattt | agggttttta | ggtatatgga | atagtaatgc | 9360 |
| atttctttca | aataatccaa | attcttctaa | gttatttatt | ttatcaatat | ttttaacaat | 9420 |
| atctgttaaa | gttattaagt | aattagaagt | tgaattttct | cctataaaaa | tcctatactt | 9480 |
| atcccctcta | taatttatat | gaccataaac | atctatatta | tcaggacacc | aactagaaaa | 9540 |
| atcaaaatta | tgatgctcta | atgtttgttc | tattatcttt | attataattc | ctctatttaa | 9600 |
| gttaggttgt | gaatagtttt | ttaaaataac | atttaataaa | acagataatg | tcaattcatt | 9660 |
| tttgtattca | cttttactaa | tatcatcttt | atataggttt | aaagctattt | ctttattaac | 9720 |
| aagactatct | gttaagaaaa | ccttgactgc | tcctgtctta | acgtcaaatg | aacttttatt | 9780 |
| ttctaaaacc | catttgttac | ccatattatg | cttatccctg | atatgtctaa | ctttaagacc | 9840 |
| aaaagatgaa | ttattctcag | tacttgggtg | catgtaccaa | acacgactat | acaatgaatc | 9900 |
| tgacatttcc | ttataatact | cactagaacc | tttttctata | tcttcattca | taacaataat | 9960 |
| agatgaattt | ataagaacat | atttaccttg | gtctagtaca | tccatgatat | cattatttaa | 10020 |
| actatctact | gcttccttat | actcatctaa | ttgtctagct | tcatatcccc | ataaacggtt | 10080 |
| ttcattttct | aattctttaa | ttttttcttc | aacatacccct | ttagattgta | tttgttttct | 10140 |
| acgtctacta | ccatataaag | gaaaatcttt | tcttttctcct | ctatcagctt | caatatactc | 10200 |
| tttgtaattt | cttccttat | tattaccaat | cacaccttca | actaattttt | caactgtttc | 10260 |
| atagggtca | ccttcaaagt | ttgttacttc | tttattacca | catagggcta | aaaataaatg | 10320 |
| tatttctgta | gctgtatcaa | aactaaatat | attatgaata | tctctaaata | attctttaga | 10380 |
| acctaagtta | attatattat | ttttctttt | cttaagaaat | acatcttctt | ctcctatata | 10440 |
| gatacatcct | ttattaacct | taggtaaatt | aataatttct | tgttctgtta | atccttttg | 10500 |
| tttataagtt | attgccattt | aaaatcactc | cttatttgtt | atgtactaat | cataccatag | 10560 |
| taaataatat | ttgtcaacaa | aaaaagaaga | acttttaaa | gttcttctaa | atgagtttcg | 10620 |
| tatataactt | tttgaatttt | atttaatggt | tctaaatcta | aattcctaat | aagttttca | 10680 |
| tactttcttg | aattttaaa | attgatagta | tttggcatag | caagagcttc | atcaacatct | 10740 |
| ttagtatagc | ttacaacatc | tgaatagata | tctacttctt | ttacatatag | accttgagtt | 10800 |

FIG. 19G sequence.txt

| | | | | | |
|---|---|---|---|---|---|
| aaactcctaa | atactacctc | attatgtgct | ataatttctt | cttcttttc | tatgctcatt | 10860 |
| tataaacctc | ctggtctact | ctacacaaac | aagtacgtat | tctaaattag | ttaaagaaac | 10920 |
| tgatttaata | ttgtttaatt | cttgtaattt | cttaatttcc | acatcatagt | tcttacttat | 10980 |
| agtccataat | gtctctcctg | ctcttacttt | gtgataatat | ttatttccct | ctttgataag | 11040 |
| gtcattcaat | attacctacc | tccttgagta | ataattagct | tgtagataac | atataagtat | 11100 |
| aagaacaaag | tttacaaatt | cagtagctat | aatatgaaca | taggtatgtg | ttaaaaccat | 11160 |
| acttacaatt | aatgaagcta | atcctaatcc | aataataaga | aatagaaatc | tatttgttcc | 11220 |
| ttctgcactt | ttagttttat | aaaaggttgt | tatctgagtt | acatacgcaa | ggataatagt | 11280 |
| aatagttgct | acagtttgtg | ttaaggctgt | aaagtcactt | aataaaaata | gtaacagtga | 11340 |
| gaacacaata | ataaaggta | tagagaaata | gtcctttttt | ctatatgaag | ctactaataa | 11400 |
| gcaaacaata | cctagagtta | aattaagacc | aactgatact | acttgaaaca | tcgtagcatc | 11460 |
| agttagaagt | aaattgtaaa | aactaatacc | tactgtagct | acaattaaat | accaaaaata | 11520 |
| actactaaca | cctttaacac | tatctgactt | aactagggct | attaaacctg | gtatataacc | 11580 |
| tactgtaact | aatatagcat | ataatatact | taagtaatgt | gataaattat | ccatcttgtt | 11640 |
| cccctaattt | ctctaatcta | ttagtaactt | cttcccatga | aataaatcct | tctccgtttg | 11700 |
| ttaattctaa | aaccatacca | tacacaaatt | ggtttgtact | aaattcagct | ctgtcagggt | 11760 |
| cattgtatgg | tttaccatga | ccctgtctaa | tatcagagca | gtagattaat | acgggttttt | 11820 |
| ttaaaatata | ttcctgctct | ccaatttgtc | cttgtaaaat | atcatatgtt | tctgatagtt | 11880 |
| catctatctc | attgaactta | aataactcag | actgttcttt | taattgtttt | attgtttctt | 11940 |
| gtgcttgatg | tttcatacct | aataaaatac | ctagttctgc | aattgttcct | aatccttcat | 12000 |
| taagaacatc | aaatacaaaa | atatctgatt | cttgcatagc | cttaaagtca | ttagttaaaa | 12060 |
| tacgttctgc | tagcttagtt | tgttctgcat | tagctttatc | atttattgac | ttatctttgt | 12120 |
| gagggctata | cggagttact | cctacaatgc | catctacttc | tttatgttgt | ttatctctgt | 12180 |
| aatctaccat | agcttcattt | aggatatgtc | cacccatata | aattactttg | tctttaatttt | 12240 |
| tattaaccat | ctatagtatc | tcctttttct | tctaaaattt | ctcttaaaat | atgtggcatt | 12300 |
| tttttcttaa | tttgtttatc | tactatttc | agtatatttt | cttttcttc | ttccataata | 12360 |
| tcatcaacaa | agttttgacc | tacttgtttc | ataattagac | cgaagttttc | taattctaaa | 12420 |
| tcatcttcag | ataatctatc | ttcttctata | gccctaaaaa | tcatttttc | cattcttgct | 12480 |
| cttgtaatgg | cataatctgc | cactgactcg | ttctttttta | cttctgtttt | cattttttga | 12540 |
| cgactaaatt | ctttaaactc | attagatact | aatttaaagt | agtcatcata | ttctgattta | 12600 |
| ccatctaagt | atttaattac | tataccttca | cccttatcag | gtttaactgt | catgtcagat | 12660 |
| tttcctacta | attcttgaat | ttcttcaggt | tttaaatcat | ttaagtagtg | agatggttta | 12720 |

FIG. 19H sequence.txt

```
gctactagca aagtttaac tgttttaac cctaaatgat gtgcaattac attcatgtct    12780
tctattgata aataaacttc attttcttta tcataaacat caaatacata aaaattgttg    12840
taaaattctt ctttgtactg aatcttatgt ttgactaacc attcaccaaa aataatgtat    12900
ttttctaagg ctgatacgta cgtatttctt acatttatat tttcatgtac ccaatcataa    12960
aaaccattta aagtttcatt ctcatttaat ttttttctac gtgaaaaaca tactaattca    13020
ccattttcta ctgtgaagct tgcattactt ccatctaatt tttcttgtac aactagacct    13080
cttcttttaa atttatctag tacaataccct ttattttta ctttagtata cgatttcatt    13140
aattatcctc ctttgaatta tgtactatag aaaacaaaat aagacttaca ctagctaaaa    13200
atgctaatac tactaaacca ggtaaattaa gaactgttga taagaataat gatattgcac    13260
ttataacata aactagaccg cttagaaata aagttaataa tacaattgtt ataagtttca    13320
ccaaccaatt attattaata aataccttag ctaaataatt cataaaaaaa tcctccttag    13380
ttattataga ataactatac cataactaag gggatttgtc aacatattat tttaccattt    13440
aaaattgtct gcatattgtg caagcttaga gcggaaatta actgtaaaat tatgaaatac    13500
tgctccttca taattttaa agtattccat ataatctcca aaacctgatt tactttcgtt    13560
ctttaaatct atttgtttaa aattaccttc tactattaca gtagaatttt ttgtatgaac    13620
ccttgtaaga acttttttaa gttcactgcg tttaaagttc tgtgcttcat ttataattat    13680
agtagcatct cttagatttc cacctcttag gaataaatgg gatatttgag atacccaaca    13740
atctcctagt ttatcttctt taacattatc ttccatcatt aacatttcag ttatttgttg    13800
ttcaggattc atattaagtt caataagggc atcgtgtaat cccatgaaat aagccatttc    13860
ttttctgtc tgattacctg gtctgcttcc taaatcttct gatactggtg aaattataaa    13920
tactagcttt ctatttttat taagatagtc tgcgtaagca caggctactg agcacattgt    13980
tttacctgta ccggcttgac tctcattcca aagtatttca acattatcat taaagaaatc    14040
ctcacagaaa tctaactgct cggttgtagc tttttcaagg aattcattaa agattagatg    14100
ttctcccatg ttgtatctta cattaggata atcttttaac ttaaagtcta actcttttag    14160
ttgtattgcc atattttaaa gttccctat ctataaatag ttttactctc ttttaatata    14220
gtactaattt ccgatatatt ctcctgttga agagcaataa ttactacatt cacattcagg    14280
gtagttatca caaacatctt catcttctac atcatcataa ccaatatcat aattattata    14340
attaaaatct acaatacaat tttcactatt acctttagat aatcctgtat aaataatatc    14400
atccacagaa tcccaatcgt tatctgccaa gtaatttaca ctatctagta ctgattcatt    14460
atcaggtaaa taaatactac cgtctgaaaa tttaattaaa atatcacctt gaggtaaggt    14520
atcattaatt aaatcaatct ctgtttcttc ttcaatagtg aatacagttc cttctaatct    14580
```

FIG. 19I sequence.txt

```
ttccggtgta gtatgtgtta aatgttttac agtatcccct gattcttcat agaatcctac    14640
tgcattcata tctttattat attttgcaat aaatttacca ttgtcactta ccaaatattg    14700
actagttgca ttatagtcgt ttgcgtcatc tactgtcatg caagggttat aatctttaac    14760
ataataacta attttcctaa catctgctgt ttgtactttc ttaccttcac ctttaattac    14820
tgaattaatt ttcttcataa tattttctcc tttttatata tcaattgatt tttttgcaag    14880
attatcggca tagtcattcc atttgtcatt tgaatggctc tttactttta caaagtttat    14940
atctattact ttttggtatt ctcgtatcat attaatatat gttttactta gaatatttct    15000
tgcagaccaa gtaccttcat accaatgtat taaaccaata taatctatat aaactattgc    15060
ctgattgtat cctagtttta tagcctcttc aataccataa caacaagcca atatttcacc    15120
cgcaacatta ttatacttta ttaatcctgg tttgtcaaca cttttactaa tttccgatat    15180
tatatttcct tcttttactta ccaagacagc acctgagcct actttacctt tattatatga    15240
ggagctaccg tctgtgtata tatttacact atcctgcata cttataatcc tccataaatt    15300
gagggaattc acaatctgaa tagacttctc tgcaaaaaga tactgagata tagttaaaat    15360
caaaacattt gaaacagtgt tcttgaactt cttttttatc tttagcaatc acattaaatt    15420
taaaaccatc agctatgact gtaaatactc cttttttcat aaaacaaata cctccactaa    15480
tttttatttta aattaataac taactcaata aatgatttaa tagttttatt tttaccttca    15540
tcaatatctg aaaagaaatt aattaaactg tcatcctcat caaataaatc ttcaacatca    15600
tcaaatttat ttaatatgtc tgtaacactg taaccctctt ctgatatata ctcatgtaag    15660
tcttctccat cttctgacag tgttgcttct attttaccat ttttactttc aattaaatat    15720
aaagtattta atactttaac agaatctaca actacactgt agttactaat agtaggatac    15780
tctgtataaa gtatttctat attagtattc ataactat caattacaga gttaactgta    15840
tctcttttta gctcagatac attatgtttt cgtatagtag ggaattcttc atcatattct    15900
actaattctt ttctatctgt attcaataac ttgtctaaag aagacaacaa tactatttta    15960
tattggttat caggaagact gtctgtaatt tccattattg ttaaaaacgt atcttcacct    16020
agaactttgt ttatatcttg taattcaaat gaatctacca tttcaatagt atcatctata    16080
tcatctgtag tcattaaaaa attaactaaa ttattattct ccatcgtctt cctccaattc    16140
tttaaataac tcttttcctg gagtatttaa cgctttctct aaccgcatta aattagcact    16200
tcttggtttc tttttttccat actcccaata agatataaga gagtaatgaa cacctatctc    16260
agaagctaga cttcttaacg tatgtccttt ttctactcta attttttgaa ggtttagagg    16320
tttactttcc ttttttttcat ccataattat ttctcctcta cttttaaaaa tttaaaatcc    16380
tcagattctt ttgcattttt tagtatatac tcttgtgatt tatttcttgc ctctgcctta    16440
cttttagcat ataactctat atgaaataca tgaggtttt ttaaagacgg tgactcgtat    16500
```

FIG. 19J sequence.txt

| | | | | | |
|---|---|---|---|---|---|
| ctccaataaa | ctttaaaaag | tagtgtttct | tttttaaaaa | cattaattcg | aaaccatctt | 16560
| ttaaatttat | tcattcatta | tcctcctcta | tttatttgtt | aaactaatta | tagcatagtt | 16620
| aacttatgaa | gtcaactata | atatacaaaa | aagactaaga | aattaatctt | agccttaata | 16680
| tattaataac | tattatgtgc | gttgtggtat | gcaagagctc | ctgatgttga | accgtaacgg | 16740
| tcaatcatat | attgttttgc | acctttagtt | tgttctgcta | tagaaccacc | actccatgat | 16800
| ttacctaatc | cttggaatag | tccttgagct | cctgatgatg | cattaacagc | attagggttc | 16860
| attgtagatt | cacgcatagc | aatttcaatc | attgcctcgt | ctccacctgc | ttgtctaatc | 16920
| tgttctgcta | cagagcctcc | tgtagaacta | gttgattgtg | taggttgttt | agtttccttt | 16980
| tgaactggtg | ctgatgttgt | ttgtacttct | tttttagtat | cttgtttatt | ttgagtatca | 17040
| aattgtgctt | gttgttggtc | tacttttgt | tcaggtgttt | gttcttctcc | tgctaatcta | 17100
| gatactgtat | tatctacttg | agttgagcct | gaatggtatt | cataaccaaa | gttaccatta | 17160
| taattataga | aatgataagt | aaattcaccg | tcactaaatg | agaaatcata | attaccttct | 17220
| tgaattggtt | ttgtattgac | ttctgctgaa | tttgatttag | cctgttctgc | taacttatta | 17280
| taatcaattt | cgtctgcact | agcttcgttt | gtagcaatac | ctccaaaagt | aatagctgta | 17340
| cctaatgcta | atgttgcaaa | aattgttttc | ttcataaatt | taaaactcct | taaataattt | 17400
| tttagaattg | tttatttgta | aaccgacata | agtaatcata | acatatatct | ttaaataacg | 17460
| caagtataat | atagcactaa | ttagtgtaat | attattaagg | ttttattaca | aacattacag | 17520
| ttatcagata | attaaataca | aaaaaaagag | aggtattaac | ctctctaatt | tattattttc | 17580
| ctgttacatc | tacaatagtt | ccgtctccgc | caatttgaat | aggttgttta | ccatcccatt | 17640
| tttcaattaa | ctgttgacgt | aatatcttat | cagataagga | agattctcta | atctcattgg | 17700
| cttttttatc | accattagcc | tctacttctt | tttttcttagc | attttgttca | gcaatttgtt | 17760
| tatcaacttt | agtacgttct | aattcttggt | tagctttaac | tcgactgtca | attgcttttt | 17820
| gagtattctt | atctgcttta | gggctagata | atgcaatgtc | ctcaattaca | aatccttgtt | 17880
| tttctaagtt | gtcattcaag | ctatctaaag | tatcttttt | aatttcccct | gttttaactc | 17940
| caaatgcatc | aattacagaa | tacttagata | ctgcttgacg | gacattatct | tgtacccgtg | 18000
| aacgtaaata | tcctttttct | agttcttcga | tatctgcact | accaaaacga | ttaaataaat | 18060
| ctacagcttt | agttgcatct | actttataag | atacatcaat | atccatttgt | aaattcttgc | 18120
| catctgaagt | tgctacattt | aaatctttat | atttatgtgt | ttgtgtttta | gttgggtatt | 18180
| tatttacctt | atcaaaaggt | gctgttaaat | gccaacctgg | tgatttagta | tcttccttaa | 18240
| caccatttac | tgagtataca | actccaacat | gaccttgtgg | aatcttagta | atacacatta | 18300
| ataaaataat | aaaccctata | attgctaaaa | accctaatac | tcctgaaata | actactgact | 18360

FIG. 19K sequence.txt

| | | | | | |
|---|---|---|---|---|---|
| ttctcattac | atttctcctt | tttctatttc | ttttattaag | ctatttaaag | cttttcctc | 18420 |
| ttggtctatt | tcttgtttat | cggctctagt | tacaattgat | tgtctacggt | catttaagaa | 18480 |
| ttgtttttta | tactttacat | attgttctaa | accgtattca | tctaatgtac | cttgcctaac | 18540 |
| taattccctg | tattgttttc | ttatgttact | cttcttctct | ttcattgaaa | gaaaatcaaa | 18600 |
| taaataactt | ataccaaaac | ctacaaggac | tagaaaaaca | ataaaaatag | caaaatatgt | 18660 |
| taaaagtagt | gccatgtaat | tcctccttta | tttgattaca | tatataacta | tacactatgt | 18720 |
| atttaatttt | gtcaacactt | ttttgcaaaa | aaaaatagac | ggattttaaa | tccgtctaaa | 18780 |
| tttatattct | atttgaatac | tccccaggca | acgccaggta | tttgattagg | tggaacacct | 18840 |
| tgacaagttc | taacagggca | atatactctg | ttaccgttgt | aagcattata | acctatccaa | 18900 |
| atatgacctg | cttggataca | aacttcgtca | tatacaattg | tagcccctgc | cggtaagtta | 18960 |
| ccgcctactg | gagcatttaa | gaatggagaa | cctattctgg | ttactatagg | ttggttacca | 19020 |
| ttaacaaatg | ttgcgctttc | cggtttatac | caagttccga | actggttctt | tttccaagaa | 19080 |
| cctgtaactg | gtctagttgc | cggtgtactt | gcactacttg | ttttaccatc | tttaactaca | 19140 |
| gtagagcttg | aagttccgtt | actcatgtag | ttttttaattt | gtttaatgaa | gtaatctttt | 19200 |
| aacttattca | ttattgcttg | tgatggtctt | ccttgtgtta | ctgggttaaa | tcctgtatga | 19260 |
| agaaccatcg | aacggtgagg | gcaggcagtt | ggtacaaatt | ccatatgcaa | tcttacagtt | 19320 |
| ttacggttag | gagtaagacc | ccattcttta | aatttctctg | ctgtaaattg | gaatactgct | 19380 |
| tgttcatttt | taaggaattg | agcatcacta | gcactcattg | attgacagac | ttcaatacct | 19440 |
| gcaaatctaa | agttacctga | gtttgctcct | gttccatccc | ctgtgtgcca | agcaatttga | 19500 |
| ttcttagcat | ctattgcttc | ccatacataa | ccttcagagc | catagtaatg | agcaatacca | 19560 |
| ttagcatatc | tagcataacc | tgcattagct | aatgaattct | cgtattgttg | tcctgaagaa | 19620 |
| cgacctgcat | cgttgtgtat | taccattcct | tcaggttttt | taccacgttt | atccattgta | 19680 |
| tagttaatgt | gattcttaga | aactttttagt | gttgctttct | ttttaggtgc | aggtgtttta | 19740 |
| cttgcgcttt | tcttagctgt | ttctttttta | acagtagttc | ctgcttttac | aggtatttca | 19800 |
| atgaagtgag | ttaatccgta | ataattatct | acacgttttg | taggtttttt | attagcataa | 19860 |
| ccattccagt | tttgctctaa | aatagtaaat | gtagaagtat | tacctccatc | atatacaata | 19920 |
| cctatgtgac | cccactgttc | ataactaccg | gatgtaaata | ccgcaatcca | acctttttta | 19980 |
| ggtacagtag | aaggtttatt | ttcatgtatt | ttaaatccag | taccataact | ctgtttaatt | 20040 |
| tggtctttag | cattacccca | agttctaact | ttattatctg | ttaaccataa | aacatagtct | 20100 |
| gtaataaggt | cttgacattg | agcgtgatag | tagccatctg | cgtcaatggc | tcctgcttcc | 20160 |
| attacaccaa | atgacgggtc | ataacttgta | gctttttaa | ctctgtaagg | gctatctact | 20220 |
| gttcctttg | cataagcgtc | taaacgttta | tttatttctg | cttgagtctt | agccattact | 20280 |

FIG. 19L sequence.txt

| | | | | | |
|---|---|---|---|---|---|
| taacttcctc | ctctgcaaat | actttaccat | gttcctcggt | atcttcttca | tcttgagaag | 20340 |
| gtgctgaacc | accatcaatt | tcatcttcaa | tagcaggtac | ttcatcacta | tcatctgtgt | 20400 |
| caggttctgc | attgttttcg | tagctgtcta | tctcaaaagt | actagcgtta | tttgcgtttg | 20460 |
| tttgccattg | aacgaactca | ttagggtctt | tactatcacg | aggtttaacg | taatctgttt | 20520 |
| gaacaatatc | actgtctcta | agacctttag | tattattatc | aacaataata | cctaaacctg | 20580 |
| ctaataatgt | tagtatagaa | cctacaatat | ttacaccttg | ctcaatttga | gctgagtagt | 20640 |
| ctaaaccgaa | agcacctgta | atttggttag | caaataatgc | tactgctgat | ataattgcta | 20700 |
| cccaaaatgt | tttgctctta | gttcttgtgc | taaggtttat | tcctccaaca | actttaggtt | 20760 |
| gtttagtttc | attagccatt | aaaaaaccga | cctttctatt | atatttattt | ctaacaataa | 20820 |
| tataacagta | ggtcggtcat | gtttatctat | attaatttaa | cacttactca | ttaatttggt | 20880 |
| ttagtttttt | gataacttca | gacatttgtt | tgttatctaa | atcttctaat | ttagtttccg | 20940 |
| gaagtagctc | taacttatcc | caaacttctt | ctttattaga | tactttatta | ttaataattg | 21000 |
| ccttaccaac | taaactttcc | gtataatata | attgttttgc | tgatgccatt | tgtatctctc | 21060 |
| cttttaaata | tgtaaagtat | atagctagta | tcgtatccta | ggaacaaaca | cttgcgctat | 21120 |
| atactcaatg | aaatcctacc | ctcattcgag | gacacagcaa | accggttcgt | caaccgcaca | 21180 |
| tatgaattct | aagatttcat | ttatgtaaaa | cacccctct | ttgatttgca | caaagactaa | 21240 |
| gggttttgga | gacccttgta | ctactaatta | tactaagggt | gtttattatg | gtttctattg | 21300 |
| gatttgaacc | aatgacacct | agagcttcaa | tctagtgctc | taccatctga | gctaagaaac | 21360 |
| cttaaaacga | cccatacgag | actcgaactc | gtactctctg | ccgtgacagg | gcagtgtgtt | 21420 |
| aaccagttac | accaatgagc | caaaattata | atgctatacc | ctaaccttac | cttaatgtat | 21480 |
| agcaggtttt | ctcttaggct | cgaagcaacg | attattacca | ctcataacaa | ctatatatta | 21540 |
| agtgaaagga | ggtgaaatga | acaaacgtg | gtaattggta | cctaagaagg | taatatgtat | 21600 |
| aatctacaag | gagtaagtta | ttggttcata | aaggagtgtg | aacaataaat | acatgaaaga | 21660 |
| gtgaaagttt | actccctgta | gattcttttt | taattatcaa | tcaaaggagg | aaactgataa | 21720 |
| ttgttaataa | taaactataa | agaggaaaat | atttatagtc | acattctgat | ataatgcaac | 21780 |
| taaatatcca | agcataaccc | gtctcacgag | gaacctacct | ataagacctg | ttattaagtg | 21840 |
| aatcactacg | attgactcta | ttaaggagct | accttaagtc | catctcacgc | aatttaaaag | 21900 |
| ggacttacaa | accgtaaaac | ggtaataagt | ttattaaata | atgtgatatt | aacatattag | 21960 |
| ttaataactt | tcacatggtc | gaagaaaagt | aaatttattt | gattaccaaa | ttatttttat | 22020 |
| caaatatagc | tcttttgaac | ctgtagattt | atgctactca | tactgataac | ctctattatc | 22080 |
| taacacattt | ctgtgctcca | actacagtta | gtcgttacag | cgtatctttc | taggattccg | 22140 |

FIG. 19M sequence.txt

```
ctaagaccct agaaagaaat taaaccctag ccgttatcat actctacaga ccttataagt    22200
aagtaccaag tataccaatc gtatttaaca atactaatga cgacccatcc taccgatata    22260
tctccgataa gttttgattc gtttgattat cttgtacctt atgactacca aatcattatt    22320
cagtcactat gctcagatat ttagttgtat tatttatata ttaattataa catagttttt    22380
attacttgtc aagttaattt caaaaaaatt atagaagtag ggacgcttac ctacttccat    22440
ttaatttaca caaggatgat aacattgtta ttgttttata ctggaaaaca atgtaagaaa    22500
aacagtgatg tgtaaggtat ttgttttatt gttaattaca ttatagcata tactgatacc    22560
tttgtcaagt taatttaata cttttttaaa atattagtta tcttttgtta attcttcctg    22620
aatagcatcc catcttcttt ctgcttcact acgattatct tctatatgtt ttgtagtttt    22680
acaacatttg atacaatata tatctttgat atgaccttct tctcttttat ttgctctttt    22740
tcttggtact ttgaatacat ttccacattc tttacatatt aaacttgagt aaaacatttt    22800
ttgtcttttc ataattaatc aattcctttt ctcttttatt tgataattta actatatact    22860
atattgataa ataagtcaac agttttctaa aaataattta aattattttg aagaatcctt    22920
taatatcaag ggttacaaga gaaaaagtac gtatttagaa aataaggagt actcctatta    22980
tatataatta tattctgata tagagtaata aataatatta aatatataat tataattaat    23040
aaggttggga aaattgatat aaacataact gatattgctt atagatactc agtataaaag    23100
taaaatccct tagtatcagt acttacaggc aaaaaagtac gtatttagaa aataaggaac    23160
tctcctatta tagttatata tattaattac tattattaat tactatttaa atatataatt    23220
ataattaaca atgttagaaa gtcaacaata gtataaataa aaaagtgact acttaaagtc    23280
actcaataat tagaatacta ttttaaaaga ttctattctg tttggattaa tatatacttg    23340
aggtgaagtt atagcacttt cagtatatac ttttatagag gtttcatcca ttcctcttaa    23400
catataatct atatcttgcc tattgtaact cttttcatca gtagatacta aaaagtattt    23460
agctccactt gacattgtta tttcaatatg ttttgacatc tacaatctct cctatgcaaa    23520
tttgttaaag acaaggata atatagctcc tagaacaagt aaaagaactt tctcagttgt    23580
atccttcttc ttagtatcct tagttttgt acttccagca agttctgaaa tcttttcatc    23640
aagtctttct aattggacgt aaattgctga ttgttttca ctattgacag ctacatcttt    23700
atctatacta actatcattt ttcttagttc agctacctca acttctaaat ctttgaaagt    23760
ccctctatct atataattac cttcttgtat cttagactta atagtttcta cttgagaaac    23820
aaggttgttt atctccttat ccaactagaa tcacctctaa ggtctaaccg tttcagattc    23880
agaatggata tcataatttt ctaagaaatc attgataatc tccatataat tatccgtaac    23940
gactttccg taagatgttt ttgtatcaat ttcaaaccta agcttaccaa aactttggag    24000
gtctaattct tttattacaa tattagggtc atcagaagga aggtaataat agtcgaagta    24060
```

FIG. 19N sequence.txt

| | | | | | |
|---|---|---|---|---|---|
| tataattgag | ccatttatta | atactctgtc | tattctatag | acgtggaaat | agcgtctgtc | 24120 |
| tcttttaaaa | tgggctagtg | catctttaaa | ctctaactta | aggatatcct | tatatttagt | 24180 |
| caaagtggta | acctccttac | tattaatttt | taaatttact | tattttgtgg | tataatagtt | 24240 |
| atgataaagg | cagttattat | aattatatta | agaataatga | taataattat | ttttctgag | 24300 |
| aaaataagcc | aaatactaaa | aacagataaa | gcatagatag | ctgatagata | tactatatta | 24360 |
| agagttacct | tacttttatc | ttttctatag | atagaataac | ctaaagacgt | tgtaacacca | 24420 |
| ctaagtataa | aataatagaa | acaaaaaaga | ggtatagaca | gaaaaaaaga | tacgataatc | 24480 |
| attgttaaac | acctatttct | ttttgaccta | ttatttctag | aacttttaga | ttacaccact | 24540 |
| aatataacat | taaaagccag | tcataaaagt | caattgttag | attaataata | taataaaaaa | 24600 |
| agacaatagg | aggttaaagt | ggttgaataa | taacatagct | atattcatat | tcaaaacact | 24660 |
| ggttatcatt | atattcttac | tactaatttt | gtctgttatt | aattccttgt | cccttattta | 24720 |
| ctcaataaga | ccgagtgtag | ttatgacata | ctttatcttt | ggtggtattg | tttctaatgt | 24780 |
| cgcacttact | gtaacagata | agttcttact | gaagaaagaa | gacccctac | ctgaatatgt | 24840 |
| tcttaaaaaa | gtagagataa | atgataaaga | aataagaata | atcaagaaaa | tcatagaaag | 24900 |
| taattacgga | ataacagcag | aagagataaa | agttagggct | aaagcacaaa | gaagaataga | 24960 |
| ggaagatagt | aaaaaggaag | attacgatga | aaacaaagaa | agaaattaaa | gaacaaagga | 25020 |
| aagagcttaa | ggatggtgct | acatctgttt | ctttagtaaa | aaaaggagat | aagagaatag | 25080 |
| ctagccctag | tagaatttgt | agtctatgtg | gtcagcagtt | atcaggtatg | aattcacta | 25140 |
| aaggaaaagc | attatcaaaa | gttaatcatt | tcatttaca | gtattctaag | tatatttatt | 25200 |
| ttgatatttg | cgcagatatc | aacaattgtt | ataaaattt | aagaaaacga | ggtgaaatgg | 25260 |
| attgagtgca | gaaaatatta | gagatataat | taacaagaaa | aagttagaag | aagaggatac | 25320 |
| aagaaaatat | atagctgatg | gatttatgaa | tggtatcggt | aaattaatgt | acgaattcaa | 25380 |
| taaaaaagta | gataataaag | aaatagaagt | taaagaccct | aatgatttat | ataaattatt | 25440 |
| tgtgatattc | tctcaaatgc | aaaatatggt | caatgaaact | tctgaaggtg | gagcaatacc | 25500 |
| tcaactatct | agacctcaac | aggaattatt | tgatgagatt | acaacagaag | atagtaatgg | 25560 |
| agaatctaca | gttgatttac | agaagatatc | agaaatgtca | gcagaagata | ttacagcaat | 25620 |
| gatttctgaa | aaggaaaaag | taatgaatga | ggaaaattca | gaaacattct | aaggagaaag | 25680 |
| atataaatgg | atggaaaaga | actaattaag | atagcacaag | aaacatttca | aactgaaaaa | 25740 |
| ataacaagag | aacagataga | ccatataatc | aatatgctaa | acccttctac | ctatatgctt | 25800 |
| aagtatcata | cactgagagg | tcatcctata | acttttagta | ttcctaacag | ggatagaagt | 25860 |
| aaagcacagg | ctcatagacc | ttggcaaact | aggattgtaa | atgatactca | tcctaataag | 25920 |

FIG. 190

```
                                sequence.txt
gctgtaataa aatcacgtca gttaggtctt agtgaaatgg gtgtaatgga aatggttcat     25980
tttgcagata tgcatagtta tgctaacgca aagtgtctgt atacattccc tacaaatgaa     26040
caaatgaaaa aatttgttca gtcacgtttg aaccctgttt tagagaaaga atatttaga      26100
gacattgttg attgggataa agactcgtta ggttttaaaa agataagaaa ctctagttta     26160
ttctttagaa caagttctaa agcaagtacc gtagagggtg tggatattga ttatttatct    26220
ttagatgagt atgatagggt aaacttatta gcagaatcgt ctgcactaga atcaatgtct    26280
tcatcacctt ttaagattgt gagaagatgg agcacacctt ctgtacctgg gatgggtata    26340
cacaaattat accaacaatc agaccagtgg tattacggtc atagatgtca acattgtgat    26400
tacttaaatg aaatgagtta taatgattac aaccctgata atcttgaaga aagtggaaat    26460
atgttatgtg ttaatcctga aggtgtagat gagcaagcta aaacagtaca gaatggcagt    26520
taccaatttg tttgtcaaaa atgtggtaaa ccattggata gatggtataa cggtgagtgg    26580
cattgtaagt accctgagcg tacaaaaggt aataaagggg tacgaggata cctaataaca    26640
caaatgaacg ctgtatggat ttctgctgat gaattaaaag agaaagaaat gaatacagaa    26700
tctaagcaag cattctacaa ctatatttta ggttatcctt ttgaagatgt taaacttaga    26760
gttaatgaag aagatgttta tggtaacaaa tcacctattg cagaaacaca attaatgaaa    26820
cgagatagat attctcatat agctattggt atagattggg gaaatactca ctggataact    26880
gttcatggta tgttacctaa tggtaaggta gacttaatac gattattctc tgttaaaaaa    26940
atgacaagac ctgatttagt tgaagcagat ttagaaaaaa taatttggga aatatctaag    27000
tacgaccctg atatttataat tgcagataac ggggactcag gtaataacgt tttaaaactc    27060
attaatcatt ttggaaaaga taaagtattt gggtgtactt ataaatcttc tcctaaatct    27120
acagggcaat taagacctga atttaatgag aacaataata gggttacagt agataaatta    27180
atgcagaata aaagatatgt acaagcactt aagacaaagg atataagtgt ttatagtaca    27240
gtagatgatg atttaaaaac tttcttaaaa cattggcaga atgttgttat tatggatgaa    27300
gaagatgaaa aaactggaga aatgtaccaa gttatcaaac gtaaaggtga cgaccactat    27360
gcacaagcaa gtgtctacgc ctatatagga ttaacaagaa taaaagaact tcttaaagaa    27420
ggaaacggta caagctttgg ttctacattt gtttctactg attacaatca agaaggaaat    27480
aaacaattct actttgatga atagaggtga aatagacttg acagataaat tattttatgg    27540
tacaattagt aatgaagaaa ttaataaaag tgtattgaat tgttattgg gtgaggaatt     27600
atccttagat tatgtttcta aaaatagtga tactttagat gttaaatatg aacatgttta    27660
taaatctcta ggattcgata atttctttga ttgtttttta tatgctaata gagagcctga    27720
aatagtccat aaaggtggag ataaaaatct tggtggacta aataaggtta acgtactgt     27780
tattcgtaat ggtaaagaaa tggaaatgac agtttacgaa gatggtaata aagagaacga    27840
```

FIG. 19P sequence.txt

```
tagtaaagaa aaacaagaag gaaaagaaga agttagtaga agtgcagtag gagcaagggc    27900
tatttctaat ggtgaagaag gaaaggtaaa ccctaaaaag gtagcaaatt cattatctaa    27960
tttaagtaaa aaaggtgtag atgtatcaca tattaataca aactcatcat tgtataaaga    28020
gtttgttgat gataacggtg atacattagg aattacatct tttaaacgaa ctgaaaatga    28080
tataatatta gaatcttatg caagttcaca tgattcagat ggtgtaggag caagagctat    28140
tatggaatta ttacgtttaa gtattaagga aaataaaaat gcagttgtgt atgatataga    28200
attacctgaa gcagtagagt atttaaaaac tttaggattt aaacctaata agatggata     28260
catcttaaga aaaaaagatg taaaacaatt cttaggtgat tatagtgatt ttatttagca    28320
ctatagtcat ctattctatt gtatttattc tatatattgt attaaaaaca atttatataa    28380
agtctaatat gagtagaata gataacacaa ctgaattatt aaaaatatta caggaagata    28440
ttgaaggtaa gataaaaaag gaaggaagaa ataaatgact ttagaagaaa ataaattaac    28500
attagaagaa tcaataactc cacttagcaa agaggagaaa gaagatagta ttaaagaatt    28560
tagcagttta ttatgtgaaa tggtaaatag actatataag tcttataatg tatttagaca    28620
agaccctatg gatgaaactc aacgtctaga tggctcttta atggtctttc aaagtagatt    28680
aaatgaccct ttaacaggag atttacatga taagatgtat aaacttgctt tttcaaaacg    28740
tattgatatt ttcgaagcta ataagcaatt tagaaaagat gtagaagcag gtaaagcaat    28800
tgagttaggt gatgtagcta ttatagatac agcattaagt aacatccttt caggcaatga    28860
gttccaagga agtatttcat ttatgcttag aaaagacttt gaagaaaaag aacgaattag    28920
aaaagaagaa gaagagaaac ttaataactt ataaaaggga agaattatga gactatataa    28980
aatgaggtat cataattgaa aaagaaacca caaggcaatg aggtaatcat aaccataata    29040
acggttatga tagcagtatt tgtagtcatt atgaccatat tttttaataa atatcaagat    29100
gctaaagaag ataaagatag atatcaaaga ttagtagaga tttataaaaa agcagatgat    29160
aatgatggtg agactaaaaa gaaatatgtt aaaagattaa ataaggctga agaagaactt    29220
aaaaaagtaa aaaagaaaca aattataaag attataataa gaagtcaagt aaagaaagac    29280
aaaaagaaga taagaaaact agagagaaaa tatatgatgt aactggtgat gatgacttaa    29340
tattagtaaa aaataatatt gagtttagtg ataagtagaa caagcccgaa atacttatta    29400
gtgaagatgg aattggtacg ataactgttc ctgtagatag tgggtatgaa aaacaaacag    29460
taggttctat tattactagt gtattaggtt ctccttttcct atcacctggt tcaaatagta    29520
tagatggttt aagtgttatt aacgataatg tttatccaaa tacagtagat agcatagtag    29580
aagatacaaa accttctatt aacttaccaa cggataatcc tattataaca aatccagttg    29640
aaccaactat accttcagat attatacctc ctattgataa tccttcagtt ccgatatctc    29700
```

FIG. 19Q sequence.txt

| | | | | | | |
|---|---|---|---|---|---|---|
| ctgagaaccc | aggagataat | aatcaaggaa | atacagataa | tccaaatcct | cccctccag | 29760 |
| ggtacacaga | tgaagatggt | ggaagaggct | ccggtggtgg | aggaaattct | gaaccaccat | 29820 |
| caacggaaga | accttcggat | aatggtaaca | ccggaggagg | agattgggaa | gaaaaacctg | 29880 |
| acccaggaga | agaaccttca | gataatggta | atacaggagg | aaatggtgga | gaagttacgc | 29940 |
| ctgaacctga | acctgaacct | gaacctgaac | ctgaacctga | acctgaacaa | ccgaatgaaa | 30000 |
| atcctgatga | aggtaatgaa | gaaaaaccat | ctgaaccgtc | tgacaatcct | gatgaaaatg | 30060 |
| gaggatggga | aactgaacca | actgaacctg | agtcaccttc | agagccggac | gataaagtgg | 30120 |
| acgaagaaga | taaaaatgaa | gatactacag | atgataaaca | gcccactgaa | caaccggacg | 30180 |
| ataacaacat | agataatgaa | gataaaactg | aagaggagta | attactcctc | tttttttgttt | 30240 |
| gctatattaa | ataagagcta | aatataaaaa | aattgaacat | tacggtggtg | aaaactttgt | 30300 |
| taggaatgaa | tattataacg | tcactatcag | tagtatttac | ttgtttaagt | cttttaactt | 30360 |
| taatgatttt | tgttcatagt | aagttctcta | gtaaaaacgt | ttttgttttg | tatgtaattt | 30420 |
| atgctataat | aggaataggt | acatacatag | ttttaactat | gtttcaaaca | acatctgtac | 30480 |
| ttattaagaa | tgatgtaata | gattccatag | aaaatactga | acattatatt | ggattcaatg | 30540 |
| accctataat | tatatttact | ataagtttta | taggtgcaat | acttggagga | atttggtaca | 30600 |
| agatgatgaa | aattattaaa | aagagtaact | ttaaagataa | aaaataaaaa | agacggtgaa | 30660 |
| taggttgata | ttctctaaag | ataaaaaatg | ggatgaagca | aaagatttca | tcaaaggtca | 30720 |
| aggtatgcaa | gataattgga | tagagattgt | agattattat | agacagatag | gtggaaaaca | 30780 |
| cgtagctgtt | tttattgctt | taaacaaagt | aaaatacatg | attctagaag | caacaaaaga | 30840 |
| caataaggta | atattagtag | ataaagataa | taatatacta | ttagaagatt | atgatattgt | 30900 |
| tatggaaagt | aagaagatgt | tttattacat | tgaagaaccg | ttcgaggtta | aaataaatat | 30960 |
| ccctcaacat | attagagatg | taacttataa | taatactgtt | gtattaacta | cagtaagagg | 31020 |
| gagtagaggt | gactagtaat | tggcagattt | atttaagcaa | ttcagattag | gtaaagacta | 31080 |
| tggtaataat | agtaccattg | ctcaagttcc | tattgatgaa | ggattacaag | ctaacattaa | 31140 |
| aaaaatagaa | caagacaata | aagagtatca | agatttaact | aagtctttat | acggacagca | 31200 |
| acaggcttat | gcagagccat | ttatagaaat | gatggatacg | aatcctgaat | ttagagataa | 31260 |
| gagaagttac | atgaagaacg | aacataactt | acatgatgtt | ttgaaaaagt | ttggtaataa | 31320 |
| ccctatcctt | aatgctatca | tacttacacg | ttcaaatcaa | gtagctatgt | attgtcaacc | 31380 |
| tgcaagatat | tcagagaaag | gtttaggttt | tgaggtaaga | ttaagagacc | tagatgcgga | 31440 |
| acccggtaga | aaagaaaaag | aagaaatgaa | acgtatagaa | gatttttattg | ttaatacagg | 31500 |
| taaagataaa | gatgtagata | gagattcatt | tcaaactttc | tgtaagaaaa | ttgttagaga | 31560 |
| tacttacatc | tatgaccaag | ttaactttga | aaaagtattt | aataagaata | ataaaactaa | 31620 |

FIG. 19R sequence.txt

```
attagaaaaa ttcatagcag tagacccttc tactatttttt tatgcaacag ataaaaaagg    31680
taaaattatt aagggtggta agagatttgt tcaagtagta gataaaagag tagtagctag    31740
ttttacttct agagagttag ctatgggtat aagaaaccct agaactgaat tatcttcttc    31800
aggatatgga ttatcagaag tagagatagc tatgaaagag tttattgcct acaataacac    31860
tgaatcattt aatgatagat tcttctccca cggtggtact actagaggta ttttacagat    31920
acgttcagac caacaacaat cacaacatgc attagagaac tttaagcgtg aatggaaatc    31980
tagtttatca ggtatcaacg gttcatggca ataccagtg gtaatggcag atgatattaa    32040
atttgtcaat atgacaccaa ctgctaatga tatgcaattt gagaaatggt taaattacct    32100
tatcaatatt atatctgctt tatatggtat tgaccctgca gaaattggtt tccctaatag    32160
aggaggagct acaggttcta aaggtggttc tactttaaat gaggctgacc cgggtaaaaa    32220
acaacaacaa tctcaaaata aaggtttaca acctttactt agatttattg aagacttagt    32280
taatagacat attatatcag aatatggaga taagtataca ttccaattcg taggtggaga    32340
tactaagagt gctactgata aacttaatat tcttaaacta gagactcaaa tatttaaaac    32400
agttaatgag gctagagaag agcaaggtaa gaaacctatt gaaggtggag acattattct    32460
agatgcttca ttcttacaag gaacagccca attacaacaa gataaacaat ataatgatgg    32520
taaacaaaaa gaacgtttac aaatgatgat gagtttacta gaaggagaca atgatgattc    32580
tgaagaaggg caatcaacag attctagtaa tgatgataaa gagataggaa cagatgcaca    32640
aataaaaggt gacgataatg tttatcgtac tcaaacatct aataaaggtc aaggaagaaa    32700
aggagaaaaa tcttctgact ttaaacatta attaataagc ctagaataaa tctaggcttt    32760
gtttatttttt ttcgtaattt aattttgata aatgtaataa ctatgatata ctatatgtaa    32820
ttgatattaa tacataaaaa atattaatat ttcacttaca agttattatt gttatattat    32880
taacgtaaaa gtaaataaaa taacaagtgg aggtgtagac acctttggaa gaaataaaat    32940
ttaatgctt tgtacctatg gatttgaaga aatctgtatc aacagcttct gatactaatg    33000
agtattctat cgtttcagga tgggctagta ctccaagtat ggatttacag aatgatatag    33060
ttaatcctaa aggaatagat atagagtatt ttaagtcaca agggtacatt aattatgagc    33120
atcaaagtga taagttgta ggtataccta cagagaattg ctatgtggat atagaaaaag    33180
gtttatttat tgaagcaaag ctatggaaga atgacgaaaa tgttgttaag atgcttgatt    33240
tagctgagaa attagaaaaa tcaggtagtg gaagacgttt aggttttttct attgaaggtg    33300
cagttaaaaa acgtaatata aatgacaatc gagttattga tgaagttatg ataaccggag    33360
ttgcattagt taaaaaccct gctaatcctg aagcaacatg ggaaagcttt atgaaatcat    33420
ttttaactgg tcatggtaca tcacctgaca ctcaagttga tgcaggagct ttaagaaaag    33480
```

FIG. 19S

```
                                   sequence.txt
aagaaatagc atctagcatt acaaatttag cttacgtcac taagattaaa gatttaaaag    33540
agtttaatga tgtatggaat ggcgttgttg aagatttgag taaatctaat agtatgggat    33600
atgaggaatc agtccttacg ttacaactag ctaaaggttt atctcgtaaa gatgcagaac    33660
tagcagtaat ggatataaac aaacaaaaac tagaataggt aaggagaata cattctatga    33720
gtaaagaaat gcaaatatt ttagaagagt atgataagtt aaatgctcaa gaggcagttt     33780
cgaaatctgt agaagatgat gaaaagaata cagtagaatc taccgaagag caagtagcag    33840
aaacaactga agaacctgct aaagaacctg aaaaagtatc tgaggaagat gctaaagaag    33900
cacaagagca aggtgaaaaa gttgaatctg aagaggtagc agagggcaat gaagatgagg    33960
aagttgaaaa atcagctaaa gaatcaaaag accctgtaga ccaaaaagat actaagacag    34020
aaaataaaga caacgagaaa cgtaaaaata aaaagataa aaaagaagat tctgacgatg     34080
aagataaaga tactgacgat gataaagata gaaagaaga taagaaggaa aaaacttcta     34140
aatcaatttc tgatgaagat atcacaacag tatttaaatc tatcttaaca tcttttgaaa    34200
acttaaataa agagaaagaa aactttgcta ctaaagaaga tttaagtgaa gttagtaaat    34260
ctattaatga gttatcagca aaaattctg aaatccaagc tgaagatgtt tctaaatcag     34320
tagacactga tgaagaagct gtagaaaaat cagtaacatc tacaaacgga gagcaagaaa    34380
aagtagaagg ttacgtttct aaatcagtag acactgaaga acaagctgaa actggtgaag    34440
caaaatcaga agaagctgaa gaagtacaag aagataacac atttaaagga ttaagtcaag    34500
aagaacgaac taagttcatg gattcttaca agcacaagc taaagaccct agagcttcta     34560
aacatgactt acaatcagct taccaatctt acttgaacat taacactgac cctactaatg    34620
catcagagaa agatattaaa actgtaaaag actttgcaca aatttaatta atgcacaaag    34680
ttgtgttata ttatacggtg taactaaaga atataaatag ggtacatttt actgtacct    34740
acataaaata aaaagaacac aaatgaaagg tgataaattt atatgactat cgaaaagaac    34800
ctgtcagacg ttcaacaaaa gtacgctgac caattccaag aagacgtagt aaagtcattc    34860
caaactggtt atggaatcac tcctgataca caaattgacg caggagcttt acgtagagaa    34920
attttagatg accaaatcac aatgttaaca tggactaatg aagacttaat cttctatcgt    34980
gatatctcac gccgtcctgc tcaatctaca gtagtaaaat acgaccaata tttacgtcat    35040
ggtaacgtag gtcactctcg tttcgttaaa gaaatcggag tagcaccagt atctgaccca    35100
aatatccgtc aaaaaactgt atcaatgaaa tacgtttctg atactaaaaa tatgtcaatt    35160
gcatcaggtt tagtaaataa cattgctgac ccatcacaaa tccttacaga agatgctatc    35220
gcagttgttg caaaaacaat tgagtgggct tcattctacg gtgacgcttc attaacttct    35280
gaagttgaag gtgaaggtct agagtttgat ggtttagcta aattaattga caaaaataac    35340
gtaattaacg ctaaaggtaa tcaattaact gagaaacact taaatgaggc ggcggtacgt    35400
```

FIG. 19T sequence.txt

| | | | | | | |
|---|---|---|---|---|---|---|
| atcggtaaag | gtttcggtac | agctacagat | gcttacatgc | ctatcggtgt | acacgcagac | 35460 |
| ttcgttaact | caatcttagg | tcgtcaaatg | caattaatgc | aagacaacag | cggtaacgtt | 35520 |
| aacactggtt | acagcgtaaa | tggtttctac | tcatctcgtg | gattcattaa | attacatggt | 35580 |
| tctacagtaa | tggaaaatga | actaatctta | gatgaatcat | acaaccatt | accaaatgct | 35640 |
| ccacaacctg | ctaaagttac | agctactgtt | gaaactaagc | aaaaaggtgc | ttttgaaaat | 35700 |
| gaagaagacc | gtgcaggatt | atcatataaa | gtagtagtta | actcagatga | cgctcaatca | 35760 |
| gctccttctg | aagaagtaac | agctacagta | tctaacgtag | acgatggtgt | taaactttca | 35820 |
| attaatgtta | acgctatgta | ccaacaacaa | ccacaattcg | tttctatcta | ccgtcaaggt | 35880 |
| aaagaaacag | gtatgtactt | cctaatcaaa | cgtgtaccag | ttaaagatgc | acaagaagac | 35940 |
| ggaacaatcg | tattcgtaga | taagaacgaa | acattgcctg | aaacagcaga | cgtatttgtt | 36000 |
| ggtgaaatgt | caccacaagt | agttcactta | ttcgaattac | ttccaatgat | gaaattacca | 36060 |
| ttagctcaaa | ttaatgcttc | tattacattt | gcagtattat | ggtatggtgc | attagcatta | 36120 |
| cgtgctccta | aaaatgggc | tcgtattaaa | aacgttcgtt | atatcgcagt | ttaatagaat | 36180 |
| aagaaaaact | gaatacaaga | gaatagggat | aaacttaggg | tttatccctt | ttttattaaa | 36240 |
| ataaacttga | agggatttaa | taaatatgtt | atactataag | aaactattag | ataaaaaaat | 36300 |
| ggctactgtt | tatggtacag | tggagattga | caaagatgga | gtagttaaag | gattaactaa | 36360 |
| agagcaagaa | aaagaatttg | caaatgttcc | aggttttgaa | tttgaagaag | aaaagaaaac | 36420 |
| tactagaaaa | caatcagctt | ctactagtaa | agaagaagag | cctaaggaag | aggaaaagaa | 36480 |
| agcctctact | agaaaaacta | caagtactac | tagaaaatct | acagcacgta | aaacaacagc | 36540 |
| caaaaaagat | gaaaataagt | aaagggtgaa | ttaaatggtt | aactcaatgt | ttggagggga | 36600 |
| cttagacct | tatgaaaaat | cattaaacta | tgaatatcct | tatcatccta | gtggtaatcc | 36660 |
| taaacatata | gacgtaagtg | agatagaaa | tttaacatta | gctgattatg | gatggtcacc | 36720 |
| ggatgcagtt | aaagcatata | tgttcggtat | cgtagttcaa | aatcctgata | caggacagcc | 36780 |
| tatgggtgat | gagttttata | accatatatt | agaaagagcg | gtaggtaaag | ctgaaagagc | 36840 |
| attagatata | tctatactac | ctgacactca | acatgagatg | agagattatc | atgagacaga | 36900 |
| gtttaatagt | tatatgtttg | tacatgctta | cagaaaacct | atattacagg | tagagaactt | 36960 |
| acagctacag | tttaatggta | gaccaatata | taaatacct | gctaactggt | ggaaagtaga | 37020 |
| gcatctagca | ggacatgttc | aattatttcc | tacagcactt | atgcaaacag | gacaatcaat | 37080 |
| gtcatatgat | gctgtattca | atgggtatcc | tcaattagca | ggtgtatacc | cgccatcagg | 37140 |
| ggcaacattt | gcacctcaaa | tgatacgatt | agaatatgta | tcaggtatgc | ttccacgtaa | 37200 |
| aaaagcagga | agaaataaac | cttgggaaat | gcctcctgag | ttagaacagt | tagttataaa | 37260 |

FIG. 19U sequence.txt

| | | | | | |
|---|---|---|---|---|---|
| atatgcattg | aaagaaatat | accaagtatg | gggtaactta | atcattggtg | ccggtattgc | 37320
| taataaaaca | ttagaagtag | acggtattac | agagacaata | ggtactactc | aatcagctat | 37380
| gtatggtgga | gctagtgcac | agatacttca | aataaatgaa | gatataaaag | aactattaga | 37440
| tggtttaaga | gcttactttg | gatataatat | gataggatta | taaggagggt | tagaaaatgg | 37500
| aaaaaccgta | tatgatagga | gccaactcta | accctaatgt | tattaataag | tcaacaacat | 37560
| atactactac | aacacaagca | gatgaacaag | ataaacctaa | gtatactact | agactagagt | 37620
| ttgatacgat | tgacatgatt | aggtttatta | atgaccgagg | tataaaagta | ttatgggaag | 37680
| aagcatattt | ctgtccttgt | cttaatcctg | atacaggaca | tcctagggta | gattgcccta | 37740
| gatgtcatgg | taaagggatt | gcatatctac | ctcctaaaga | gactataatg | gcaatacagt | 37800
| ctcaagagaa | aggaactaac | cagttagata | taggtatatt | agacacaggt | actgcaatag | 37860
| gtaccactca | attagaaaag | agaatttcct | atagagatag | gtttactgtt | cctgaggtat | 37920
| tgatgcctca | acaaatgatt | tattttgtga | ataaagatag | aattagaaaa | ggtatacctc | 37980
| tatactacga | tgtaaaagaa | gtaacttata | tagctactca | agatggtaca | gtctatgaag | 38040
| aagattatga | aattaagaat | aacagattgt | atttaaatga | aaaatatgag | aaccatacag | 38100
| taactttaaa | gatacttatg | actttaagat | atgtagtatc | agatatacta | aaagaaagtc | 38160
| gttatcaata | tactaagttt | aatcaaccta | aatcaaaatt | tgaaaactta | cctcaaaaat | 38220
| tacttcttaa | aagggaagat | gttattgtac | tacaagaccc | ttataaagtt | aatgatggca | 38280
| tagaagaaga | cctagaaatt | caagtagatg | accctaaggc | ttcagcatct | aatcctagta | 38340
| atttaggtgg | attcttcgga | ggtgcattta | aataatgcca | gttcacggaa | agagacctaa | 38400
| tttatttaaa | aataaaaact | ataagcaggt | aggtaagaga | acaattgatg | gtatgcgttc | 38460
| agaagttctt | gataaattac | aagcaacagc | acagcaagta | gagaatacta | gtattaaacg | 38520
| tatgcctact | tacctacaaa | taacagagaa | aaagcttgaa | aaagaaggag | tagtagacct | 38580
| taaaaaagct | tttgctcact | catctaaaaa | gaaaactagt | aaagatggcg | gatggtattt | 38640
| aactgtacca | atccgcatca | aaactagtag | aatgaataac | agtacttacc | aagatatgag | 38700
| aactttaaaa | gtagataaag | gtacaggttc | agtctctaag | ataactgatt | acctagaagg | 38760
| acgtagaaag | aatgtaagcc | atccttcaat | gaagcctgaa | cctatgactc | ataatatgac | 38820
| taaagttaaa | agaggaaagc | aatcttctta | ctttatattt | agaactgttt | ctagtaagtc | 38880
| acctgctagt | tcttggatac | ttaacagaga | taaagttaat | gaagataact | tctctaaaac | 38940
| aactctaaaa | actgttaagc | aattaatgaa | ctggaagatg | aaaaatttaa | attaagagga | 39000
| gggttagtat | taaatggcaa | taacatcagt | tgattcatat | ttattatcag | aaataaagcc | 39060
| tagacttaac | actgtgctag | agaattgtta | tattatagat | gaagttttaa | aagactttga | 39120
| ttatcaaact | agagagagct | ttaaagaagc | tttctgtggt | aagaatgcac | aacatgaagt | 39180

FIG. 19V sequence.txt

| | | | | | |
|---|---|---|---|---|---|
| aacggtagga | tttaacttcc | caaaatttaa | aaataactat | gaagctcatt | acttgataca | 39240 |
| attaggtcaa | ggacaagaga | caaaaaactc | tttagggagt | attcagtcat | cttactttga | 39300 |
| ggcaacagga | gatacctag | tcgaatcttc | tacagcaata | agagaagatg | ataagttagt | 39360 |
| ttttactgtt | tctaaaccaa | taggagagtt | aataaaggta | gaagatatag | agtttgctaa | 39420 |
| atacgataat | ctccaagttg | aaggtaataa | ggtatcattt | aagtatcaaa | caatgaaga | 39480 |
| ttatgagaac | tacaatgcta | acattatatt | taccgaaaag | aaaaatgatt | ctaaaggttt | 39540 |
| agtaaaagga | ttcacagttg | aagaacaagt | aacagttgta | ggtctttcat | ttaatgtaga | 39600 |
| cgttgcaaga | tgtttagatg | ctgtactgaa | aatgatttta | atatctatga | gagatagtat | 39660 |
| agaagagcaa | caaacattcc | aattacagaa | tttgtctttt | ggtgatattg | caccaataat | 39720 |
| agaagatggt | gactcaatga | tttttggtag | accaacaatt | attaagtaca | caagttctct | 39780 |
| agatttggat | tatactatta | cacaagatat | taataaacta | acttttaaag | aaagaaagga | 39840 |
| ttggaagtag | gatggctaga | aaaaagacac | ctgaaaataa | cactcctaaa | tttaatggtt | 39900 |
| atgttcatat | agatacattc | cttgatactg | caaaaaccct | ttttaatatg | aaggattcac | 39960 |
| aagtagcagg | atttaaagct | tatatggaag | gtagtcatta | tttgtttagt | gagcaagaat | 40020 |
| tcttaccatc | attagagaag | tatctaggta | ggaaattaga | tatataataa | cattcagata | 40080 |
| aggagaatta | aatatggcag | tagaaccatt | cccaagaaga | cctattaccc | gtcctcatgc | 40140 |
| atctattgaa | gtagatactt | caggtatcgg | tggctcagca | ggttcaagtg | aaaaagtatt | 40200 |
| ttgcttaatc | ggtcaggctg | aaggcggaga | accaaataca | gtttatgaat | tacgtaacta | 40260 |
| tgcacaagct | aaacgtttat | tccgttcagg | agaattactt | gatgcaatag | aattagcatg | 40320 |
| gggttctaac | cctaactata | cagcaggtaa | gattttagct | atgcgtatag | aagatgctaa | 40380 |
| acctgcttca | gcggaaatcg | gtggattaaa | agtaacatct | aaaatctatg | gtaatgttgc | 40440 |
| taacaacatt | caagtaggat | tagaaaagaa | tacattaagt | gattcattac | gtttaagagt | 40500 |
| aatcttccaa | gatgaccgtt | tcaatgaggt | ttatgataat | atcggtaata | tcttcacaat | 40560 |
| caagtacaaa | ggagaagaag | ctaacgcaac | tttctctgta | gaacatgatg | aagaaactca | 40620 |
| aaaagcaagt | cgtttagtat | taaaagttgg | agaccaagaa | gttaagtcat | atgatttaac | 40680 |
| tggtggagct | tatgactaca | ctaatgctat | tattcagac | attaatcaat | tacctgattt | 40740 |
| cgaagctaaa | ttatcacctt | tcggagataa | gaacttagaa | tctagtaaat | tagataaaat | 40800 |
| tgaaaatgca | aatatcaaag | ataaagctgt | atatgtaaaa | gcagttttg | gtgacttaga | 40860 |
| aaaacaaaca | gcttacaacg | gtatcgtatc | tttcgagcaa | cttaatgcag | aaggagaagt | 40920 |
| accaagtaat | gtagaggttg | aagcaggaga | agaatcagct | acagtaactg | ctacttcacc | 40980 |
| tattaaaact | attgagccgt | ttgagttaac | taagttaacg | ggcggtacta | atggagaacc | 41040 |

FIG. 19W

```
                                    sequence.txt
acctgctaca tgggcagaca agttagataa atttgcacat gaaggcggat actacattgt    41100
cccattatca tctaaacaat cagttcatgc agaggtagct tcttttgtta aagaacgttc    41160
tgatgcaggg gaaccaatga gagctattgt tggtggagga ttcaatgaat ctaaagaaca    41220
attgttcggt agacaagcat cattatctaa tccacgagta tcattagtag ctaactcagg    41280
tacttttgtt atggatgatg gacgtaaaaa ccacgtacct gcttacatgg tagccgtagc    41340
tctaggtggt cttgcaagtg gtttagaaat tggtgaatca atcacattca aaccactacg    41400
tgtaagttca ttagaccaaa tctatgagtc aatagactta gatgaattaa atgaaaatgg    41460
tattattagt atagagtttg ttcgtaaccg tactaataca ttcttcagaa tcgttgatga    41520
cgtaactaca ttcaatgata aatcagaccc agttaaggct gaaatggctg ttggggaagc    41580
taatgacttc ttagtaagtg agcttaaagt tcaacttgaa gaccaattta ttggtactcg    41640
tactatcaat acaagtgctt caatcattaa agactttatc caatcttact tgggtcgtaa    41700
gaaacgtgat aatgaaattc aagacttccc tgctgaagac gtacaagtta ttgttgaagg    41760
taacgaagca agaatttcaa tgacagttta cccaatcaga agcttcaaga aaatttctgt    41820
tagcttggtt tacaagcaac aaacattaga agcctagtct aggtgatgga gtacctggat    41880
taggtactcc tattaatata atttgaatac tttaggagag tgaatacaga tggcatcaga    41940
agctaaacaa accgtccata ctggtaatac cgtcctactt atgattaaag gtaaaccggt    42000
aggaagagca caatcagcat caggtcaacg tgaatacggt acaactggtg tatacgaaat    42060
cggttctatc atgcctcaag aacacgtata tttacgttat gaaggtacaa ttacagtaga    42120
acgtttacgt atgaaaaaag aaaactttgc agatttagga tatgcttcac ttggtgaaga    42180
aattcttaag aaagatatca ttgatatttt agtggtagat aacttaacga aacaagttat    42240
tatctcatat catggttgct ctgcaaataa ctacaatgaa acttggcaga caaatgaaat    42300
tgtaacagaa gaaatcgagt tcagttacct ttaactaata gaggctatgt ttggtgacaa    42360
gcatagaaaa cactttaaat tgcgtgaaag tcttaaagac tagataacta caacgtaact    42420
cgaaagggta agcgtgaatg ttgagaaatc agaaaaaata tctagtatag tataaggtta    42480
aatcctaagt acagtaaaat agatgatacg caggcaagcc tacaaatgtg ggaagcttca    42540
acgactataa taggtgagtc ttagttacac attaagatta tggtatagtc tactcccttt    42600
aaaatatatc gaaagatagg gtacaaagga cagcatcaga taaagctaga acttaaattt    42660
cttattaaga ccaacaataa aagttggtct tatattttat acttgctttg tctgaggcag    42720
tgtgctataa ttaaaataca aggaggtaat aatatgggaa aaaatcaata tacatttaat    42780
attaaagaaa ataaaaataa atggtatgaa tggtgtaaac tacaaaacgt aaaacctta    42840
gtagaatatg aaaatgcaca acaaatattt tattttgaat ttcttgaagg taaatttaaa    42900
ggactaatag gaaaaacata ttgggctagt ataaatagag gttctaatat gcgtatgagt    42960
```

FIG. 19X sequence.txt

| | | | | | |
|---|---|---|---|---|---|
| tgtttaacat | cagaaagtaa | agataaatat | ttaaaaaatt | taggaaaaag | aaaaggtata | 43020 |
| gaggtagtag | aagactataa | gggtggcaga | aaattaaaac | ataaatttat | agttttagaa | 43080 |
| ggtaagtacc | aaggatgtga | agggtatata | actttaaatg | atttagagaa | tttaggtaga | 43140 |
| gtagataata | gaagtttatc | tgaaaaagga | aggaaacaat | actttgataa | acaggcaaga | 43200 |
| cttagagatt | gtattattct | agagtaccct | aaagactata | gaataaaaac | taaagataag | 43260 |
| atagtagtaa | aagataaaga | agggcatgtt | cataatatta | ttgttcagga | cttttttgag | 43320 |
| aaatcatctt | tattggagtt | atcttgtgct | agtgaaggag | agaaaatagt | taaagaaata | 43380 |
| cttactaaaa | attctataaa | atttgaaaaa | gaaaaatcat | ttagaaacaa | agaaggtaaa | 43440 |
| gtacaaagat | ttgatttta | tattaatgaa | aataataaag | aatatgcaat | agagtacaat | 43500 |
| ggtgcacagc | actacataga | ttctacagga | tatcttaaag | atactttgga | aacaacccag | 43560 |
| aaaagagata | aactaaaaaa | agaatacagt | aaagataaag | gtataaattt | attaattatt | 43620 |
| ccttacacaa | taacagataa | gaaagaaatg | gaaaaaatta | ttttaaattt | tttaaacaaa | 43680 |
| taacccttga | cactccctca | agggatatgt | tattataata | acaggttagg | agtaataagt | 43740 |
| atgaataata | ggcaagctaa | actaaaagga | tataaccaat | ttcattatta | tgattttcca | 43800 |
| acaactaaag | gtaagtttaa | agatataatg | aaaagaaaat | ctagaacaga | acttaaaaaa | 43860 |
| gatttacaaa | aagaaaggaa | gtattatctt | gacaataag | agaaaaacga | taggtaagat | 43920 |
| gagtaacaca | agagcaacat | ggaatattaa | tccggtaact | aaagttaaaa | aagataaaac | 43980 |
| aaaatattct | agaaaaaata | aacataaagg | tcttgacaat | tataattaac | taaggtatat | 44040 |
| tattagtata | acaaaaaaag | gagatgttat | aatatgagaa | tttatataag | taatgactat | 44100 |
| aacaaagagc | tattagataa | atgtttatca | gatattaaca | aagataaagg | taatataaac | 44160 |
| tacagtatta | attatggtga | aggtaacatt | aaagaagcag | atgtagaaat | tattaaacta | 44220 |
| gataagaatc | tattagaaac | agaatcaaga | gcatttgctt | attcgaagtt | tgttgaagat | 44280 |
| tgtatatttt | tatttccttta | taagattgct | ttacttagag | ggggtaaaat | agagttaaga | 44340 |
| tttgattgga | atgaaatatt | ataacaaaaa | aaggagatgg | atatatgagt | acatttggt | 44400 |
| cagaaagaag | aacaactaat | aaagataggc | aagttaaaaa | acattatact | caaatgagta | 44460 |
| tgtatgaaag | aaagaaatgt | gtagagttat | tacaagagac | aattactgaa | aatagaatta | 44520 |
| ttaattttac | acgacatagt | gcaaaaaaag | ttaaaggtaa | accaacaaca | aatataccta | 44580 |
| aattaatagg | ttttattttt | aaaaataagt | ttgcctacga | aaatatcata | gagtacaata | 44640 |
| acacagatta | taatggtaat | attgagagga | gaattgttgt | taaacatccc | aaagttataa | 44700 |
| ctgtagaagg | aaaacttagc | tatcagtttt | tgacaattag | tcttgaagat | gctagagtta | 44760 |
| ttacggtgtg | gtataacagt | gtagatgata | cacatagaac | actagattta | aattattata | 44820 |

FIG. 19Y

```
                              sequence.txt
gtaaagactt gacaattcaa taaggaggag ttataatggg attaacaata gtaaatggtt    44880
atttctttct atcaagtatt atatttattg tagtaagtat actaaatgga aaaggtacag    44940
ttacaaggga atcactagct atgagtcaag cattagtgat aataacatcc attcaatttt    45000
tagcattttt aattataaat ggcatttatt actcattaaa atatatgtaa taaaaaggag    45060
tacaaatgga aatatacatt gtaatagact taagaggaag cacagaagaa gaaacaagta    45120
tggatttttaa agcttttaga aaattacaag atgctataac atatgtagat ggtaatggta    45180
acagggattt acatataatt cctctagaat tagaataaaa gtattgacaa attaaaacta    45240
ataattata ataaggtat aacaaattaa aggagaagat ataaaatgtc acaagataaa     45300
ttaagagcaa tttcacagaa aatgaaagta gaattacaca aatttcctaa agaggtagat    45360
gtaacaagta aatcaactgc aattgcaatc aatcagattt tagataaatt caaaacatta    45420
acagaacaag caggaaagat tactagaaaa tatttagaag gtcaagaaat attaactatt    45480
gattatgagt actatgattc attacaagaa tactatattt acctacttag aaatagtgaa    45540
aaaattgaac aaagtttaca agaaattact aagcgtacag gtgaatatgt aaagtaattt    45600
tgatttaaaa acaaaatatg atatactatg tttaaagtag taagcctaca ctagtccgtg    45660
ttatattaat attgaatcgg ataagcgtag gctttattaa tatttaaaaa aaggaaggta    45720
tatcatatta tggcagaaga aattaaaaag gaacaagatg tacaagaaac aactaaagaa    45780
gaaaaaaaag atgttagcaa aatgacaccg gaagaaatag ataaattaaa atatcaagac    45840
aagcaagaaa aagaacaagt tattaacaaa gttattaaag gtgttaatga tacttgggaa    45900
aaagaatata actttgaaga attagactta agatttaaag ttaaaattaa attacctaac    45960
gcacgagagc aaggtaatat atttgcgtta cgttctgctt acttaggtgg tatggatatg    46020
taccaaacag accaagtaat tagagcatat caaatgttag ctacattaca ggaagtaggt    46080
attgaagttc ctaaggaatt ccaagaccct gacgatattt ataacttata tccctttaact    46140
gttatgtatg aagattggtt aggattctta aactccttttc gttactaata gtatagaaac    46200
actagataaa gatatagaac gattgggcgg tatggaatca attgttaaac aacctttatc    46260
tagaaatcta tgggctatta tgaaagagtt taatgtttta cctactgagc aaagatttaa    46320
ggacttagat gattatcaga tagagtttat tattgggaat atgaacagag atgtttatga    46380
acataacaaa caacttaaac aagctcaaaa aggtggaaaa ttcgatagtc aatttgaaga    46440
tgatgatagt agttggtgga atgaatctca tgaagacttt gacccagtac ctgatttctt    46500
agatgctgat gatttagcac aacagatgga agctaaatta tccgatagag ataaggaaga    46560
aagagctaag agaaacgatg cagagttaaa tgatgaaaca gaaggactta ctacacaaca    46620
tctagctatg atggaataca tcagacagaa acaacaagaa ttagatgatg aagtaggaaa    46680
tggtaagact agtgaagatg acgctactat atcacaagat agcgttaata aagcactaga    46740
```

FIG. 19Z sequence.txt

| | | | | | |
|---|---|---|---|---|---|
| agacctagat | gatgactggt | atatgtaaag | ggtggtaggt | gatactacca | tccttatttt | 46800 |
| tttaaaatgg | atggtgaata | atgatggcaa | tgaatgacga | ttatagattg | gtcttgtccg | 46860 |
| gtgatagttc | ggatttagag | aatagtctaa | aggcaataga | actttatatg | gattctttag | 46920 |
| agtctaagaa | tattgatgct | cctttagata | atttcttaaa | aaaattaaaa | gtaattgcta | 46980 |
| aagaagttaa | aaatgtacag | aacgcaatgg | ataaacaaga | tggtaaatct | gttatatctt | 47040 |
| ctaaagacat | ggatgaatct | attaaatcca | ctcaatctgc | tacaaagaat | ataaatgaat | 47100 |
| taaagaaagc | tttagatgac | cttcaaaaag | agaatatatc | taaaggtatt | gcacctgacc | 47160 |
| ctgaagttga | aaaagcatat | gctaagatgg | gtaaagttgt | agatgaaact | caagaaaaac | 47220 |
| ttgagaaaat | gtcttcacaa | aaaataggtt | ctgatgctag | tattcaaaat | agaattaagg | 47280 |
| aaatgaaaac | cttaaatcaa | gtaactgaag | aatacaataa | aataagtaaa | gattctagcg | 47340 |
| caactaaaga | ttatacaaaa | cgattaagag | ctaatcgtaa | tatgactaga | ggttacatgg | 47400 |
| agcgttcaga | aggaacagga | cgtttgacat | atgaccaagg | tgcacgagtt | agaagtgaac | 47460 |
| taggtaaagt | aagttcttat | gagagccaaa | gaaaacaaaa | ccaacgtaat | ttgggacaag | 47520 |
| caagagaaca | atatagcaac | tatagaaacc | aacaacaaga | cttgactaaa | cgtagagcta | 47580 |
| gcggtcaaat | taataaggca | caatatgaac | aagagttagc | ttctattaaa | caggaaatga | 47640 |
| aagctagaga | agaacttata | tctaactatg | agaaattagg | agcagaactt | gataaaacag | 47700 |
| ttcagtatta | taagggttca | gttcaaaagg | atttccaatc | tagagacgta | gaccaacaaa | 47760 |
| gaggaacatt | tggtagaatg | gttcaagaac | gtttgccatc | tattggttct | catgctatga | 47820 |
| tgggtactac | agctatggct | acaggtttat | acatgaaggg | tgcctcacta | agtgaaacta | 47880 |
| atagacctat | ggttacatca | ttaggtcaaa | attccgataa | tatggatata | gattctgtaa | 47940 |
| gaaatgcata | tggagacttg | tcaattgata | acaaattagg | ttataatagt | actgacatgt | 48000 |
| tgaaaatggc | tacttcatat | gaagcatcag | taggacataa | aagtgatgag | gacacaatgg | 48060 |
| caggaactaa | acagcttgct | attggaggac | gttctttagg | cattaaagac | caagaagctt | 48120 |
| atcaagagtc | tatgggtcaa | atcatgcata | ccggcggagt | aaattctgat | aacatgaagg | 48180 |
| aaatgcaaga | tgcattctta | ggtggtatta | aacagtcagg | tatggttggt | cgtcaagatg | 48240 |
| aacaacttaa | agcactaggt | tctatagcgg | aacaatcagg | agaaggaaga | actctaacta | 48300 |
| aagaccaaat | gagtaatctt | actgccatgc | aatctacttt | tgcagagtca | ggaagtaaag | 48360 |
| gattacaagg | tgaacaaggt | gccaatgcta | ttaacagtat | agaccaagga | cttaaaaatg | 48420 |
| gtatgaatag | ttcttatgct | cgtatagcaa | tgggatgggg | aacgcaatac | caaggtcttg | 48480 |
| aaggtggata | tgatttacaa | aaacgtatgg | atgaaggtat | atctaatcct | gaaaacttga | 48540 |
| cagatatggc | tgatatggct | actcaaatgg | gtggcagtga | aaaagaacaa | aaatacctat | 48600 |

FIG. 19AA sequence.txt

| | | | | | | |
|---|---|---|---|---|---|---|
| ttaatagaag | tatgaaagaa | ataggcgcta | acctaactat | ggagcaatct | gatgaaatat | 48660 |
| ttaaggactc | taaagaagga | aaactgtcta | aagaagagtt | agctaagaaa | gctaagaaaa | 48720 |
| tggaaaaaga | aggtaaaaaa | gaaggagaag | ataacgccac | tgattataaa | gaatctaaat | 48780 |
| caggaaaaaa | tgaccaaaat | aaatctaaga | ctgatgataa | agcagaagat | acttatgata | 48840 |
| tggctcaacc | actaagagat | gctcatagtg | ctttagcagg | tcttcctgcc | cctatatatt | 48900 |
| tagctattgg | tgctatagga | gcatttacag | cttcactaat | tgcatctgca | agtcaatttg | 48960 |
| gagcaggtca | cttaattggt | aaaggagcca | aaggacttag | aaataaattt | ggtagaaata | 49020 |
| aaggtggtag | ctccggtggt | aaccctatgg | caggtggaat | gcctagtggt | ggtggttcac | 49080 |
| ctaagggtgg | aggctcacct | aaaggtgggg | gcactcgttc | tactggagga | aaaatacttg | 49140 |
| atagcgctaa | aggtcttgga | ggattcctag | taggtggcgc | aggatggaaa | ggtatgtttg | 49200 |
| gcggggagtc | taaaggtaaa | ggatttaaac | aaacatctaa | agaagcctgg | tcaggtacta | 49260 |
| gaaaagtatt | taatagagat | aatggtagaa | aagccatgga | taaatctaaa | gatatagcta | 49320 |
| aaggtaccgg | tagtggtctt | aaagatatct | ataatgatag | tatatttggt | aaagaaagaa | 49380 |
| gacaaaacct | aggagaaaaa | gctaaaggtt | ttggtggcaa | agctaagggt | ctctatggta | 49440 |
| agtttgctga | taagtttggt | gacggaggta | aaaatggtat | cctttcacaa | tcaccaaaag | 49500 |
| caggtggaag | tggcataggg | aaacttggaa | aacttgcagg | tggacttgga | aaaggagccg | 49560 |
| gagttttagg | tgttgctacg | tctgccttat | cattaatacc | tgctttagct | tccggagata | 49620 |
| gtaaagctat | cggcggagga | ataggctcta | tgggtggagg | aatggcaggt | gcatcagcag | 49680 |
| gagcttctat | aggagcttta | tttggtggtg | taggtgcaat | ccctggagct | ttaataggtg | 49740 |
| gagctatagg | ttctttcggt | ggaggagctg | ttggtgaaaa | agtaggagac | atggctaaga | 49800 |
| aggctaacac | taaagaagga | tggaacctag | gatggactaa | tggagataaa | gacggtaaga | 49860 |
| ataaattcca | agattcttta | ttaggaaaac | ctatatctaa | agcatggagt | ggtataacag | 49920 |
| gtctctttga | taatgacgct | gaagcatctg | aagaaaatag | caaagataag | aaaaaaggcg | 49980 |
| ttaaaggtgt | taaaggggat | actaagaaga | aagaaaaaat | gacagcagaa | caacttagag | 50040 |
| aaaaaaataa | ccaatctgaa | actaagaacc | ttaaaatcta | tagtgattta | cttgatagag | 50100 |
| ctcagaaaat | tattgagagt | gctaaaggta | ttaatataga | tggaggaact | tctgatagtg | 50160 |
| gttctgatag | tggaggctct | gcatctgatg | taggaggaga | aggtgcagag | aaaatgtata | 50220 |
| agttccttaa | aggaaaagga | ctatctgata | accaggtagg | agctgttatg | gggaacttac | 50280 |
| aacaagaatc | taaccttgac | cctaatgcta | agaacccttc | aagtggagca | tttggtattg | 50340 |
| ctcaatggtt | aggtgctaga | aaacaggat | tagataactt | tgctaagtct | aaaggtaaaa | 50400 |
| aatccagtga | tttagatgtt | caattagact | acctatggaa | agaaatgcaa | tctgattatg | 50460 |
| aaagtaaaaa | cctcaagaat | gcaggttgga | gtaaaggtgg | aagtctagaa | cagaatacaa | 50520 |

FIG. 19BB sequence.txt

| | | | | | |
|---|---|---|---|---|---|
| aagcatttgc | taccgggttt | gaacgtatgg | gagcaaatga | ggctatgatg | ggtactcgtg | 50580 |
| ttaacaatgc | caaggaattc | aagaagaaat | atggaggttc | cggcggagga | ggcggagggg | 50640 |
| gcgctatgtc | ctctacttac | caagaagcta | tgagtaaccc | tgtattaacc | actggttcca | 50700 |
| actacagagg | ctctaacgat | gcttctaatg | cttctacaac | taacagaata | acagttaatg | 50760 |
| ttaacgttca | aggcggaaat | aatcctgaag | aaactggaga | cattatcgga | ggaagaatta | 50820 |
| gagaagtttt | agacagcaac | atggatattt | ttgcaaatga | acataagaga | agttattagt | 50880 |
| gattttgtat | tgacacaaga | gtagtatagt | agtatactac | tcttatacat | ataaaaataa | 50940 |
| aaggaagtat | gtgtatatga | aaagattaag | aagacctaag | gtaagaatag | agatagttac | 51000 |
| agatgataat | acatttacat | taagatttga | agatacacgt | gactacaatg | gtgatgagtt | 51060 |
| tggagctaaa | cttttaggct | ttcaaactaa | aaactctatg | gaagatgata | gttctgtatt | 51120 |
| ccaaatcaat | atggcaggag | atacttactg | ggataagtta | gttatggcta | atgatataat | 51180 |
| cagaatattt | attcaccta | atgatgaccc | taatgataaa | gaaggtcgtc | aagaacgttt | 51240 |
| aatacaagta | ggtatggtat | cacaagtatc | aaaagtaggt | agctatggta | atgaccaaac | 51300 |
| tcaatttaga | ataacaggtc | aatcttttgt | aaaacccttt | atgaaatttg | gattaggtgt | 51360 |
| tattcaagag | gttcaagctg | tattacctga | agtaggttgg | cttattgatg | gtgatgggga | 51420 |
| taatgaagta | aaatttactg | gtagttcggc | acatgaagtt | atgacaggta | ttatccgaag | 51480 |
| atttgttcct | tatatgaaat | ataactatac | agaaaaaaca | tataatacaa | tagatagtta | 51540 |
| ccttgattat | gatgatttaa | gtagttggga | tgaatttgaa | aatctgacag | aagtatctgc | 51600 |
| ttttactaat | tttgatggct | cattaaaaca | gttgatggat | atggtaacag | ctagaccttt | 51660 |
| caatgagtta | ttctttaaaa | actccgaaaa | aacaccaggt | aaagcacagc | ttgttttaag | 51720 |
| aaaaactcct | tttaatccta | ctgagtggag | agctttggat | atgattaaag | tacctactga | 51780 |
| agactttatt | gaagaggatg | tgggtaaaag | tgacgtagaa | acatactcta | tatttacagc | 51840 |
| tacacctgca | ggtatgttaa | aagaacttaa | tggtgatgta | ttttctaaac | cacaatttca | 51900 |
| ccctgaattg | actgatagat | atgggtatac | taaatttgaa | gtagagaata | tctatcttag | 51960 |
| tactaaatca | ggttcagcta | ctgaagactc | agattcttcg | ggtgatgata | atggtactga | 52020 |
| aagaggaact | tattctaaaa | ttatgaaaga | tttaagtaac | tatggaagag | ataatatatc | 52080 |
| taaggtata | gataagtata | caagtaaatt | atcctcaaaa | tataaaaact | taaaaaagcc | 52140 |
| caagctaaaa | aaattataga | gaagtttgtc | aaagaaggaa | aagtaacaga | aaaagaatat | 52200 |
| gaaaagataa | caggtaataa | ggtagatgat | gaattaacat | cagataacag | accgaagttg | 52260 |
| acaaaagata | aattaaagag | tatactaaaa | gagaagttta | aacacaaga | tgatttaat | 52320 |
| aattctaaaa | aaagaaaaaa | gctaaaacag | atgcacttaa | agaattgaca | actaaatatc | 52380 |

FIG. 19CC sequence.txt

| | | | | | |
|---|---|---|---|---|---|
| gttttggtaa | taaaacacat | gctacaactt | tgttagatga | atatattaaa | tacaaaggag | 52440 |
| aaccacctaa | tgatgaggct | tttgataaat | atcttaaagc | tattgaaggt | gttagtaata | 52500 |
| tagctacaga | tacaggttca | gatgcaagtg | atagtccttt | agttatgttc | tctagaatgc | 52560 |
| tatttaactg | gtatcatggc | aaccctaact | tctatgcagg | agatattatt | gttttaggag | 52620 |
| accctaagta | tgacctaggt | aaaagattat | ttattgaaga | taagcaacga | ggagacactt | 52680 |
| gggagttcta | tattgaatct | gtagaacata | aattcgatta | taaacaaggg | tattatacaa | 52740 |
| ctgtaggagt | aactagaggt | ttaaaagatg | ctattctaga | agacggtaaa | ggtagtcctc | 52800 |
| atagatttgc | aggactatgg | aaccaatcat | cagacttcat | gggaggtctt | atgggtgaag | 52860 |
| atacttctaa | agaacttaaa | gaaaaaggtg | tatcagagaa | acaaagcagt | ggagataaag | 52920 |
| acggtggctc | tgatagtggt | ggcgctcaag | atggtggctc | tttagattca | cttaaaaaat | 52980 |
| ataatggcaa | acttcctaag | catgacccaa | gttttgttca | acctggtaac | cgacattata | 53040 |
| agtatcagtg | tacatggtat | gcttataata | gaagaggtca | attaggcatt | cctgtgcctt | 53100 |
| tatgggggga | tgccgccgac | tggataggcg | gtgctaaagg | agcaggttat | ggagtaggta | 53160 |
| gaacacctaa | acaaggtgct | tgtgttatat | ggcaaagagg | agtacaagga | ggtagtgctc | 53220 |
| aatatgggca | tgttgctttt | gttgagaaag | ttttagacgg | aggtaaaaaa | atatttatct | 53280 |
| ccgaacataa | ctgggctact | cctaatggat | atggtactag | aacaatagat | atgagctcag | 53340 |
| ctataggtaa | gaatgctcaa | ttcatttacg | ataagaaata | aaggaggata | gtctatggca | 53400 |
| acagataaag | aagctaaaga | tgttattgac | aagtttatag | ataatgtatt | taattttgat | 53460 |
| gtattaacta | tggaaagagt | taaagaaaaa | gatgaagaaa | ttaaaaaaat | aactacagat | 53520 |
| gatatgtatg | aaaaggttgt | gtatatacga | ccttatgttg | gagtaataca | aagccttaac | 53580 |
| cctcaacatg | tacagtatga | atcattttct | aataatggtt | atgatataga | ggcagaatta | 53640 |
| agtttcagga | aagtaagtta | tttagttgat | aaagggtcta | tacctacaga | ttctttatct | 53700 |
| actttaacag | ttcatttagt | agaaagaaat | caagagctat | taatagatta | ctttgatgag | 53760 |
| atacaagatg | tgttgtacgg | agaatatatg | gaagaagaat | atgtattcga | tgaagatgta | 53820 |
| cccttaagta | cgatactagc | attagactta | aatgataatc | ttaaatcctt | atcaaatata | 53880 |
| aagtatatgt | tcaaaggtgc | tcctaaagag | aatccatttg | gaacagataa | agatgtttat | 53940 |
| atagatactt | ataacttatt | atactggtta | tatttaggtg | aagatgaaga | gttagcatac | 54000 |
| cctatgaata | ttaattattt | ctttacagag | ggtagattct | ttactatatt | tggtaaaggg | 54060 |
| cataagtaca | aggtagatgt | tagtaaattt | atagttggag | atatattatt | ctttggtaga | 54120 |
| agtgatacta | atataggtat | ttatgtaggt | gatggagagt | ttatatctat | gataggtaaa | 54180 |
| tttcctaaag | atgaaacacc | tataggaaaa | tataaacttg | atgattactg | gaatgaattt | 54240 |
| aacggaagag | ttatgagatt | cgatgaagag | gtgtatattt | aatggtagta | agattccaat | 54300 |

FIG. 19DD sequence.txt

| | | | | | |
|---|---|---|---|---|---|
| cttccatggg | aagaagttta | aaaagagtag | attcagatga | tttaaatgta | aaaggattag | 54360
| ttttagctac | agttagtaaa | attaattata | aatatcaatc | agtagaagtt | aaagttaaca | 54420
| acctaacttt | gggaagtcgt | ataggtgacg | atggtagctt | agctgtacct | tatcctaaat | 54480
| ctttcatagg | aagaacaccg | gaaggaagcg | tattcggtac | aaaacctctt | attactgaag | 54540
| gttctgtagt | attaataggg | ttcctaaatg | atgatataaa | tagccctata | atcttaagtg | 54600
| tttacggtga | taatgaacaa | aataaaatga | ttaatacgaa | tcctttagat | ggaggtaaat | 54660
| ttgatacaga | cagtgtttat | aaatatagta | gtgcactata | tgaaatttta | ccatctttaa | 54720
| attataagta | tgatgatgga | gaaggtacaa | gtattaagac | ctataatggt | aagtcattct | 54780
| tctccatgac | atcaggtgaa | gaagaaaaac | ctcaggcaac | agattttac | actggaactg | 54840
| agtatcaaga | tttatttact | tcttattatg | gtaataagac | attaattgag | cctagaatac | 54900
| aaaaggctcc | taatatgtta | tttaaacatc | aaggagtttt | ttatgatgat | ggtacaccgg | 54960
| ataatcatat | aactacttta | tttatatctg | aaagaggaga | tataagagct | tcagttttaa | 55020
| atacagaaac | acagaaaaga | accacacagg | aaatgtcaag | tgatgggtct | tatagggtta | 55080
| tcaaacaaga | tgacgattta | atgttggatg | aagctcaagt | ttggattgag | tatggtatta | 55140
| gtgaagataa | taaattttat | attaaaaatg | acaagcataa | atttgaattt | actgatgagg | 55200
| gaatctatat | agatgataag | cctatgttag | aaaacttaga | tgagagtata | gcagaggcta | 55260
| tgaagaattt | gaatgaaata | caaaaagaac | tcgatgatat | aaactacctt | ctcgagggtg | 55320
| tgggtaaaga | caatttagaa | gaattaatag | agtctacaaa | agagtctata | gaagcttcta | 55380
| aaaaagcaac | ttcagatgtc | aatagactta | caactcagat | agcagaagtt | agtggtagaa | 55440
| ctgaaggtat | tataacacag | ttccaaaaat | ttagagatga | gacttttaaa | gatttttatg | 55500
| aagatgcttc | tactgttatt | aatgaagtaa | atcagaattt | ccctactatg | aaaacagatg | 55560
| ttaataccct | aaagactaaa | gttgataacc | tagagaaaac | tgaaatacca | aacattaaaa | 55620
| ctagattaac | agaactagag | aacaataata | acaatgccga | taaaataatc | tcagatagag | 55680
| gagagcatat | aggtgctatg | atacagttag | aagaaaatgt | tactgtaccg | acaagaaact | 55740
| atatgccaat | accttggagt | aaagttactt | ataataatgc | agagttttgg | gattctaata | 55800
| atcctactcg | attagtagta | cctaaaggaa | taacaaaagt | aagagttgca | ggtaatgttt | 55860
| tgtgggactc | taacgccaca | ggacaacgta | tgttgagaat | attgaaaaat | ggtacttata | 55920
| gtctagggtt | accttataca | agagatgtag | ctatatctac | agcccctcag | aacggtacta | 55980
| gtggagttat | tcctgttaaa | gaaggagatt | actttgagtt | tgaagctttc | caagactcag | 56040
| aaggtgacag | acaattcaga | gcagacccct | atacatggtt | tagtattgaa | gctatagaat | 56100
| tagaaactga | aactatggag | aaagacttta | tgcttatagg | acatagagga | gcaaccggat | 56160

FIG. 19EE sequence.txt

| | | | | | | |
|---|---|---|---|---|---|---|
| acacagatga | gcacacgata | aaaggatatc | aaatggcttt | agataaaggt | gcagattata | 56220 |
| tagaattgga | tttacaatta | acaaaagata | ataagttatt | gtgtatgcat | gattctacta | 56280 |
| tagacagaac | aacaacagga | acaggtaagg | taggagatat | gactttatct | tatatacaaa | 56340 |
| ctaactttac | atctcttaat | ggtgagccga | taccatctct | tgatgatgta | ttaaatcatt | 56400 |
| ttggaacaaa | agttaaatat | tatatagaaa | ctaaacgtcc | gtttgatgct | aatatggata | 56460 |
| aagaattatt | aactcaatta | aaagcaaaag | gattaatagg | aatagggtca | gagagattcc | 56520 |
| aagtaattat | tcaatcattt | gctagagaat | cattaattaa | tattcataat | caattctcta | 56580 |
| atataccttt | agcttattta | acaagtacat | tctctgaaag | tgaaatggat | gattgtttaa | 56640 |
| gttatggttc | ttatgctatt | gctcctaagt | atacaactat | aactaaagaa | ttagtagatt | 56700 |
| tagctcatag | taaaggtctt | aaagtacacg | catggacggt | aaacacaaaa | gaagaaatgc | 56760 |
| aaagcttaat | acaaatgggt | gtagatggat | tctttacaaa | ctacttagat | gaatataaaa | 56820 |
| agatttaata | ttaaagacct | attaatttag | gtcttttttt | agttgtaatt | taaactagtt | 56880 |
| cgtgatatat | tagtagtatg | agatttatat | acatactgaa | aaggagagga | taaaatgcca | 56940 |
| caatcagatg | gaataagtaa | tcttcataga | atagctttac | gcttccctaa | agaaggcggt | 57000 |
| ggttatgata | tgtatagatt | taaagttaac | cccgagaact | acacaataga | ttcaccacaa | 57060 |
| cgtacgacag | caattaaaac | aaaatcagat | attgtaatag | aagattatgg | taaagacata | 57120 |
| gaagttatta | acttcacagg | tacaactggt | tttagacctg | ttagagaagc | agacggatta | 57180 |
| aaaacaggta | agcagaaaat | ggaagagtta | caaagtagag | ttagtgaata | tgctatgcaa | 57240 |
| ggtggtagtg | gtaatgtaag | tggttcttac | ttacaatttt | ttaactttac | agatgatagc | 57300 |
| tactataaag | ttcatttagc | tcctcaaggg | ttaaagataa | ctaggtctaa | agatgaacca | 57360 |
| ttacttttta | gatatgaaat | aacattagta | gttattggtt | cgttaacaga | agcagataga | 57420 |
| agtgctgtaa | caacagaaga | gtttggtaat | gttaaaccta | atgcttctca | aagagtagat | 57480 |
| gagggtataa | aagaattaga | taaaaatgct | cgtaaaacga | gagatagaaa | taatcaagaa | 57540 |
| atatctaaaa | gagaaaatac | aataccctaaa | tctacaggag | ataatacgaa | tgagggtaat | 57600 |
| agacttaagc | aaagcttccc | tagtagttct | atatataatc | ctagacaatc | tactaacgga | 57660 |
| ttaaaaggga | atattgacaa | tatggctctg | ataataggtt | acggtgatgg | aggtgtatct | 57720 |
| agctaatgaa | taattttata | ccacaacctc | aaggtctact | cagatttta | aatgccctag | 57780 |
| atgcagattt | aacttcttct | cacatgaatt | tactggatga | agaggtatca | tttgtatcta | 57840 |
| aattttacac | accacagcta | caattaagtg | aattagcaaa | aaaagtattg | acaaatataa | 57900 |
| agacagatga | tatacctgta | ttagaaagag | aatttaatga | taatacaatt | atccataaag | 57960 |
| ctaatgatac | attactaaaa | gtacaggctc | caagaatgta | tatgattcta | cagtctattg | 58020 |
| tgcttgaagc | atatgctatt | gttaattgct | ttgtagaaaa | tccaagctct | ttaaaatact | 58080 |

FIG. 19FF sequence.txt

| | | | | | |
|---|---|---|---|---|---|
| taactgaaga | agatgttagt | ataacacgag | aaaatttaaa | ttatgtagct | gactacttag | 58140 |
| gtaactatga | tgactacaat | agtgttgtct | tagacttaag | agatttagac | ttatgtttta | 58200 |
| gtgctataga | attacaatta | cctctaatta | aaaaggaggc | taatgtataa | tgagatttaa | 58260 |
| gaaacacgta | gttcaacatg | aagaaacgat | gcaagcaata | gcacagagat | actatggtga | 58320 |
| tgttagttat | tggatagacc | tagtagagca | taataatcta | aagtatccct | atttagtaga | 58380 |
| aactgatgaa | gaaaaaatga | aagaccctga | acgattggct | tctacaggtg | atacactgat | 58440 |
| tatacctata | gaatctgatt | taacagatgt | atcagcaaaa | gaaattaatt | ctagagataa | 58500 |
| agatgtacta | gttgaattag | ctttaggaag | agatttaaat | attactgcag | atgaaaagta | 58560 |
| tttttaatgaa | catggtacta | gtgataatat | actagcattc | agcacaaacg | gtaatggaga | 58620 |
| tttagatact | gtaaaaggca | tagataatat | gaaacagcaa | ttacaggcac | gtttattaac | 58680 |
| tcctagaggt | tctttaatgc | tacatcctaa | ttatggttca | gatttgcata | atttatttgg | 58740 |
| tcttaatata | cctgaacaag | ctacattaat | agaaatggaa | gtattgagaa | cattaacatc | 58800 |
| agataataga | gtaaaatctg | ctaatctaat | tgattggaaa | atacaaggta | atgtttattc | 58860 |
| aggtcaattt | tcagtggaaa | taaaatctgt | tgaagaatca | ataaattttg | tcttaggaca | 58920 |
| agatgaggaa | ggaattttg | ctttatttga | ataggaaagg | attaaattat | gaaaactaga | 58980 |
| aaattaacta | acatactatc | aaaattaata | gataagacaa | tggcaggtac | aagcaagata | 59040 |
| acagacttta | ctcctggttc | agcttcccgt | tcattattag | aagctgtatc | attagagata | 59100 |
| gagcaattct | atatcctaac | aaaagaaaat | attgattggg | gtatacaaga | aggtatcatt | 59160 |
| gaagcttttg | attttcaaaa | aagacaatct | aaaagagctt | atggtgatgt | tactattcaa | 59220 |
| ttctaccaac | ccttagatat | gagaatgtat | atacctgcag | gaacaacttt | tacttcaaca | 59280 |
| cgacaagaat | atcctcagca | atttgaaaca | ttagttgatt | attatgcaga | gcctgattct | 59340 |
| actgagattg | ttgttgaagt | ttattgtaaa | gaaacagggg | ttgcaggtaa | tgttcctgaa | 59400 |
| ggaacaatta | atactatagc | atcaggttct | agtttgatta | gaagtgttaa | taacgagtat | 59460 |
| tcttttaata | caggaactaa | agaagagagc | caagaagact | ttaagcgcag | attccactct | 59520 |
| tttgtagaat | ctagaggtag | agcaactaat | aaatcagtaa | gatatggtgc | attgcagata | 59580 |
| cctgatgtag | aaggtgttta | tgtttatgaa | gaaacaggac | atattacagt | atttgctcat | 59640 |
| gatagaaatg | gtaatttatc | agatacctta | aaagaagata | taatcgatgc | tttacaagac | 59700 |
| tatagaccaa | gtggtataat | gttagatgtt | acaggtgtag | aaaaagaaga | agttaatgtt | 59760 |
| tctgctacag | taactatatc | taataaatct | agaattggtg | atacattaca | aaaacatatc | 59820 |
| gaaggtgtta | ttagaagcta | tttaaataat | ctaaaaactt | ctgatgactt | aataattaca | 59880 |
| gaccttattc | aagctataat | gaatattgat | gatgtactaa | tatatgatgt | gtcatttgat | 59940 |

FIG. 19GG

```
                                    sequence.txt
aacctagatg agaacattat agtaccacca caaggaatta ttagagcagg agaaataaaa      60000
gtagaactaa agtaaagaga ggtgaaactt aagtcgtggc taattttta aagaatcttc       60060
atccattatt aagaagagat agaaacaaaa aagataatca agaccctaac tttgctctca      60120
tagatgcact caatgaagag atgaatcaag tagagaaaga tgctatagaa agtaaattac      60180
aatcctctct aaagacatct acaagtgaat atttagataa gtttggggat tggtttggag      60240
tttatcgtaa gactgatgag aacgatgatg tttatagagc aagaattata aaatatttac      60300
tcttgaaaag aggaactaat aatgctataa tagatgctat aaaagattat ttaggtagag      60360
atgatattga tgtaagtgta tatgaacctt ttacaaatat tttctatacg aacaaatcac      60420
atttaaatgg tgaagaccac ttaatgggat actattatag atttgctgtt attaatgtct      60480
ctataggtga ttatttccct gtagagatta tagatgtaat taatgaattc aaacctgcag      60540
gtgtaactct gtatgtcact tatgatggag cttctactat tagaggtgga gcaattatta      60600
agtggttaga tgggttacct aaaatagaaa cataccaaga gtttgatagg tttacaggat      60660
acgatgatac attctatggt catattaaca tgaatcaaag taaagatact gataatagta      60720
catcagatat ttttaaaaca aaccatagct taattaatag tttagatgtt ttaacaggtt      60780
cctctagcgt aggtagacag tatgttaact atggatatat aacatcatat gtttataatc      60840
caggtatgac atcttctgta aatcaaataa gcgctagtac agaaggtaga gggcaagaag      60900
tacctactga ctattatatg tatactagta ctaagaataa caatacagta gaacttagta      60960
tgcaaactac ttccggtgtg tcttatttat ataataactt taattttagg gattatatga      61020
gtaaatatag acctcaagta aatttacaat ctgatgaggc tagaagaatt gtatctgatt      61080
atataaaaga attaagtatt gattattatc tcagtgctgt aatacctcct gatgaaagta      61140
tagaaattaa attacaagtt tatgattttt ctattaatag atggcttaca gtatcaatta      61200
ataatttatc tttctatgaa aaaaatatcg gtagcaatat aggatatata aaagattatt      61260
taaacagtga attaaatatg tttactagat tagagataaa cgcaggtaaa agagattcag      61320
tagatattaa agttaattac ttagatttaa tgttttatta ctatgaacga ggtatttata      61380
caataaaacc ttataaagcc ttagtagaaa attatttaga tatatctaga gagacttacg      61440
tagaggcatt taaaatatca tcgttatcta atggagatat tataactaaa acaggttatt      61500
tacctatagg ttatctaaga gtatcaggag acattgataa cttaagtaac catatagaaa      61560
ttattaccat agataataat actaatagta ttacaagtac tcttttagaa gatgactcta      61620
atagtttgat attatcatat ggtaacgtca aaaccaatat acacagtttt gaattaaata      61680
gtgatgcttc aatttcaaat attaaatttg aatactctta ttatggtgat gcttgggaag      61740
aactgacagt attaactgaa atatctgagg gtgaaactat agtacctaat atactaatag      61800
atttatatgg attacagaca gtagattatt ctaatataaa tccaatgtca aaagtatcat      61860
```

FIG. 19HH sequence.txt

| | | | | | | |
|---|---|---|---|---|---|---|
| tacgttctat | ttggaatgtt | aaattaggtg | aacttaataa | taaagaaggt | tctttatcaa | 61920 |
| atatgcctaa | cgattatttt | aatgctgtat | ggcaagatat | agataaacta | tcagatattg | 61980 |
| atttaggctc | tatgagaatg | attaaagaca | ctgagggtgg | agtatttgat | ggagctacag | 62040 |
| gtgaaattat | taaagctact | ttatttaatg | ttggtgtata | tactgattta | gatatgttag | 62100 |
| cctacacttt | aactaactat | actgaaccaa | taactttagg | ttctagtcga | ttaataagtg | 62160 |
| aacttaaaga | agaactatta | acatcagaat | catttaatgt | cgataataga | attaaagtaa | 62220 |
| ttgactcaat | atctgagcag | ttacctaata | acaatatatt | aagtaactct | taccaaacac | 62280 |
| aaactattac | acagaatgga | tttgctaagt | ataatttgaa | agaacctata | gagcagagaa | 62340 |
| aacaatacaa | tctaagaata | catggagatt | ttaaagaagg | attagaaaga | ttagctatag | 62400 |
| gtaattctaa | tggttcattt | aatgaagtat | ttgtttaccc | tgaaaatatt | aaagatggta | 62460 |
| tagtagatat | tacttacact | tctagagatg | ataattcgc | agaagggaaa | caaagactta | 62520 |
| ataatgatta | tagagtttac | gctcaaccat | acgatagtga | agtagtaaca | atttacagtt | 62580 |
| tagagttaat | aaaagtttaa | taaataagtt | gacagaaagt | taataatatg | gtatacttat | 62640 |
| aaagtaatat | ttagtgggta | taccatgtta | tattaataaa | gaaacaaca | gatgaaagga | 62700 |
| attaaaaaat | atggcaattg | caacgtataa | ttctcatgtt | gagttagcaa | aatatctagt | 62760 |
| tagtaaagct | gattcagttt | acttaacaat | tggaaagagc | acaccgtggt | ctaatgaaac | 62820 |
| aaacccaccg | caacctgatg | aaaatgcaac | agtattacag | gaggttatag | gatacaaaaa | 62880 |
| agctactaaa | gtaactttag | ttagaccttc | taaatcacct | gaagatgata | ataagaattt | 62940 |
| aatttcttat | ggtaataaat | catgggtaga | agtaacacct | gaaaatgcta | agatgaagg | 63000 |
| agctaaatgg | gtttacttag | aaagcagtat | tgttggtgac | gaactacctc | ttggaacata | 63060 |
| tagacaagta | ggatttgtta | tggacttagt | agcaaaaagt | ggtattagta | aatttaactt | 63120 |
| agtacctagt | gaagtagaat | caactggaac | attattattc | tttgataata | acaattcca | 63180 |
| aaatagaagt | gagcaaacaa | ctgctaaaga | aagatttatt | gtagaagttt | aaagaaaggg | 63240 |
| agataattct | aaatggcaat | taattttaaa | ggttcacctt | atttagatag | atttgacccg | 63300 |
| tctaaagata | gaacaaaagt | attatttaat | cctgatagac | ctctacaaca | ggcagaatta | 63360 |
| aatgaaatgc | agtctataga | ccaatattat | ttaaaaaatc | taggagacgc | tatttttaaa | 63420 |
| gacggagata | aacaatcagg | tcttggattc | acattatctg | aagataatgt | attgacagta | 63480 |
| aatcctggtt | atgtatatat | caacggtaaa | ataagatatt | acgataatga | cgattcagtt | 63540 |
| aaaataactg | gcgtaggtaa | agaaactatc | ggtattaagt | taacagaacg | tattgttaca | 63600 |
| cctgatgaag | atgctagcct | actagaccaa | actagtggag | taccaagtta | cttctctaaa | 63660 |
| ggtgcagata | gattagaaga | aaagatgtca | ttaactgtta | atgaccctac | atcagcaact | 63720 |

FIG. 19II

```
                              sequence.txt
atttatactt tcatggacgg agatttatat atccaatcaa ctaatgctga gatggataaa    63780
atcaataaag tattagctga acgtacttat gatgagtcag gttcatataa agtaaatggt    63840
tttgagttat tctcagaagg taatgctgaa gatgatgacc acgtttctgt agttgtagat    63900
gcaggtaaag cctatgtaaa aggttttaaa gtagataaac ccgtatcaac aagaattagt    63960
gtacctaaat cttatgactt aggaacagca gaaatgaaa gtactatctt taataagtct    64020
aataattcta ttagtttagc taatagccct gtaaaagaaa ttagacgtgt tacaggtcaa    64080
gtacttattg aaaaagaacg agttacaaga ggagcccaag gtgatggtca agattttctt    64140
tcaaataata cagcatttga aattgtaaaa gtttggactg aaacaagccc tggagttact    64200
acaaaagagt ataaacaagg agaagacttc agattaacag atggtcaaac gattgactgg    64260
tcacctcaag gtcaagaacc ttcaggaggt acttcatact atgtttctta taaatataat    64320
aaacgtatgg aagtcggtaa agattatgaa gtaacaactc aaggagaagg gttaagtaag    64380
aaatggtata ttaattttac acctgaaaat ggtgctaaac ctattgacca aacagtagta    64440
ttagtagatt atacttatta cttggctcgt aaagattcag tgtttattaa taagtatggt    64500
gatattgcaa tattacctgg tgaacctaat attatgagat tagttacacc accattaaac    64560
acagaccctg agaatttaca attaggtaca gttacagtat tacctgattc agatgaagcc    64620
gtatgtattt catttgcaat cactagattg tctatggaag acttacagaa agttaaaaca    64680
agagtagata acttagagta taaccaagca gtaaatgcct tagatgatgg tgctatggaa    64740
ggacagaacc ctctaacatt acgttcagta tttagtgaag gtttcattag tcttgataaa    64800
gcagatatta cccatcctga cttcggaata gtatttagtt ttgaagacgc agaagctact    64860
ctagcttata cagaagccgt taaccaacct aaaattattc ctggagatac aacagctcat    64920
atttggggta gattaatttc agcaccattt actgaggaac gtacaatcta tcaaggtcaa    64980
gcatcagaaa cattaaatgt taaccttat aatatcccta ataagcaagg tgtacttaag    65040
ttaacaccta gtgaggataa ttggattgat actgaaaatg ttacaattac tgagcaaaaa    65100
actaagaaag taactatgaa acgattttgg agacacaatg aaagttacta cggtgagact    65160
gaacactact tgtactctaa tttacaatta gacgcaggtc aaaagtggaa aggtgaaact    65220
tacgcttatg acagagagca tggtcgtaca ggtacattac tagaatcagg cggtcaacgt    65280
actttagaag atgatggtga attcattaga attagagatg tatccttcga ggttaaaggt    65340
ctaaacccta atgataataa cttatattta ttatttgatg gtgtaagatg tcctattact    65400
cctgcaactg gttacagaaa aggttctgaa gatgggacta ttatgacaga tgcaaaagga    65460
acagctaaag gtaaatttac tattcctgca ggtattcgtt gtggtaaccg agaagttaca    65520
ctcaagaatg ctaactctac aagtgctaca acttacacag ctcaaggacg taaaaaaatc    65580
gttcaagata ttattattag aactcgtgta acagtaaact tagtagaccc gttagcacaa    65640
```

FIG. 19JJ sequence.txt

| | | | | | |
|---|---|---|---|---|---|
| tcattccagt | atgatgagaa | cagaactata | tcatcattag | gtttatactt | tgcttctaaa | 65700
| ggagataagc | aatctaacgt | tgttatccaa | attagaggta | tgggtgacca | aggttatcct | 65760
| aataaaacaa | tctatgcaga | gacagttatg | aatgcagatg | atattaaagt | atctaataat | 65820
| gctagtgctg | aaactagagt | atactttgat | gaccctatga | tggcagaagg | cggtaaagaa | 65880
| tacgctattg | ttattattac | tgagaacagt | gattatacaa | tgtgggtagg | tactagaact | 65940
| aagcctaaga | ttgataaacc | taatgaggtt | atctcaggta | atccatatct | tcaaggtgtg | 66000
| ttattcagtt | catcaaacgc | atcaacatgg | actcctcatc | aaaactctga | ccttaaattt | 66060
| ggtatctata | cttctaaatt | taatgaaaca | gcaacaattg | aattcgaacc | aattaaagat | 66120
| gtatctgcag | atagaatagt | tcttatgtct | acgtacttaa | ctcctgagag | aacaggatgt | 66180
| acatgggaaa | tgaaattaat | tctagatgac | atggcatctt | ctacaacatt | cgaccagttg | 66240
| aaatgggaac | ctattggtaa | ctatcaagac | ttagatgttt | taggtctagc | aagacaagtt | 66300
| aagttaagag | caactttcga | atctaataga | tatatctcac | cattaatgag | ctctagtgat | 66360
| ttaacattca | ctacattctt | aacagagtta | acaggttcat | atgttggtag | agctattgat | 66420
| atgacagagg | ctccttacaa | tacagtaaga | tttagttatg | aagctttctt | acctaaaggt | 66480
| actaaagttg | ttcctaagta | ttctgcggat | gatggaaaaa | cttggaaaac | atttactaaa | 66540
| tcccctacaa | ctactagagc | caataatgag | tttacacgct | atgtcattga | cgagaaagta | 66600
| aaatcatcag | gaacaaatac | taaactacaa | gttagattag | atttatcaac | tgaaaatagc | 66660
| tttttacgtc | ctcgtgttcg | tagacttatg | gttactacta | gggatgaata | aactagaggg | 66720
| gttgattgac | ccctctttat | ttaataagga | gagatttata | tgcctagaga | agttagagac | 66780
| ccttattctc | aagctaaatt | atttatacct | acagttgagg | aaaaatcaat | taaggaatta | 66840
| gaaaaaacat | acaaagaaaa | aattgatgaa | gctactaagt | taatcaatga | attaaagaaa | 66900
| gagagaggag | aaaaatagat | ggcatttaac | tacacgcctc | ttactgaaac | acagaagtta | 66960
| aaagatatgt | atcctaaagt | taatgatata | ggtaactttt | taaaaacaga | agttaacctt | 67020
| agtgatgtaa | aacaaatatc | acaacctgac | tttaataata | ttttagcatc | tataccctgat | 67080
| agtggtaact | actatgtaac | taattcaaaa | ggtgctccta | gtggagaagc | tacggcagga | 67140
| tttgtaagat | tggataaacg | aaatgtaaat | tattataaaa | tttattattc | accatatagt | 67200
| agtaataaaa | tgtatatcaa | gacttatgct | aatggtactg | tatatgattg | gattagtttt | 67260
| aaattagatg | aaggtaactt | atacaatgaa | ggtaatactt | tgaatgtaaa | ggaacttact | 67320
| gaatctacaa | ctcaatatgt | aacactagtt | aatcctccaa | agagaacttt | aaatacaggt | 67380
| tgggttaatt | acaaagaaag | taaaatggt | gtttcttctt | tagtagaatt | taacccagtt | 67440
| aactctacct | caacttttcaa | gatgataaga | aagttaccag | tacaagaaca | aaagcctaac | 67500

FIG. 19KK

```
                                sequence.txt
ttattgaaag atagtttatt tgtttatcct gaaactagct cttcaaatat taaaacagat    67560
aattggaata caccctcctt tgggggatac acagctaata gtggtcgttc aggggttaga    67620
tttagaggag agaatactat acagattgat gatggtagta gcacatatcc tactgcaatg    67680
actaatagat ttaagatggg taatgagctt tctgtaggtg atacaattac tgtatctgta    67740
tatgctaaaa ttaatgaccc tgcattactt aaagataact tagtttactt tgaactagcg    67800
gggtatgata tggtagatag aactgataat ccttatacag gaggacgtag agaaataaca    67860
gcaagtgaga taacaactga gtggaaaaag tactccttca cattcacgat acctgaaaat    67920
acaattggag catcaggcgt taaagttaat tacgtatctt tactcttaag aatgaattgt    67980
tcatctagta aaggtaatgg tgctgtggta tactatgctc tacctaaatt agaaaaatca    68040
tctaaagtta caccgtttat cacacatgca actgatgttc gtaagtatga tgagatttgg    68100
tctaactggc aagaagttat tagtaaagat gaattaaaag gtcactctcc tgtagatata    68160
gaatataatg attactttaa gtaccaatgg tggaaatctg aagttaatga aaagagttta    68220
aaagatttag ctatgacagt acctcaagga tatcatacat tttattgcca aggctctatt    68280
gccgggacac ctaggggacg ttctattaga ggaaccattc aggtagatta tgacaaaggt    68340
gaccccctaca gagctaataa gtttgttaaa ttattgttta ctgacacaga aggtatacct    68400
tatacattat actacggagg gtataatcaa ggttggaaac tcttaaagca atcagaaact    68460
tctactttac tatgggaagg tactttagat tttgggtcta cggaagctgt taacttaaat    68520
gactcattag ataattatga tttaattgag gtaacttatt ggactcgttc agcaggacat    68580
ttttctacaa aaagattaga tataaaaaat acatcaaatt tactgtatat tagagatttt    68640
aatatttcaa atgatagtac aggttctagt gtagactttt ttgaagggta ttgcactttt    68700
cctactagaa catcagtaca acctggtatg gtaaaatcta aactttaga cgggtctaca    68760
aatacaacaa aagtagcatc atggaatgaa aaggaacgta taaggtata caatattatg    68820
ggaattaata gaggataaag aaaggtggaa taaaaaaac tatggctgtt aaatatgata    68880
taggtaataa tgagatagta ttacatttaa gagaaggtaa atatataaca gggtttacaa    68940
cagtaggagg gtatgataag gagttaggac aagtaaaagt taatagagaa atcttacctg    69000
cttacttctt tgataattt gcctatgaaa gatacttgta ttatagtaaa cctgaagagg    69060
ttatagagaa taaaaactat gtaccacctc aaatcaataa tggtgatgag gaatctcaac    69120
aaaatactgt acctaaagaa caatatgata gtttaaaaga agaactagaa cttatgagaa    69180
aacaacaaga agctatgatg gaaatgcttc aaaaactctt aggtcaaaag gggtaataat    69240
aaatggcatt aaattttact acaataacgg aaaacaatgt tattaaagac ctgactactc    69300
aggtcaataa cattggggaa gaattaacaa agaaagaaa tatatttgac attacagatg    69360
atttagttta taattttaat aaatcacaga agattaaact aactgatgat aaaggattaa    69420
```

FIG. 19LL sequence.txt

| | | | | | |
|---|---|---|---|---|---|
| ctaaatcgta | tggaaacata | acagctctta | gagatataaa | agaaccaggt | tactactata | 69480 |
| taggcgctag | aacattagca | acattattag | atagacctga | tatggagtct | cttgatgttg | 69540 |
| ttttacatgt | agtacctctt | gatacttcta | gtaaggtagt | tcaacattta | tatacactat | 69600 |
| ctactaacaa | taaccaaatt | aaaatgttat | atagatttgt | ctcaggaaac | tctagttcag | 69660 |
| aatggcaatt | tattcaagga | ttaccgagta | ataaaaatgc | tgttatatca | ggaactaata | 69720 |
| ttctagatat | agcttcacca | ggtgtttatt | ttgttatggg | aatgacagga | gggatgccta | 69780 |
| gtggtgtaga | ttcaggtttt | ttagatttaa | gtgtagatgc | taatgacaat | agattagcta | 69840 |
| gactaactga | tgctgaaact | ggtaaagaat | atactagtat | taagaagcct | acagaagtat | 69900 |
| acacagcttg | gaaaaaagaa | tttgagccaa | agatatggga | gaaatattta | ctaagtagta | 69960 |
| tcagagacga | tggtagtgca | tcattcccac | tcctagttta | tactagtgat | aataaaacgt | 70020 |
| ttcaacaagc | tattatagac | catatagata | gaacaggtca | acaacccttt | actttctacg | 70080 |
| ttcaaggtgg | tgtatcaggt | tcccctatgt | ctaatagttg | tcgaggtcta | ttcatgtcag | 70140 |
| atacacctaa | cacttctagt | ttacatggtg | tctataatgc | tataggtaca | gatggtagaa | 70200 |
| atgtaacagg | ttcagtggta | ggaggtaatt | ggacttcacc | aaagacatca | ccttcccata | 70260 |
| aagaattatg | gacgggagca | caatcattcc | tatctgtagg | tactactaag | aatctagcag | 70320 |
| atgatattag | taattactct | tatgtagagg | tttatactaa | acataagaca | gtagagaaga | 70380 |
| ctaaaggtaa | tgatgactcg | ggtacaattt | gccacaagtt | ctacttagat | ggtagcggta | 70440 |
| cttacgtttg | ctcaggaact | tttgtttcag | gagatagaac | agatacaaaa | ccacctgtta | 70500 |
| cagagttcta | tagagtaggt | gtatctttca | aaggttcaac | atggacgctt | gtagatagtg | 70560 |
| cagtacaaaa | tagtaaaact | caatacgtta | caagaattat | aggtattaat | atgccataga | 70620 |
| ctaggataag | tttcctagtc | ttttttttctt | gacttgaaaa | ggattctatg | gtatactata | 70680 |
| actcgtgtaa | ggatataagg | agattaaaat | gagattaaga | attaagaact | tatataccta | 70740 |
| tgtagaattt | gaggaggatg | ataaatactt | aaaagatata | tttttaaaga | gagttcatac | 70800 |
| aactatagga | gcaaggcaag | aaggttttca | gtatagccct | gcttacaaaa | gaggcagttg | 70860 |
| ggatgggtat | gtagactttt | atgtttatga | ggaagataaa | ttccctactg | gactttatt | 70920 |
| taaaattgag | ttattattag | gtgagctaca | atcaagatat | aacttccagt | ttgaaacaat | 70980 |
| tgatgagcgt | gatgaaagtt | tcttatctga | agaagatatt | gatgacgaga | taacattgct | 71040 |
| tgataataat | gtaggtcaaa | ttaccttacg | agattatcaa | tatgaggcag | tgtacaacag | 71100 |
| cttaacattt | tacaatggta | ttgctcattt | agctactaat | ggaggtaaaa | ctgaggttgc | 71160 |
| tagtggtatt | atagaccaac | tattacctca | attagaaaaa | ggtgaaagag | tagcattctt | 71220 |
| cacaggctct | acggagatat | tccatcagtc | tgcagataga | ctacaagaac | gtttaaatat | 71280 |

FIG. 19MM sequence.txt

| | | | | | |
|---|---|---|---|---|---|
| ccctattggt | aaagtgggtg | caggtaagtt | tgatgttaag | caggttacag | ttgtaatgat | 71340 |
| acctacttta | aatgcaaacc | ttaaagaccc | aacacaaggg | gtaaaggtta | cacctaaaca | 71400 |
| aaatattagt | aaaaagattg | ctcaagagat | attaccgaaa | tttgaaggcg | gtacaaatca | 71460 |
| aaaaaaatta | ctaaaagtat | tacttgataa | cacaacacct | aaaacaaaag | tagaacaaaa | 71520 |
| cgtattaagt | gccttagaga | taatttacca | aaatagtaag | acagatgcag | aagtttatt | 71580 |
| aaacttaaga | aatcataatg | cacattttca | aaaaattgtt | agagaaaaaa | acgaaagaa | 71640 |
| atatgataaa | tatcaagata | tgagagattt | tttagactca | gttacagtta | tgatagttga | 71700 |
| tgaggcacac | cattctaaat | ctgattcctg | gtacaacaat | ctaatgacat | gtgaaaaagc | 71760 |
| tttataccga | attgcattaa | cagggtctat | agataaaaaa | gatgaattac | tttggatgag | 71820 |
| attgcaggct | ctattcggta | atgttattgc | acgaactact | aataagtttt | taattgatga | 71880 |
| aggtcattct | gctagaccaa | caataaatat | tatacctgta | gctaatccta | atgacataga | 71940 |
| tagaattgat | gattataggg | aagcttatga | taaaggtata | acaaataatg | attttagaaa | 72000 |
| taaacttatt | gcaaaactaa | cagaaaagtg | gtataatcaa | gataaaggta | cattgattat | 72060 |
| tgtaaacttc | attgaacatg | gagacacaat | atcagaaatg | ttaaatgatt | tagatgtaga | 72120 |
| gcactacttc | ttacatggag | aaatagactc | tgaaactagg | agagaaaaat | taaatgatat | 72180 |
| gagaagtggt | aaacttaaag | taatgatagc | tacatcactt | attgatgagg | gtgtagatat | 72240 |
| atccggtatt | aacgcactaa | tattaggtgc | aggaggcaag | tcattaagac | aaacattgca | 72300 |
| acgtattggt | cgtgctttgc | gtaagaaaaa | agacgataat | acaacacaaa | tatttgattt | 72360 |
| taatgatatg | acaaatagat | ttttatatac | tcacgctaat | gagcgtagga | aaatttatga | 72420 |
| agaggaagat | tttgaaataa | aagacttagg | aaaataggag | ggtaagagat | ggcaacaaaa | 72480 |
| acacaaagaa | agctatacca | atatctagag | gaaaatgcta | cagaaaataa | atttcatatt | 72540 |
| tctactaaga | aagagttagc | agattctcta | ggtgtttcca | tctctgctct | atccaataac | 72600 |
| cttaaaaagt | tagaagaaga | aaataaagtc | gttactgttt | ctaaaagagg | aaaaaacggt | 72660 |
| ggagtaataa | taactttagt | tagagagtat | gacacagaag | aattgaaaga | atttaataat | 72720 |
| tctacagata | atattattac | ttccgattta | cagtatgcta | aggcattaag | agaaaagcac | 72780 |
| ttcccttctt | atagatatga | gagaaaagaa | caacgtagac | gtactaagat | agaaatggca | 72840 |
| caatacaatg | ctattaagga | tgagaagaga | agaattatag | cagatatgaa | tttctattca | 72900 |
| gaaggtcttc | cttacccttc | taaagatatt | tttaatatgt | cttatgaccc | ggaaggtttt | 72960 |
| tataaagcat | acatcttatg | taagttatat | gaccaatatg | ctatttctca | tatggatgct | 73020 |
| aaacatacaa | gtcatcttaa | agcaatgagt | aaggcaacaa | ctaaagatga | atatgactac | 73080 |
| catcaacata | tgtctgaata | ctatagaaat | aaaatgattc | aaaatttacc | tagaaatagt | 73140 |
| gttagtgata | atttctttgg | tagtaaaatg | tttaatactt | tttataattt | ttatttaaaa | 73200 |

FIG. 19NN sequence.txt

| | | | | | |
|---|---|---|---|---|---|
| ataaaagata | aaaatattaa | tgtatttaaa | tatatgaaaa | acgtatttaa | aaatgtaaca | 73260 |
| ttttattacg | agaacggtat | gcaacctaat | ccaataccct | ctcctaactt | ctttagttca | 73320 |
| gataagtatt | ttaaaaacta | taataattat | attaaaggaa | taaaaaaagg | cattaacagt | 73380 |
| acgaatagac | acctaggtga | tacagacagc | atcattaatt | catcagacta | tgtgaaaaac | 73440 |
| cctgctgtat | tacatctaca | ccaactatat | actacaggat | taaattctac | tttacatgat | 73500 |
| attgatacta | tgtttgaaca | agccttagac | cttgagaatg | cttcttatgg | attatttgga | 73560 |
| gatatgaaac | atattatctt | actacagtat | aattctatga | ttgaagaaga | aattaagaat | 73620 |
| ttacctatag | aagagaagga | tattattaat | aaatatgtaa | aacaatgcat | aattaataat | 73680 |
| tactcaccaa | caagtatttc | accatctgca | agattatcaa | tgtttactat | gcagaaagag | 73740 |
| catatagttt | ataataagca | attaaataag | ggaatcaaga | gagaggattt | attaccatta | 73800 |
| agtctaggag | gtatagtgaa | taaagattca | ttaagtagta | tggatataca | aaacttagaa | 73860 |
| cagaatggca | atgaatacct | atatatgaga | caacatactt | caacttatta | tatactaaga | 73920 |
| atgtttggtg | actatttagg | gtatgaggta | aatttaagag | aagtaaaata | tattgtagag | 73980 |
| aaatataatt | taattgataa | aataccattg | acaaaagagg | gtatgttgga | ttataataaa | 74040 |
| cttatacatt | tagtagagga | agaggttaat | aactatgagt | aagaagataa | aggagcttat | 74100 |
| ccttcataaa | tcaatgaagg | atatacattt | tgcaagagaa | gtattagata | acttacctaa | 74160 |
| gaacttattt | tcagcagagt | ctgaagacat | gggttactta | tttacagcca | taaagagaac | 74220 |
| agcacatatt | tccgataaga | tgtcaaatga | agcattagca | attaaagtag | aacagcttat | 74280 |
| gggtaataac | aaggaagatg | aggagaaagt | aaccaagaca | ttaacttact | tagaagattt | 74340 |
| atataaagta | gacgttaatg | aaaaagatga | atctgttaat | tatgaaatag | agaagtatat | 74400 |
| taaaacagaa | atgtcaaaag | aagttttagt | taaatttatt | gcagaaaata | aacaagaaga | 74460 |
| ctctgataat | ctacatgaac | ttgtagacaa | actaaagcaa | atagaagtaa | gtgacatctc | 74520 |
| aggaggtaat | ggggagttta | ttgacttctt | cgaagataca | gaaaagaaac | aagaactatt | 74580 |
| gagtaattta | gctacaaata | aattctctac | tggatttact | tctattgaca | accatattga | 74640 |
| aggtggtata | gcaagaggag | aggttggatt | aatcatagct | cctaccggta | gaggtaaatc | 74700 |
| attaatggct | tcaaacttag | ctaagaatta | tgttaaaagt | ggattaagtg | ttttatatat | 74760 |
| tgccttagag | gaaaaaatgg | atagaatggt | tttgcgtgct | gagcaacaaa | tggcaggagc | 74820 |
| agaaaagagt | caaattgtaa | atcaggatat | gtctttaaat | aataagttt | atgatgcaat | 74880 |
| acaaaatcat | tatcagaaga | atagaaagtt | attaggtgac | ttttatattt | ctaaacatat | 74940 |
| gccgggtgaa | gttacaccaa | accaattaga | gcaaattatt | gtcaatacaa | caattaagaa | 75000 |
| agataaaaat | attgatgttg | ttattattga | ctatcctcat | ttaatgagaa | atccttatgc | 75060 |

FIG. 19OO

```
                              sequence.txt
taaatatcat tcagaatcag atgcaggcgg aaaattgttt gaagatattc gtagattatc    75120
acagcaatat ggatttgttt gttggacgtt agctcaaact aaccgtggtg cttatggttc    75180
agatgttatt acaagtgagc atgtagaagg ttctcgtaaa attgtcaatg ctgttgaggt    75240
gtctttagca gtaaaccaaa aagatgaaga attcaagagt ggtttcttaa gattatattt    75300
agataaaatt cgtaatagct ctaacacagg agaacgattt gttaatctta agtagaacc     75360
aactaagatg attgtaagag atgaaacacc tgaagaaaaa caagagcata taacaattgct   75420
atcagataat ggaaaagaag acacaagtaa atttcaaaat aaagataata aaatagaagc    75480
tataaataac acattcggag gattaccggg agtttaattt tttaaaatat accacttgac    75540
attttatatg ttaggtggta taattatttt ataaagaata aaggagagat taataatgaa    75600
atttgtattc tttacagata gtcattttca cctatttact aactatgcta aacctgataa    75660
tgaatttgtg aatgatagat ttaaagaaca gatagaagca ttacagaaag ttttgatat     75720
tgctaaaaaa gaagaagcaa cagttatatt tggtggagat ttattccata aacgtaactc    75780
ggtagatact agagtatata acaaagtatt tagtacattt gccaaaaata atgaggttcc    75840
tgtattatta cttagaggta atcatgatgc tacaactaat tcattatata ctgattcaag    75900
tatagataca tttgagtatc tacctaatgt aaatgtaata aaatcattaa atacaatttt   75960
aaaagataat gttaatattg tgtttactgc ttatggggat gagacgaagg aaataaagac    76020
atacattaat agtaattatg ataaagatat ggtcaatata ctagtaggtc atttaggtgt    76080
agaaggttca ttaactggaa aaggctctca tagattagaa ggggcatttg gataccagga    76140
tttattacct gataaatatg atttcatttt actaggtcat tatcaccgta gacagtattt    76200
ccaaaatccg aatcattttt atggtggctc attaatgcaa caatcatttt ctgatgaaca    76260
agaagctaat ggtgttcatt taatagatac agacaaaatg actacagaat tcattccaat    76320
tcatacacgt agatttatta ctattcaagg agaagatatt cctgataact ttgaacaatt    76380
aatagaggaa gataatttta ttagagttat tggtacagca aatcatgcta aggttttaga    76440
aatggatgac agtatgaaag ataagaatgt tgaagttcaa attaaaaaag agtatactgt    76500
agagaaacgt attgatagtg atgtatctga tgaccctcta acaattgcta gtacctatgc    76560
taaacaatac tcacctgaat cagaacaaga aatccttgaa tgtttgaagg aggttttata    76620
atgaaaaaat atagagaata tctaaataag acagatgcag aaaatttagc agaggattgg    76680
gagaaagtaa ccgaagattt atggaaagtg tttaaagata tgaaacctaa aattaataca    76740
ttagatatca gtaatgtagg aagtaaagat ttagataaaa gtaaacctat actacaattc    76800
caagattcag atggagtaat agagaatatt tgtaatgttg aaggtttaga agatggtcta    76860
agtaaaatga aaaagatttt tgatgatagt aattttgaaa agcattatta caatagagta    76920
gtagaccatg atgggtatta ctggattgat tatggttctc atcattgttt ctttagagtt    76980
```

FIG. 19PP sequence.txt

| | | | | | |
|---|---|---|---|---|---|
| acgaaagggg | ataagtaatg | gttgtattta | aacaagtaga | agttaataat | tttttagcaa | 77040 |
| ttaaagaagc | tacactagag | ttagacaata | gaggtttaat | tctcattgag | ggtgagaata | 77100 |
| aatccaatga | gtcatttcat | tcaaacggct | caggtaaatc | aactttaata | tctgccatta | 77160 |
| cttatgcttt | atatggtaaa | actgaaaaag | ggctaaaagc | ggatgatgta | gtaaataata | 77220 |
| ttgagaagaa | aaatacgtct | gtgaaactta | agtttgatat | cggggaagat | agctatttaa | 77280 |
| ttgaacgtta | tcgtaaggac | aaagagaata | agaataaagt | aaaattattc | gttaatgaaa | 77340 |
| aagagattac | aggttcaaca | aatgacgtta | ccgataaaca | aatacaagac | ttatttggta | 77400 |
| ttgagtttaa | tacttatgtt | aatgccatca | tgtatggtca | aggtgatatt | cctatgttct | 77460 |
| ctcaagcaac | agataagggt | aagaaagaaa | ttcttgaatc | tattactaag | acagatgtat | 77520 |
| ataaacaagc | gcaagatgta | gcaaaagaga | aagttaaaga | agtagaagaa | caacaaaata | 77580 |
| atataagaca | ggaaatctat | aaactaggtt | atcagttatc | tacaaaagat | gagtacttcc | 77640 |
| aaagagaaat | agaacaatat | aatcagtata | aagaacaatt | ggttcagata | gaaaatagta | 77700 |
| ataaggaaaa | agatagatta | agagaacaag | aggagaagca | aatagaagct | caaatagagc | 77760 |
| aattagcttc | acagatacca | acaatacctg | aagatgaatt | taagcactca | gaggagtata | 77820 |
| ataaagcctc | tcaaagccta | gatttacttt | ctaataaatt | aacggagtta | aatcaagtat | 77880 |
| actcagaata | taataccaaa | gaacaagtac | taaaatctga | aatagctaca | ttaagcaata | 77940 |
| gtctaaatca | gttagatata | aatgaccatt | gtcctgtttg | tggctcccct | atagataatt | 78000 |
| ctcataaatt | aaaagaacag | gaaaatatca | gcaatcagat | tgagaataag | aaacaagaga | 78060 |
| ttactagtgt | attagaaatg | aaagatacgt | ataaagaagc | tattgataaa | gtaaaagata | 78120 |
| aatcacaaga | aattaaagat | aaaatgtcac | aggaagacca | acaagaacga | gagcacaata | 78180 |
| ataagattaa | cagtatcatt | caagaggctt | ctaggattaa | atcagacatt | agttcattag | 78240 |
| agaataataa | aacttatta | aaagtgaaat | accaacatca | atctgttcaa | ggattagaga | 78300 |
| gagaagaacc | aagtaaagaa | aaacatgagg | aagataaaaa | agaattacaa | gaatctattg | 78360 |
| acaaacatga | agagaatata | gtacaattag | aaactaagaa | agggaaatat | caacaagctg | 78420 |
| tagatgcttt | tagtaataaa | ggtatacgtt | cagtagtgtt | agactttatt | acaccattct | 78480 |
| taaatgagaa | agcaaatgag | taccttcaaa | ctttatcagg | ttcagatatt | gaaatagagt | 78540 |
| tccaaactca | agtgaagaat | gctaaaggag | aactaaaaga | taagtttgat | gttattgtta | 78600 |
| agaataacaa | gggtggaggc | tcctacaaat | ccaattcagc | aggagaacaa | aaacgtattg | 78660 |
| atttagcaat | tagttttgca | attcaggatt | taattatgag | taaagatgag | atatctacga | 78720 |
| acattgcact | ttacgatgag | tgttttgatg | gattagatac | tatcggttgt | gaaaacgtga | 78780 |
| ttaaattatt | aaaagataga | cttaatacag | taggaacgat | atttgtaatt | actcataata | 78840 |

FIG. 19QQ sequence.txt

```
ccgaacttaa acccctattt gaacaaacaa ttaaaatagt aaaagaaaat ggagtatcaa    78900
aactggagga aaaataatga aattaaagat tttagataaa gataatgcaa cacttaatgt    78960
gtttcatcgt aataaggagc ataaaacgat agataatgta ccgactgcta atttagttga    79020
ttggtaccct ctaagtaatg cttatgaata caagttaagt agaaatggag aatacttaga    79080
attaaaaaga ttacgttcta ctttaccttc atcttatggt ttagatgata ataaccaaga    79140
tattattaga gataataacc atagatgtaa aataggttat tggtacaacc ctgcagtgcg    79200
taaagataat ttaaagatta tagagaaagc taaacaatat ggattacctg ttataacaga    79260
agaatatgat gctaatactg tagagcaagg atttagagat attggagtta tattccaaag    79320
tcttaaaact attgttgtta ctagatatct agaaggtaaa acagaggaag aattaagaat    79380
atttaacatg aaatcagagg aatcacaatt gaatgaagca cttaaagaga gtgatttttc    79440
tgtagactta acttatagtg acttaggaca aatttataat atgttgttat taatgaaaaa    79500
aattagtaaa tagtaaggaa ggatattatg aggtttgaag acttttttaac ccaagaatta    79560
ggagaaccaa aagaaaatac tataggtgag ctaagatact gttgtccgtt ttgtggagaa    79620
aaaagttata agttctatgt taagcaagcc ctagactcta gtaatggtca gtatcattgt    79680
aaaaaatgtg atgaaacagg caaccctatt acatttatga agacttatta taacattaca    79740
ggtaagcaag cttttgattt attagagtct aagaatatag atatagagag agccccttta    79800
cttacaacta ataataagga tttaacagaa tcagagaaac ttatattaat gcttagaggt    79860
gtgcaccaag ataaaggaac tactagtatt aaacctcctc gattacctga aggatataaa    79920
ttattaaaag ataatttaaa taataaagag attataccctt ttttaaaata cttaaaaggt    79980
agaggtataa ctttagaaca aatcattaat aacaatatag gctatgttat taatggtagc    80040
ttttataaag ttgacgggga atccaaagta tcattaagga atagtattat attttttact    80100
tatgataaca atggaaacta ccagtactgg aatacaagaa gtatagagaa gaacccttat    80160
attaaatcta ttaatgctcc tgctaaacaa gatgaagtag ggagaaaaga tgtcatattt    80220
aatttgaata tagcaagaaa gaaaaagttc ttagttataa ctgaaggtgt atttgatgct    80280
ttaacctttc atgaatatgg agtagcaaca ttaggtaaac aagtaactga gaatcaaata    80340
aaaaaaataa ttgattacgt tagtatagat acatcaatat atattatgtt agacactgat    80400
gcattagata ataatataga cttagcttat aagttaaaaa cacattttaa taaagtttac    80460
tttgtaccac atggtgatga agatgcaaat gatatgggaa caaggaaagc ttttgagtta    80520
ttaaaacaga accgggtgtt agtaacacct gaaagtatac agagttacaa aatacaacaa    80580
aaacttaaac tttaggcttg accttagaga agttttatgt tatactagta attaagtaat    80640
taataaagga gaaaaaaata atgtcaaata gtaaaaaaga tattttagaa tttgtagatg    80700
aatacattac agctttaaga gttggtaatg agcaacgaca acaccaatta gaagaaatgg    80760
```

FIG. 19RR sequence.txt

| | | | | | | |
|---|---|---|---|---|---|---|
| gtaaagaaga | aacagcaaca | ttaacagatg | tagctaaagc | tattactaac | cttatgttag | 80820 |
| gtgttaatga | gcagatgaca | gacttagaat | ataataacga | gttaaactta | aatattttaa | 80880 |
| ttgacgcttt | atataaagca | gagcttatta | atgaagatgt | attagactac | attcaagaat | 80940 |
| caattgataa | atcacaagaa | gaacctaaaa | atgaagaaga | aaaaggagaa | caagaataat | 81000 |
| ggaaaaaaat | attagcacac | acacaaaagg | tattagtcaa | gcagacatgg | agaaatggat | 81060 |
| tgaagctgta | gtacaaggaa | ctgttgatgg | taaacaagtt | gatgagaaaa | cagctaaaca | 81120 |
| attagataga | attggttcac | gtagtgtttc | tttagaagaa | gcaactcgta | ttgctaaagt | 81180 |
| tcttaatgct | gtaacagctc | aagaggttac | aggagacttt | aatgatgcat | ttaatgcaat | 81240 |
| tgacttaatg | atgattatca | tggaagatga | gctaggagta | actcaagaaa | aagtgggtaa | 81300 |
| agctaaagat | aaactaaatg | aaaaacgaga | agcttaccta | aaagagaaac | aagaagaatt | 81360 |
| acgccaaaaa | caacaagaag | aggcacaaaa | agaaactgaa | tctgacagca | atgagaaagt | 81420 |
| aattcagttg | aagaaaaatg | acgaacagta | agaaaaaagg | ggatacattc | gaacgtaaaa | 81480 |
| tagctaaaga | attaactgct | tggtggggat | accaattcaa | taggtctcct | caatcaggtg | 81540 |
| gtgcttcatg | gggtaaagat | aataatgctg | tcggagatat | agtagtacct | caggaagcta | 81600 |
| attttccttt | agtagtagaa | tgtaaacata | gagaagaatg | gactatagat | aacgttcttt | 81660 |
| taaacaacag | agagccacat | acatggtggg | agcaagtcat | taatgatagt | agcaaggtgg | 81720 |
| ataagacacc | ttgcttaata | tttactagaa | acagagctca | gagttatgtt | gctttacctt | 81780 |
| atgatgagaa | agtatatgaa | gatttgagaa | ataatgaata | ccctgtcatg | agaacagatt | 81840 |
| ttattattga | taatattaga | aaagataaat | ttttttatga | tgtacttata | actaccatga | 81900 |
| atgggttgac | ctcatttaca | cccttcttata | ttatatcttg | ctacgacaaa | aagatataa | 81960 |
| aaccatacaa | gaaggtcgag | tctaatttat | ctgaggtaag | taagcatgaa | gatgaattga | 82020 |
| ttaatgacct | tcttagtgat | atataaggaa | ggtaagataa | gtatgacaag | taaagaaaga | 82080 |
| ccattaatcg | tatattttc | aggtacaggg | caaacagaaa | gattagtaaa | taaaattaat | 82140 |
| attaataatt | catttgaaac | atttagggtt | aagagtggaa | aagagaaagt | aaataaacct | 82200 |
| tttatactaa | taacacctac | ttatatgaaa | ggtgcaatac | ctaaacaaat | agaaagattc | 82260 |
| ctagaaatta | atgggagccc | taaagaagtt | attggtacag | gaaataaaca | atggggctct | 82320 |
| aatttctgtg | gagcaagtaa | aaagatttca | gagatgttta | agattccttt | aattgctaaa | 82380 |
| gtagagcaat | caggacactt | taacgagata | caaccaatat | tagaacactt | tagtaataaa | 82440 |
| tataaagtag | cgtaaaggat | gagagatata | tggcaacata | tggaaaatgg | attgagttaa | 82500 |
| ataatgaaat | aactcaatta | gatgacaatg | gaaaaaataa | actctataaa | gaccaagaag | 82560 |
| ctttagatga | gtatttaaaa | tatattgaag | acaatacaag | aaagtttaat | agtgaagtag | 82620 |

FIG. 19SS sequence.txt

| | | | | | |
|---|---|---|---|---|---|
| aaagaattag | agtattgaca | aaagaaggaa | catatgataa | aatatttgac | aaggttcctg | 82680 |
| atactattat | tgatgagatg | actaagttag | cttacagttt | taattttaaa | ttccctagtt | 82740 |
| tcatggcagg | gcaaaagttt | tatgaatctt | acgcatcaaa | acagtatgat | gaaaacaaaa | 82800 |
| aacctatttt | tgttgaagac | tatgagcaac | ataatgttcg | agtagcttta | tatttatttc | 82860 |
| aaaatgacta | tgtaaaggct | agagaattac | tagtacaact | tatggagcaa | acattccaac | 82920 |
| catctacacc | tacgtataac | aactcagggc | aagctaatag | aggtgaacta | agttcatgtt | 82980 |
| atctatttgt | agtagatgat | tcaattgagt | ctttaaactt | tgttgaggat | agcgtagcta | 83040 |
| atgctagttc | taatggtggc | ggagttgcaa | ttgatttaac | tagaattaga | cctaaaggag | 83100 |
| ctccagtacg | taatagacct | aattcaagta | aaggtgttat | tgcttttgct | aaagctattg | 83160 |
| aacataaagt | tagtatttat | gaccagggcg | gtgtaagaca | gggtagtggt | gcagtttacc | 83220 |
| taaatatatt | ccacaatgat | atcttggatt | tattaagctc | taagaaaatc | aatgccagtg | 83280 |
| agtctgttag | actagataaa | ttatctattg | gtgttacaat | ccctaacaaa | tttatggagt | 83340 |
| tagttaaaga | aggtagacct | ttctatactt | tcgatactta | cgacattaat | aaagtgtatg | 83400 |
| gtaagtattt | agatgagcta | aacattgatg | aatggtatga | taagttatta | aataatgata | 83460 |
| gtatcggtaa | agtaaaacat | gatgctagag | aagttatgac | agatattgct | aaaacgcaat | 83520 |
| tagaatcagg | ctacccttat | gtattctata | ttgataatgc | taatgataat | cacccattga | 83580 |
| aaaacctagg | taaagttaaa | atgagtaact | tatgtacaga | aatttcacaa | ttacaagagg | 83640 |
| tatcagaaat | ttatccgtac | tcttacagta | atcagaatgt | tattaataga | gatgttgttt | 83700 |
| gtacattagg | ttctcttaac | ttggttaatg | tagttgaaaa | aggtttattg | aatgaatctg | 83760 |
| tagatattgg | tacaagagca | ttaacaaaag | ttactgatat | tatggattta | ccttacttac | 83820 |
| ctagtgttca | aaaagcaaat | gatgatatta | gagctatcgg | tttaggttca | atgaatttac | 83880 |
| atggacttt | agctaagaat | atgattagtt | atggttctag | agaagcatta | gacctagtaa | 83940 |
| acagtttata | tagtgctatt | aacttccagt | ctattaagac | atctatgtta | atggctaaag | 84000 |
| aaacaggaaa | accatttaaa | ggctttgaga | agtctgatta | cgctacaggt | gaatactttg | 84060 |
| taagatatat | tagagaatcc | aatcaaccta | agacagataa | agctaagaaa | gtcttagata | 84120 |
| aggtttatat | tccaacacaa | gatgattggg | atgaattagc | taaagcagta | aaagtacatg | 84180 |
| gcttgtataa | tggttataga | aaagcagaag | cacctactca | atctatatct | tatgtacaga | 84240 |
| atgctacaag | ttctattatg | ccagtcccta | gtgctataga | gaatagacaa | tatggagata | 84300 |
| tggagacata | ttacccaatg | ccttacctaa | gtcctataac | tcagttcttc | tatgaaggag | 84360 |
| aaacagctta | taagattgac | aataaacgta | ttattaatac | aagcgcagtt | gttcagaaac | 84420 |
| atacagacca | agcagtgtct | acaatacttt | atgtagagtc | agaaatccct | actaataaac | 84480 |
| tagtatcatt | atactattat | gcttgggaac | aaggattaaa | atcattatac | tatacacgtt | 84540 |

FIG. 19TT sequence.txt

| | | | | | |
|---|---|---|---|---|---|
| cacgtaaact | ttctgttatt | gaatgtgaaa | catgttcggt | ttagaaagga | aatagatatg | 84600 |
| gatattacac | aaaaagtaaa | acaacataat | aaaaatgctg | tattaaaagc | aacaaactgg | 84660 |
| aatattgaag | atgacggtat | gtctgatatt | tattgggagc | aaggaatctc | ccaattttgg | 84720 |
| actcctgaag | agtttgatgt | atcaagagat | ttaagttctt | ggaatagttt | aactgaaagt | 84780 |
| gaaaagaaca | cttataagaa | agtccttgca | gggctcacag | gtctcgatac | aaagcaagga | 84840 |
| ggagaaggta | tgaacttagt | atcctaccat | gaaccaagac | ccaaatacca | agctgtattt | 84900 |
| gcgtttatgg | gtggtatgga | agagatacat | gctaaatcct | atagtcatat | ctttacaaca | 84960 |
| ttactaagta | ataaagaaac | aagctatcta | ttagatactt | gggtcgaaga | aaatgacttt | 85020 |
| ttaaaagtaa | aagctcagtt | tatcggatat | tactatgacc | aactattaaa | acctaacccT | 85080 |
| actgtatttg | atagatatat | ggctaaagta | gctagtgcct | ttttagaaag | tgcactattc | 85140 |
| tactcaggat | tttattatcc | tttacttctt | gcaggaagag | gtcagatgac | acaatcagga | 85200 |
| gctattattt | ataaaattac | tcaagatgaa | gcttaccatg | gttcagcagt | aggattaaca | 85260 |
| gctcaatatg | attataatct | tctaacagaa | gaagagaaaa | acaagcaga | taaagaaact | 85320 |
| tatgaattat | tagatattct | ttacactaat | gaagtagcgt | atacacatag | tctatatgac | 85380 |
| ccactagaat | taagtgaaga | cgtaattaac | tatgttcagt | ataattttaa | tagagctctt | 85440 |
| caaaaccttg | gaagagagga | ctattttaat | cctgaaccttt | ataaccctat | tgtagaaaat | 85500 |
| caaactaatg | tagacagatt | acgaaatgtt | gatttctta | gtggtaaagc | agactatgaa | 85560 |
| aaatctacaa | atatcaaaga | cattaaagat | gaagatttct | cattcttaga | tagtaaagaa | 85620 |
| tacaatactg | ccaaggaatt | cctataaaaa | ggagaaaaga | tattatggat | agaaaagaag | 85680 |
| caatggattt | actaagtaaa | gcagaaatat | tatttaaaaa | acatgatgag | ttttcatgtg | 85740 |
| taagtgatat | taatgacccT | atgaagttat | tcagtagctc | taaggatgct | aaagctgatg | 85800 |
| atacgtctaa | gtcttttcag | ctagagttta | tgcatgatat | gaccatgtat | actttatctt | 85860 |
| atggctcagg | acagttaaaa | cttattgatt | tagcagaagg | ttatgaagca | caaaaagcta | 85920 |
| cagtagttaa | ctcatttccc | gaaattatta | aacattaga | aaaggatgat | tcagaagatg | 85980 |
| gaaaaaatga | atagtttagt | agatttaaat | acagcaatta | gacaaaagaa | agatgttatt | 86040 |
| gtcatgatta | cacaagataa | ttgtggtaag | tgtgagattt | taaaaagtgt | aatccctatg | 86100 |
| tttcaagagt | caggtgacat | taaaaaacct | atcttaacat | taaatctaga | tgctgaagat | 86160 |
| gtagatagag | aaaaagctgt | taagttattc | gatatcatga | gtacaccagt | attaattggg | 86220 |
| tataaagatg | gtcagttagt | taaaaagtat | gaagaccaag | ttacacctat | gcaattacaa | 86280 |
| gaattagagt | cactttaatt | tggaatttcc | tactatctgt | gctatactat | aatagtacaa | 86340 |
| ggtagtagga | ttttttaatg | gaaggaagat | gacatatcgc | aaagaataaa | acattaacga | 86400 |

FIG. 19UU

```
                                   sequence.txt
tatataatag tgatagatat tttaatatac acacaaaaga taaagataaa attaatgagg    86460
ctattaaagt cacacatggt aatgaagaag aaattgagaa gaatatggat gaattaatat    86520
ctaagtctag acgatatatc atgagagatg aaaatcatta catgttattt aatgagaagt    86580
ataataatga tagacttata gaaaaagtat gtaaacatgg cggtaaagtt acatactata    86640
ctgattcagt attaccttat tatgttttaa aagacttatc tagtcaccct gactcagaag    86700
ttgtttatcg tatgcgcaat ggttttactg caaaagaagt agataatata gctttatcat    86760
tcatgggtac aaaagttatt attgatattt ctgtagtatt tccttatgta aacccttatg    86820
atattattag aagtttacat gatattaaaa caaatgtaga tgaagttcat ttatcatttc    86880
cacgaatatt agaggtagat gaaaaacaag aaaagtttta tttctttgat ggtgaagctt    86940
atgatttaaa acctgaatat aaagtcgatt tgcagataaa aattagagta tctttatcag    87000
tatggaaaat gtatatctat atcttaacaa gtagtcgtga ttttgaggat gtagacaatg    87060
taattacgaa attaaaacaa caacgaaaga ttaagatata aggtgattat atgagtacag    87120
caaatagaag agatatagca agaaagatat cagagaatac aggttactat atccaagatg    87180
tagaggaaat actaagtgca gagacagatg ctatttctga cttactagaa gaaggatata    87240
ctaaagtaaa gaatcataaa tttatgcaaa tagaagttat tgaaagaaaa ggtaaaaaag    87300
cgtgggatgg tctgaataaa gaatacttcc atttacctaa tagaaaagct ataaaattca    87360
aaccactaaa agaactagaa gaggttattg atagacttaa tgaagaagag aaataattct    87420
cttcttttt tattgacaag gtttaaaata tatggtatag tattattaag ttaaaaaagg    87480
agaggaatta aatgaaagta ttaatcttat ttgaccacat tagagaagag catttttctg    87540
taagtaaaga tgggagtgtg aaatctaatg tactaaaatac acctaatgga aaaacactta    87600
agaaattact tgagaagtgt tctaacttaa agagagataa gacaaacaga gattatgata    87660
ttgattttct ctacaatgca gtacctacac ctatcagaaa tgactacggt aaaatcatta    87720
aatatcaaga tgttaaacaa gcagaagtaa agccatacta tgagagaatg aacaatatta    87780
ttattgataa ttccttatgat atggtaattc ctgtaggtaa actaggtgtt aaataccta    87840
taaatgttac agctatcggt aaagtaagag gagtcccaag taaagtaact attgaaaatg    87900
aaacatcttc tcatgacgtg tgggtattac ctacttacag tattgaatat actaatgtaa    87960
ataaaaatag tgaacgtcat gtagtatcag atttacaaac agttggtaag tttgtagagc    88020
aaggagaaga ggcatttaaa cctaaggaag tatcttacga gttggtagat aacattgaaa    88080
gagtaagaga aatattcaat aaggaagtaa agaacgacaa ttatgatggc gtagatatta    88140
ccgcatggga cttagagact aactcattaa aacctgataa agaaggaagt aaacctttag    88200
tactatctct atcatggaga aacggtcaag gtgtaactat acctttatat aaatcagact    88260
ttaactggga aaatggtcaa gatgatattg atgaagtctt agaattgctt aagaattggt    88320
```

FIG. 19VV sequence.txt

| | | | | | | |
|---|---|---|---|---|---|---|
| tagctagtaa | agaagacatt | aaagtagcac | acaacggtaa | atgatttgct | gttgtaaaat | 88380 |
| ccctctcata | tcgggcatag | ctttaagaag | ctgataagag | aacctaagtc | ctgtaataag | 88440 |
| gatagtggta | atcccgagcc | tacattattg | gtgacaatag | atggggtgta | gagactgagc | 88500 |
| tgaggttttg | tagaccaagg | tgagacatag | tgtatcaact | taatagaggt | ggtacagtga | 88560 |
| aaaaagatta | tatgacatca | gttaaaaata | acaaaaaagt | atgtagaaga | tgtaatgaag | 88620 |
| aattagactt | atctaatttt | aaaacatata | aaaagaatga | taaaatttat | tatcagagta | 88680 |
| tgtgtatacc | ttgtagaaag | gaatacaata | aattagataa | aactaaaaat | actattaaaa | 88740 |
| aatgttatga | taaaaatgga | gataagtatc | ggaaacaagg | taatgagtat | aacacttctg | 88800 |
| atagaggaag | agaactaaat | aaaaagcgtt | caagaaaata | cagagaaaat | aattctttaa | 88860 |
| aagctaaagc | tagaaactct | gtaagaactg | cattaagaaa | tggttctcta | ttaagaccta | 88920 |
| gtaaatgttc | agagtgtaat | aaggaatgta | ttcctgaagc | tcatcatcct | gattataaca | 88980 |
| aacctttaga | aataaaatgg | ttatgtaaat | catgtcatga | agatacacat | cataaaaaat | 89040 |
| aatcacacta | tgtaaatgag | ggacatcaag | cccatttagg | taactacaaa | caaacctaat | 89100 |
| ggtaagggct | tatgaaggta | tagtccgttc | tgtatagaaa | tatacaggct | aaaacgaaat | 89160 |
| atgatattaa | attcttaatg | agtactgaaa | actttaaaga | ttttgagagt | attcaggata | 89220 |
| ctaaagtagg | ttggtaccta | gccgttaccc | aggaagttaa | agaatcttta | agattatctg | 89280 |
| atttagctta | cgaggttacg | gatgtcggag | gatatgataa | accattagaa | gactttaaat | 89340 |
| tatggtttgt | tactaagtta | ttaagattct | tctcagataa | aattaaagag | atacagaaag | 89400 |
| aaaataaaaa | aattgctaag | aaagagtatg | atgttaaagc | tcctgaatat | aaagaatggt | 89460 |
| tagagaataa | actaaatgaa | acagtagtag | aactagatga | tactgagaag | aaatttagag | 89520 |
| tcagtgaatt | agagaaaaag | tatattcaac | taggtctttc | acctgaaatt | gtaaatatga | 89580 |
| atttagttat | gaataacgat | gagtttataa | gtattgcaga | acaatcacct | gagtacatgg | 89640 |
| ggttatctga | ctacgctaag | tcttacacat | taaatactgc | aattaattta | attaatgagt | 89700 |
| atagagatgt | aaaagatgta | gttaatgata | ttgatggagg | taactttaat | tatgattggt | 89760 |
| tccctattga | gttaatgcat | ccatatgctt | caggagatac | tgatgtatgt | agaagaattc | 89820 |
| attgtgatgt | agttaaaaaa | cttaaagaac | aagatagacc | taaatcaatg | catttattag | 89880 |
| aagttaatta | tccaagactt | actaagtctt | tagctaggat | tgaatcaaat | ggtttatatt | 89940 |
| gtgacttaga | ttatatgaaa | gaaaatgatg | agtcatacga | gtctgagatg | gctaaaaatc | 90000 |
| atgctacaat | gagagagcac | tgggctgtta | aagaatttga | agaataccaa | tacaatctttt | 90060 |
| accaaatggc | gttagaagaa | catgagaaaa | agccaaaaga | tagagataaa | gatatccatc | 90120 |
| agtatagaga | taaatttaaa | gatggtaaat | ggatgttttc | cccaagttcc | ggagaccata | 90180 |

FIG. 19WW

```
                                    sequence.txt
aaggtagagt aatttatgat attttaggaa ttcaattacc ttatgataaa gaatatgtta    90240
aggaaaaacc atttaatgct aatgttaaag aagcagacct tacttggcag gactataaaa    90300
cagacaagaa agctattggt tatgcgttag ataatttaga attaaaagat gatgttagag    90360
aacttcttga gttacttaaa tatcatgcta gtatgcagac aaaacgtaat tcatttacta    90420
agaaattacc taatatgatt aataaacaaa acgaacatt acatggttct ttttctgaga     90480
caggtacaga gacatcaaga ctaagtagta gtaaccctaa cttgcaaaac ttaccggcac    90540
acacatcaga tgtaaacaag tttgattaca acatccaat taaacgttca tttgtttcta     90600
gatttgaaaa tggagtacta ctgggagccg actatagcgc cctagagatg cgtattattg    90660
gattatttac taaagaccct gatatgctac aatcattctt aaatggggaa gatattcata    90720
aggctactgc aagtattgtt tataataaac cagtagaaga ggtaactaag gaagaacgac    90780
aagcaactaa agcagttaac ttcgggttag ccttcggtga atcacccttc tcatttgcag    90840
gtaaaaataa tatggaagta agtgaagcag aagaaatatt tgaaaagtac ttccaaacaa    90900
aaccaagtgt aaaaacttct attgacaatg tacatgagtt tgtgcaacaa tatggttatg    90960
ttgatacaat gcacggacat agaagattta tccgttcagc ccaatcaaca gataaaaaga    91020
taaaaaatga aggtctaaga cagtcattta acactattat ccaaggttca ggtagtttct    91080
taacaaacat gtctttaact tacttagatg attttatcca atctcgtaac ttaaaatcaa    91140
aagttattgc cacagtacat gatagtatct taattgattg tcctcctgaa gaagctaaaa    91200
ttatggctaa agtgacaatt catattatgg aaaacttacc atttgatttc ttaaaagcag    91260
aaattgatgg aaaagaagta caatacccta ttgaagctga tatggaaatc gggttaaact    91320
ataatgatat ggttgaatat gatgaggaag aaatagatac atttaattct taccaaggtt    91380
atattaagta tatgatgaat ttacagacct tagaagatta taaagagtca ggtaaactaa    91440
cagatgaaca atttgaaaag gctactaacg ttgttaaaag tgaaaaacat atttaccaag    91500
aaatttaata aaagtattga caatatattt aacttatgtt atactatata ggtaataaat    91560
ataaggagga aaaagagtga atacaggaga gattagattt aatcgttcta tggatgaatg    91620
gattataaca agtatgtacc aggatgagct aggtgatatg aatattgttg ttacattcta    91680
taatagagaa gaaaataaac acggttctac agttttaccc acagagtcat ctactggaga    91740
agtaacagag gaattggcaa atcttgaaga agaatatcct ctagctttac ctttaagtag    91800
tatctcagtt aatatttaaa aggaggaact gataaatgga aatacacatt gattccctag    91860
attttacaaa ctttactatt aaagatagaa atgggaactc acaagagttt gatattacag    91920
atgagttaag aattacagag tatacaatac aagaggactt tatgcaacaa tcagctaaat    91980
atgcttttg ggcttctata ttagagaagg taagagcata ttctgaaatg gaacaaagaa     92040
atctagaaac aattggtagt aagctaaacc ttacaattag acaagagtac gaacaacaag    92100
```

FIG. 19XX sequence.txt

| | | | | | | |
|---|---|---|---|---|---|---|
| gtaaaaagcc | tactaaagat | atgattgaat | ctagtgttta | tattcatgat | tcttaccaac | 92160 |
| aacaacttaa | agttgttgag | gcttggaatt | ataaagttaa | acaacttcaa | tatgttgtaa | 92220 |
| aagcttttga | gacaagaaga | gatatgatga | ttcaattagg | tgcagaatta | cgacaaacaa | 92280 |
| ataaaaatgg | tggaattact | aatccatttt | cacattaaaa | aataaagtaa | agaatataat | 92340 |
| tgacaaatat | aaaaaactat | gttataataa | ataagtaaat | taattaaaag | gagaaaagat | 92400 |
| aattatggat | ttcaatcaat | ttattaacaa | tgaggcaagc | aaattagaaa | gcaataacag | 92460 |
| ttcttttaac | aataatgtag | agagctacaa | acctaaaaac | cctgtactac | gtttaggtaa | 92520 |
| tattaaagat | gcaaacggaa | ataaggttgt | taaagaaaat | gcttttgtac | gagtattacc | 92580 |
| tcctgcacaa | ggaacaaatg | ttttctttaa | agaatttaga | acaacaggta | ttaactattc | 92640 |
| taagaaagat | ggttctcaag | gattcacagg | attaacatta | cctgcagaag | aaggttcatc | 92700 |
| tgtccttgac | ccgtacattc | aggactggat | aacaaatggt | gttcaattta | gtagattccc | 92760 |
| taataaacca | ggagtacgct | attacattca | tgtgattgaa | tactttaata | acaatggtca | 92820 |
| aattcaacca | aaaacggatg | ctcaaggaaa | tgtaatgatt | caacctatgg | aattatctaa | 92880 |
| cacaggatat | aaagaattat | tagctaactt | aaaagatact | atgttaaaac | catcacctaa | 92940 |
| tgcacctcat | agctttatct | cagcaaatga | agcattctta | gttaatattg | ttaaagctaa | 93000 |
| gaaaggtgaa | atgtcatgga | aagtaagtgt | ttatcctaat | gctcctttag | gtgcgttacc | 93060 |
| gcaaggttgg | gaacaacaat | tatctgacct | agaccaatta | gcaaaaccaa | cagaagaaca | 93120 |
| aaatcctaat | tttgttaact | tcttaatcaa | taatgttaat | aacacagagt | taagtcatga | 93180 |
| taactttaaa | tttaaccgtg | aaacaaatgt | cttaggtgaa | gaaccttcag | agcctaaaca | 93240 |
| agcacctacg | caacaagatg | tagatagtca | aatgccaagt | aatatgggag | gacaacctaa | 93300 |
| tcagcctcag | caaggtcaag | taggtcagta | tgcacaacaa | ggtcaaagta | atggtcaagg | 93360 |
| acagcagtta | caaggtacac | aacaacctat | caataacacg | caatttggtc | aaggaactcc | 93420 |
| ttcaggacaa | caaccaagta | acacaggttc | tgttgattgg | gataacttag | cgcaacaaca | 93480 |
| atcacaacct | gattcaaacc | cattcaatga | ttttgatgtt | agcagtgttg | atgattcaca | 93540 |
| ggtacctttt | gagacacaac | ctcaaaatac | acaacaagca | cctgaaccac | accaaactac | 93600 |
| acaagagcct | ccaaaacaaa | aacaaacgca | aagtattgac | gatgtattag | gtggtctaga | 93660 |
| cttagataac | ctataagata | tagagtgcct | tagagcactc | ttttatttga | gatataatta | 93720 |
| ctaggaggat | attaaatggc | aagagcaaaa | aaaggtaaag | aagtagattt | aacagattta | 93780 |
| aatacaattg | atttaggtaa | agaattagga | ttaacattgc | tatcagatac | aaacagagca | 93840 |
| gatattaaaa | acgttatacc | tacaatggtt | cctcagtatg | actatatttt | aggtggaggt | 93900 |
| attccattag | gtcgattaac | agaagtttac | ggtttaactg | gtagtggtaa | atctactttt | 93960 |

FIG. 19YY

```
                              sequence.txt
gcagttcact tatctagaat tgcaacacaa ctaggtgtta tcactatttg gattgatatt    94020
gaaggaacag cagataacaa tcgtatggaa caacttggtg tagatgtttc aaaactattc    94080
tctattcaat caggagaagg tagacttaaa aatacagtag aattatctgt agagcaagta    94140
ggtaaagaat tagaatactg gattgacact ttcaatgaaa agattccagg agtacctatt    94200
gtatttattt gggactcatt aggggctaca agaactcaga aagagattga tggcggtatt    94260
gatgagaagc aaatgggtct caaagcatca gctactcaaa aagtaattaa tgcagtaaca    94320
cctaaactaa atgatacaaa cacagggtta attgttatta accaagcccg tgatgatatg    94380
aacgcaggta tgtatggtga ccctattaaa tctacaggtg gtagagcttt tgaacatagt    94440
gctagtttac gtattaaggt tcataaagca tctcagttaa aacagaagag tgagttaact    94500
ggtaaagatg aataccacgg tcacattatg cgtattgaaa ctaagaaatc taaactatca    94560
cgaccagggc aaaaagctga agcagactta ctatctgatt atatggtagg taaagaagat    94620
gacccatatct tattaaatgg tatcgactta gaacataccg tatataaaga agcagttgaa    94680
agaggtttaa ttactaaagg agcatggaga aactatgtta cattgaatgg tgaggaaatt    94740
aaacttagag atgctgaatg ggttcctgta cttaaagata atagagagtt atatctagaa    94800
ttgtttagta gagtttatgg agaacacttc cctaatggtt actcaccatt acttaataac    94860
aaagtaatcg taactcaatt agaagagtat caagctcttg aaaactacta taaagaatgg    94920
gctacagata taaacaaga agaacaagag gaagaactaa aaggagaatc tcaagaaaag    94980
gattctgaat aatagatgga taatttaata gataaaaaca tgagtcaggt aaaagaatct    95040
ttggggaacg caaattcctc agatgttctt cctttacctt ataaagatat agcaaagaaa    95100
tttgaagaag taaagaaaa aggtgaatca attatcattg aagaaggtgg attcccttat    95160
acagattcta cagtgatgta tatagaacat gtaacagata gatgggcagg aggatattcc    95220
ttaattagac atgaaggtga ggaagttaaa gtacctaaga ctatccattt ctctgatata    95280
tatgttaaag ataaatcaca caaagtaaga ataatcttcg aggggctaa tccttatgaa    95340
gaaagctaat aatggtaata gatatgtaat agatatagat ggtatacctg ttgattttga    95400
aagagattta gatagtttac ttaataggta taaaaacctt agatggtctt tatatcatag    95460
atacgcaggg attttatcta atgattttga aagacaagaa ctaagagaat atattgatga    95520
gcaatttatt aaattagtta agaatataa tattagaagt aaagtggatt ttcctggata    95580
tattaaagct aaactaactt taagagttca aaatagttat gttaagaaga atgaaaaata    95640
taaacgtact gaaattatcg gtaaaaaga ttatacagta gagtccttaa cagaagattt    95700
aaatgaagac ttcgaggata atcaaattat gagttatgta tttgatgata tagaattac    95760
agaggttcaa agtgagttac ttaaagaatt acttattaac cctgaaagag aagatgatgc    95820
ctttatcgtt tctcaagtag cggaaaagtt tgatatgaaa agaaaagaag tagcaagtga    95880
```

FIG. 19ZZ sequence.txt

```
gttgacagaa ctcagagact atgttagatt taaaataaat gcataccatg agtactatgc    95940
taagaaagaa ttaaataacc atagagttaa tactgaaaat catatttggg aaaactagtt    96000
acagtgcctt ccttgtgtta tattattatc gagaattcaa taataaagca tagggaaggc    96060
tttttttctat gtcttataga atgctttaaa atagattact aaaataaaga ttggagatta   96120
agcttatggc taaaaagaat gttaatgatg tattacaaca agaatctgtt acagtagcag    96180
ataagtattt acaagttaaa gttaaccgtg acggttatac tcgtacacat gaaggacaat    96240
atgcgtacaa agtagtttca gagggagaag aattattctt atacctgta caaacagatg     96300
gtaaaggtac attaaatgta atgaagaaat cacctattgc ttacactgat ggagacaata    96360
tccatttcgt agtaaacaca gtagtagacc cttataatca ctcatttatc cgtactgaag    96420
atattaaagg attagataaa ggtaaacaac ttattcaagc tttcttagct ttcgttgaag    96480
accgtttcaa atttggtgtt tataacgtat ttgttgcaaa caacaaagag gatgtattat    96540
ctattgtaga ccctacagat aatgatgcag atgaagttaa agatagttta gagcacgcac    96600
atgaagatgt aattgcggat ttccctgcta gccctgctcg taaggacgtt aaaggcgtag    96660
attcaggaga aggtcaagga gacacttcag aaccatcagc acctaagaac gttcaagtta    96720
ctcctaagga agacggagca gacgtatcag cagaataata tatagataag gatggtaaat    96780
ttggctaagt taaatttata caaaggtaat gagttactaa acagcgtaga aaaaacagaa    96840
ggaaaatcaa caatcacgat tgagaattta gatgctaata cggattaccc taaaggtact    96900
tttaaagtat cattctcaaa tgattcagga gagtcagaga aggtcgatgt tcctcagttt    96960
aagacaaaag caattaaagt tatttcagtt acccttgacg ttgatagttt agaccttaca    97020
gttggagata ctcaccaact atcaacaact atcacgccta gtgaagcatc taacaaaaat    97080
gtgtcatttg aatcagacaa atcaggtgtt gctagcgtaa catcagaaga cttaattgaa    97140
gcagttagtg caggaacagc taatgttact gtaactactg aagatggtag tcacactgat    97200
attgttgctg taacagttaa ggaacctatt cctgaagcac ctgcagacgt aacagttgaa    97260
cctggtgaaa atagcgcaga tattactgta taagaggaca ataaagaatg gaaaagacat    97320
taaagttta tagtaatggt gaagttgtgg gctctcaagt agctaataac gatggagcta    97380
ctacagtatc tattacaggc ttagaagccg gaaaaactta tgctaaagga gattttaaag    97440
tagcatttgc taatgattca ggtgaatcag aaaaagtaga tgttcctgaa tttacaacta    97500
aaactcctac tgaagaacct tcaggagacg cataataatt aagaccaact aaaaagttgg    97560
tcttttttta ttgacaattt ataatatcta tgatacacta tataagaatt aagaaaagga    97620
ggggaaagta atggatattc caacaatatt atttagaaat ccatatgatt atacgaaagt    97680
aaaaaaatta atggaaaaca aagagcagta tattgtagta agtttgatt ctgtttctgt     97740
```

FIG. 19AAA

```
                              sequence.txt
tcataattta aatgttcaag gtatgatgaa tgtcatccaa gattacctac acatctatgg    97800
ttacagagtt aaagagtacg gacaagaaaa ttcttctaaa gatgatgaaa gagacgttaa    97860
aggctactta tatgaaagag taggtgagta gggtatggga attatagtaa actccaacca    97920
tattcaatca gacactttat atgagtatga tagcttttt gatattgaga aagtagatac    97980
atttgaagaa ggattgcttt caatacagga tgagccaact gttttagcag gattcatcta    98040
tgatgatatc acatttaata aggtcattaa ttctaattca gatattgatg actatattaa    98100
gaataatgat atttattatg tctctgatat aggattactt cctgatactt ttatcactgt    98160
tgattctgat agaaaatatt attcattatt acaacagata actgagttaa gtaaagaccc    98220
ttttcctaaa tgggtagagg atgatgcaaa aggtttaact aagtattata actttcaaga    98280
ttttgaagat gtatttgatt taaatagttt ttacaaaaaa gaagttgaca tggtaagaga    98340
aaagtgctat aataatggta atgtatattt attatatgag gttctgcctg attataaatt    98400
acctctagct tatagtttac tttcaaacaa ggagcatggt attgttatta tcggttcaca    98460
gacacgttct aataatgata tactgacttt ttatgttaaa ggtatggatg ctaaggcaat    98520
agctagtatg ttcaatgtag aacatgatta tgattctaat attttccata catttgtaaa    98580
cagtcacatt aatatttag gaaatcaaat aactaagttt ataagagaga aaggaagcag    98640
ttatgagtaa ctataaaaca atagaagaag tacaagcagt tattattggg gtattattta    98700
aagatgaagg taaaattata acatctaagt ttaataaaat tactaaagag tttggtttag    98760
atagaatcgg taaagatgac cttaaagaaa ttgtagagga tatccgacaa gacgcttatc    98820
taaatgaact taaaaacaaa gcaattaaag gtaaagtaac gttaggtgat ttaaaagatg    98880
ttgcagataa ccaagtattc gaaggtaata actaccatga agaagtatct acttatgtag    98940
tagctaaaga aaaagaattg tctcacttaa gagaacagcg taagcacaat aggcatactg    99000
catacccctca aattatgttt gatgaactta agaacatat ggttaaggaa ttacaagggg    99060
aaacattagt agaacatcac ggaagtaaag ctaatattaa tgatacagag ctaattgtgt    99120
tactatcaga tttccatatt ggaagtattg tatctgatat gactaatggt aaatatgatt    99180
ttgaagttct taaagcaaga ttaaatcatt ttattaatac aacagttaaa gaaattgaag    99240
atagagaaat ttctaatgta actgtttact ttgttgggga cttagtagaa catattaata    99300
tgagagatgt taaccaagca tttgaaacag agtttacttt agcagaacaa atctctaaag    99360
gtactcgatt acttattgat atcctgaatg tactatctaa tgtagtttca ggagaactaa    99420
gatttggtat tattggtggt aaccatgacc gtatgcaagg taacaagaat cagaagattt    99480
ataatgataa cattgcttat gtagtgttag attctttatt gttattccaa gaacaaggac    99540
tattaaatgg tgtagatatt attgataatc gtgaagatat ttatactatt agagatacct    99600
ttggcggtaa atctattatc attaaccacg gagatgggtt aaaaggtaaa ggtaatcata    99660
```

FIG. 19BBB sequence.txt

| | | | | | | |
|---|---|---|---|---|---|---|
| tcaataaatt | tatcttagat | agtcatattg | acttattaat | tacaggtcat | gtacatcatt | 99720 |
| tctcagtaaa | acaagaagat | tttaatagaa | tgcacatcgt | agcttcatct | ccgatgggat | 99780 |
| ataataacta | tgctaaagag | ttacatttat | caaaaactaa | accttcacag | cagttattat | 99840 |
| tcataaataa | ggaaaataaa | gatattgata | ttaaaacagt | attttagat | taaggatggt | 99900 |
| taataaatgg | atacaatttt | tattataggt | gtagcgttta | taacttttgc | aacatttaac | 99960 |
| atagtcttta | gattatttga | tttatggact | acagagaaaa | aaatggtaag | tcaaggacaa | 100020 |
| cctccactaa | gtaactttga | gtactatcat | gtgatagtac | cttacttagt | aggtgttatt | 100080 |
| gttattatac | tgagtattat | ttttagggat | tccttgtatt | ccgcacaatc | agggttcggt | 100140 |
| gttattatta | caagctttat | ttacatgcta | gtttatgtta | taattggtct | tgtagggtca | 100200 |
| tttgtactta | caatattcca | agctagaaaa | gctagacagt | atcaaacaca | ggaggataat | 100260 |
| aatgaagttc | aatgatattt | atgagcaatt | aattaaaaat | gatacagtac | aaaacattca | 100320 |
| tgagtctcaa | gatgacaaag | gaaatattta | tacaatacag | tttgataaag | gtaatgataa | 100380 |
| gtatttattt | aatgttatta | atgatggatt | cttgaaagaa | atgacaaatg | gtatggtaga | 100440 |
| ccatcctgaa | ggtcagccat | attcagtaag | tttaatcaat | aaagaaacac | ctagtatgtc | 100500 |
| agtgaaacaa | tatttaacag | atgtagaaga | tattgtacct | actattagaa | aaatggaaaa | 100560 |
| ggatttctta | tagagtcaag | tctttacttg | actcttttta | ctatatatgg | tatattaata | 100620 |
| tagaggtgac | ttaaaaatgg | attttaattt | tagtgctttt | gataatagct | cattagcaat | 100680 |
| gagaattagt | gagggtgtat | actatttcaa | tgatacgcct | tattacttta | ttgagcatgt | 100740 |
| agaagaagaa | atgtctgagt | atgttattgt | atatgacata | catgacagag | aggaaaaaga | 100800 |
| aaatcctcag | aagaaatata | gaatagaacc | ttaccaacgt | acaataccgg | gaggaacacc | 100860 |
| tcttagtaat | ttaattaaga | gtatgatgcc | tcaacgtaag | tatcctaaga | aggttacaga | 100920 |
| agaccctata | tttgtagcta | atgttattcc | tttaggaaca | gatacagtaa | caggtaaaac | 100980 |
| cggtaaagga | tttttgaaa | gagataagga | tagaactatc | tattctcaaa | aggaaccaac | 101040 |
| taaagtcgtt | catggtcaat | acacaggtgt | ttttataggt | ctaacaagtg | ttaagtggaa | 101100 |
| tagaacatat | accccttag | aaagtgttgt | tgagtactac | aaaagggtta | aaggagatag | 101160 |
| gttaaatgtc | taatgatgta | gttaagttct | atgaaaaaga | tattaaagac | cttatcagaa | 101220 |
| ctaaaaaaca | catgttcaaa | gacgatgaaa | taactagtga | tataaacgat | atacgaatct | 101280 |
| ttaatgagaa | agtcatttgt | caaggtaaat | gtagaacaga | ttgtttagtg | ttagaccgta | 101340 |
| atggtacagt | aatgggtata | gagataaaaa | cagaacgaga | ctctacacaa | agattaaata | 101400 |
| accaattaaa | atattatagt | ctagtatgta | agtatgtata | tgtaatgtgc | catgacaaac | 101460 |
| atgtacctaa | agtagaacaa | atacttaaaa | ggtataaaca | taatcatgta | ggtataatga | 101520 |

FIG. 19CCC sequence.txt

```
gttacattag ttttaaaggc aaacctgttg taggcaaata caaagatgct acaccatcac    101580
cacatagaag cccttatcat acaatgaata tattatgaaa gacaaactta atgacaatac    101640
ttagattgat tagagacct catacgtata gaacagggta tagctataat gctagtggta    101700
gatatagtgg aggggaaggt aatttctccc aaacaactca aagtaaaaga atgaaaaaac    101760
ctgctattat taaccaaata attcattatg taggggtaga taatacttat aaactctta    101820
caagaggtgt tatctatggt tataataata ggtgggaagt tatagaagaa gatttcttta    101880
atactatgaa gaatggggta agagtaatta atgagcaaag acaaaccaaa tagacgtaaa    101940
gagatacagc atcaacctgt taactttgcc cctacgaata ctttaacagg agctaataat    102000
agtttctttg ctaaaaatcc ttcagagcct aaagatgcaa catctgttat tgaatatcgt    102060
atactattta ttaaaagatt tgataacgta acaagtacag atgtgaaatt acagaaaaag    102120
tatgcactaa atcttattag tgaagcactt gatgttaaag aaacttactt gtctcttaag    102180
caaaaaggaa aaaaaacaga atctattttg catacagata gagtttatta tgttcataga    102240
ggtaaaaaac ttattggaaa gtgtagtatc agagagcaaa gaacatttaa gggtaaacat    102300
ttgatattta tattcaaaac aagacataga gttaaagcag aaaggaaaga taataatgt    102360
taaaaggatt ttcagaacat gtagacaaac ctacaactag taagaccta tacaagacct    102420
taacaagtgg taaagtagaa ttactaggtg tatcttacga tagtgattac ttcccttcag    102480
gtgttacagt acaatcttac attgaggata taggtaatga agatgagggt ctacagtttg    102540
ttaataaggt aaatgtagta gaatcaatga acaggctgt agtaggtatg aataatcaat    102600
taggttcttc aggtcttggc tatgtgagaa ctgaacaact taaaaaagag ttggaagaga    102660
ctggactaat gacagattta cttgctagag gtactaactt aacctctact aagaaagtag    102720
atattgtaag tactttatt gagcctgagg taacatacca aaatattact atagctaaag    102780
atattaaact acgtttgtat aaagtagaag aagaatcacc attaaatggt tacactcata    102840
ttgtatactt acttactaca gaaaaactat atgatggtca aacactcttc ggtatgctct    102900
ctaaaaaaga taagttatct aaaggagata ctgataaatt attagcattc ttcagaaaca    102960
atagtttaat aagtaaaagt gtattttgtg ttaagttatt aagtaaagac tactacttta    103020
atttatataa tacacatgag acagggatat tcttttaga agacacagat gttattacta    103080
ttgcttgtgg tcagtcatat gttaaagtta acactaaaga tattaagtct agttatgtta    103140
aaattgaaga taagactcat aaattaactg agctagtaat taacctaaag ggtgacgaca    103200
cattaactat tttattctag gaaaatgtta taaatatgtg ataattaagt ataaatatac    103260
gttatataag aagttttcat aatgttttta atacagaaac tagttaagtt ttttctactt    103320
gctctagttt ctgtgaaatt atatttatga aaagttaaaa tatcttttag gtaaaggctt    103380
tgtaaatagt taaaaaatat attaaaattt tatacaaagt agttaataaa attatattac    103440
```

FIG. 19DDD sequence.txt

| | | | | | |
|---|---|---|---|---|---|
| atttatatat | tatgaaataa | taacagaaat | tgtgatatat | tatatagtgt | aaccttgaaa | 103500 |
| cagttgatgt | tgtagggttt | gtttatgttc | gttaaactgg | tttcaaaaca | tcagttacca | 103560 |
| taaataaatg | acagttaagg | agagctatat | aatggctaga | aaaaagaatt | tacgaaataa | 103620 |
| aaacagtgat | ataaaagttg | ttcctgataa | agaaaaagaa | agtatattat | ctaagctata | 103680 |
| ccataataaa | ttactacgtt | ctaaggtaga | taatgcatta | gatgaagata | tgagttatga | 103740 |
| tgatattata | gaactatgta | aagaatatga | tttagaattg | tctaaatcag | ctattacaag | 103800 |
| atacaaaagt | aaaagaaaag | aagctattga | aaatggttgg | gatttaggag | aattaattga | 103860 |
| taaacgtaaa | aaaacaagtg | taaaagatat | taaggaaaaa | gaaactccta | tattagaaga | 103920 |
| ggagcaactt | tctccattcg | aacaatcaaa | acatcacaca | caaacaattt | atgatgatat | 103980 |
| tcaagtacta | gatatgatta | tttctaaagg | tgcaaaagga | ttagagtttg | tggaaacttt | 104040 |
| agaccctgct | ttaatgatac | gtgcaatgga | aactaaagat | aagattaccg | gaaatcaatt | 104100 |
| aaaaggtatg | tcatttattg | gacttagaga | attacaatta | aaacaaacag | ctcaagatac | 104160 |
| agctatgagt | gaagtattat | tagaatttat | acctgaagag | aaacatgaag | aggtattaca | 104220 |
| acgattagaa | gaactacaaa | atgaattcta | caaaaatcta | gatttagatg | aggaaagtag | 104280 |
| aaaattaaaa | gaagctcttg | atagagtagg | ctatacaatt | tagatagtga | ggttagagta | 104340 |
| atggcagatg | agattagttt | aaatccaata | caagatgcta | agccaattga | cgatatagta | 104400 |
| gatatcatga | catacttaaa | aaacgggaaa | gtactgagag | ttaaacaaga | caaccaagga | 104460 |
| gatatccttg | ttagaatgag | tccagggaaa | cacaaattta | ctgaagtatc | tagagactta | 104520 |
| gataaagaat | cattctacta | taaaagacat | tgggttctct | ataatgtatc | tgttaactct | 104580 |
| cttataacat | ttgatgttta | tctagatgaa | gaatattcag | aaacaactaa | ggttaagtat | 104640 |
| cctaaagata | ctattgtaga | atatacaaga | gaagaccaag | aaaaagatgt | tgctatgatt | 104700 |
| aaagaaatac | ttacagataa | taatggtaat | tatttctatg | cacttacagg | agaaacaatg | 104760 |
| ctctttgatg | aaaataaatt | aaataaagtt | aaagattagg | gttgacagct | tctatagttt | 104820 |
| atgatatagt | atatgtatac | taaaaataaa | ggagctaaca | attatgttta | tttcattaaa | 104880 |
| tcaagaagag | aaagaattat | taactaaaga | ggaaagtaaa | tacacaccac | tagaaacatc | 104940 |
| aagagagttt | aacacaccta | agaagaatt | cattgtaaca | agttataacg | aaggtaaacc | 105000 |
| cttagattac | attgcaaaag | aagctaaggt | aagtatggga | ttaatttaca | cagttctaaa | 105060 |
| ctactataaa | gtaggtaagc | gtaataagaa | atcacctgta | gaagaaagaa | ttgcacatat | 105120 |
| cttaaaagat | aaaaacttag | tcaaagagat | tattaaggat | taccaatata | tgaatttaca | 105180 |
| ggacatttat | agtaaatata | atcttcataa | gaatggttta | tattacatct | tagatttata | 105240 |
| ccatgtagaa | agaaaatctg | aacttaagga | caaagcatta | gaagaggata | atattgtcgt | 105300 |

FIG. 19EEE sequence.txt

| | | | | | |
|---|---|---|---|---|---|
| tgagtaagta | aagaggttat | aatatgagaa | ataaaaaatc | atttcaagag | cagttaaatg | 105360 |
| acatgcgtaa | taaagagaaa | tgggtatctg | aagaggagtt | cactgaagaa | gtggctcctt | 105420 |
| ctgaagaacc | tgaagtagaa | gaagaaaaac | tatatacttt | aaatgagtta | aagagaact | 105480 |
| tactagatgc | tcaaggatta | aaagatgttg | tagctgattt | tcctgcatct | aaagatttat | 105540 |
| atgaacctaa | taaactatat | atttgtacaa | taccaaaagg | atatcgttct | acagaagtac | 105600 |
| aaccaggtca | atatattggt | atcagtacag | gattattatc | agaatcagaa | gattttagtc | 105660 |
| atttaagagg | tcaaatgcct | agaaatcttt | atgaaacttc | tcatgtttta | aaacctttag | 105720 |
| tacgtattaa | taatacaaat | ctcgaatatc | aacagcatga | gttacttgaa | gatattaaag | 105780 |
| atgacaagaa | gatatacgat | gttgaattag | aagacctgag | attagtaaca | ggagaagaaa | 105840 |
| tatcccattt | agaaattgtc | gatagtaagt | tttttgaaag | tcgtattaat | gaaattctag | 105900 |
| accgctatac | tgaattaacg | gattccgatg | atttgcttat | atactatagt | aaattacgag | 105960 |
| aattagttgg | tagtgacaaa | atgatttatt | gttcactttt | agataaatgt | gttaaaatta | 106020 |
| tagattaata | gttagtctcc | tcttatatta | taactgtaag | aggagacatt | tttgtataga | 106080 |
| ggtgttaatt | atgtcaagaa | aagcaagtat | attctatata | ctagtggtta | ttgttttggc | 106140 |
| tttttctatt | tcatcttatt | atatatcttc | tttcatgtat | cacgacaaag | caaagaatga | 106200 |
| agtctctact | gagttatcaa | acacgggaaa | gattaaagaa | gaaagaacg | tagaatttgt | 106260 |
| cggtgactat | acacttaaaa | aagtggaaaa | taataaagct | tattttatgg | aaacattacc | 106320 |
| tacttaccta | cccggtagaa | caggagataa | cagcatagat | atgaggtact | acaaaacaag | 106380 |
| tagatttaaa | gaaggggtaa | atttcaagct | tattagggta | tatactgaag | atggggaaga | 106440 |
| taatccaatt | cataagtata | ggtttgaagc | agtaccaacc | aaaaagtaat | aaggaggtga | 106500 |
| cttaaatgac | aacattaatt | gtcgtcatct | ttattgctat | catttattac | ttatggaaca | 106560 |
| gtgattgagt | caagttaatt | cttgactctc | tttttgtttt | atggtatatt | aatatataga | 106620 |
| aaggagagat | taattatgga | aatggcagat | ttagaaagat | tcgatacgtt | tgtaagatta | 106680 |
| gtttcagatg | atgagctttc | ggaggagaga | gcattagaat | taagtgtaga | cttattaaat | 106740 |
| ccgatactag | aaggaggtac | agcttaccaa | gctaaaaaac | gcattagaag | taagttcggt | 106800 |
| aaaatagaag | caaaaaactt | taaagaaat | tataaattct | tactcaagtc | gatagctcaa | 106860 |
| atagaccaaa | ggagatagga | caatgataga | aagggaaaag | ttagttaaag | aaattgaaga | 106920 |
| tgctaataga | gacatacaat | tgaggttaaa | agaagtagat | gattataagg | atagtatacg | 106980 |
| ttctaaagga | acaagaaact | atgtatctac | taaggtatta | gattcagtta | tggtagggct | 107040 |
| aattataagt | ttctttattc | ttgtaatgtt | acgtgtactt | gaatattttg | taacaggtaa | 107100 |
| tgctgtttat | tcacctttag | cacccgcagt | tattattatg | tttgttttag | ccttaggtac | 107160 |
| atggaaagta | agtaaaatga | ataaaatagt | atcctatagg | ggaactatta | agatgtactg | 107220 |

FIG. 19FFF sequence.txt

```
ggaattaagt aatgctgaac agaaccaagc taaggtattt aagtatccta atgatgaagt    107280
agatattgta tcaaaacata acttaagaca aataactttt agtgagatta atatacttca    107340
tcttaaatat atgagatata ataaggcagt agaacagcat actaagttat ctaaagaact    107400
tttttaaaaaa gataaagaaa ctgttgacaa gaataaataa gtgtagtata gtattactaa   107460
aggaggagag atattatggt tatacctagt attaaagcac aaaacaaatt caagaatgaa    107520
ttagagtatt ataagcaagg tcacattagt gaaagtaaaa tgttagaatt agcttttgat    107580
tacattcaag aattagaaca aaataatgaa tacgttacta atttgctaga agaggagaga    107640
tacggtgagt aaatttattg gagtgtactt atttaattta ttagtagtag cactaattta    107700
cacagtagga ttttttattct tttatggtgt agctagctta gttattattt taactcatgc   107760
tactattgac ccgttcgtat tagctacttt cttaggaata ggattcttag ttattagaac    107820
tgcacacaga atcatggcac gagtaattaa tgatgcagta gctaaagcta ttaaggataa    107880
agaaaatgaa taaaggggaa tttattatgg ataaaacatt accaaagttt agtgtatatg    107940
aagttattgt aaagactgta attatgacac caacagaagg aagttctgac ctagaatcat    108000
tttacttttc aactagagag ttagcagaaa gatttgttga agaaaataca gtggaaacaa    108060
aaaacggtaa acgtgtatct tttgctgtta aagaacgtaa agtaaatcaa ccaggctaac    108120
attaatttgt tagctttttt tattgacaaa tcattttata tagtgtatag taatatata     108180
cagaaaagga ggaattatta tgaaagtttc agaagaagta aaacagagtt atctagagaa    108240
tagagctaat actaaaatgg ataagataag ttggtctgag ttaaggtcta gtcctttagg    108300
tattacctta ggtgatatta tattttatag tgtggttatt atagataaca ttatagctat    108360
tattttaact ttaaccttaa taggtactat tactgactca attgagagta ctttagccca    108420
aataatcgta gggatgttca taatcattac tatatatgga atcctatcag cgttaatacc    108480
tattctagtt cataaagctg tatcaccggg atggagctat actgaatgga atgaatccta    108540
ttacatcaga ttacctggag aagagaacta caagtactat agtaaatggt atttagattt    108600
attaggagtt aaagaatttt actataagag agacaatgga gaagaagtaa aagaaaaaat    108660
atatcatggg cttttcaagc tgaagtaaaa agacctgaag atgttaacca ctggaaaaac    108720
caattgctta ctaatagacc tttaacaatt ttagaatata aaaaattaaa gaattagat    108780
aaggaaagtg aaattaggaa acaagaagat ttagaagaat ataaacaata caatagtaat    108840
taaagaggtg gaaagcaatg ataagctcat tgatagtat actacttgtc atatacatta    108900
ttatagcttt tgcagtagct atggcaatta tctacttagt atttaaaggt atgactattc    108960
tactagataa gctaatgatg ttattattaa gtaaaactac attagatgta gaagcttgct    109020
ctatgataat ggcagtcatc agtacaattg tgtttggaat tattgtactt ttaatatggc    109080
```

FIG. 19GGG sequence.txt

| | | | | | |
|---|---|---|---|---|---|
| tagcagtaaa | taatatttta | ctataaggag | atttactatg | gattttaatg | actttataaa | 109140 |
| cagtgaatcg | gatagggtag | gtaagcctaa | acaaaagaag | aaggtagaga | ataagctacc | 109200 |
| ttcttctact | cctattgaag | ataaggaaaa | gaaattaaaa | gagataagaa | agaaatcatt | 109260 |
| atatattgat | ttaaggagaa | aaagaaatga | ctaaagaaac | aaatgtactt | tacaaagata | 109320 |
| agtatagaga | ttatactata | gttgtaagat | tagcagggaa | tattattgtt | actgaagtag | 109380 |
| ataagaaaca | taaaacagca | tttacaccta | ttatatttga | caatggtgta | gaaggcgtag | 109440 |
| agcttgtaat | gcgtataggt | tctgtagagc | ttagcatgac | agatttacgt | gagttcacaa | 109500 |
| aggaagtatc | tacagctcag | aaagctttag | aatattttaa | taaaaaactt | tatattaaag | 109560 |
| gcttgacaga | tgaagcattt | taatatatac | taaaagtata | aataaaataa | agaaaagagg | 109620 |
| aatgattatt | atgttattag | gaattttatg | gtttatatgg | ggatttgtat | cgtactttgt | 109680 |
| attgatgttt | ggaattgagt | tttggaaaga | tagatggatg | ccaggtgtta | tcggagcagg | 109740 |
| agctttacta | ctattcttat | tttggattat | gaaatctatt | cataatgcta | tgacagtagt | 109800 |
| atacttgtat | taggaggttg | tatagatgat | tgatatacta | gttattcact | atgaagaaac | 109860 |
| aaataaacgg | gttttaaaag | aaacaataca | aacaatacaa | aatcatttaa | atgatgaaca | 109920 |
| tggtttggtt | aagatgacag | caacaaaact | tagcagagag | aatatagaga | aaagatttaa | 109980 |
| taactataat | atagtcattg | cagaagatga | ccctgataat | tcttatcatt | acggtgaagc | 110040 |
| tgtagaagac | gcagatttta | ttatagacat | accaatttca | tatttagata | tacatgcagg | 110100 |
| aatagaatgg | gatgttgata | atcctgtaga | tatgctagat | aggaatcctg | attttataga | 110160 |
| agctgtaaat | aaactaaatg | aagacttaat | gttataagga | ggaaatagaa | tgctaaatga | 110220 |
| aaaactaaaa | aacctggaag | atacaaaagt | atacatgatt | aatagtattg | caagtttact | 110280 |
| aagcgcaagt | acaggaaaat | caagtaaagt | attttttgat | gaaggaacta | ttaaaattgt | 110340 |
| aagtggtgaa | acaaaagcag | tagaagttat | tgataactta | gttcaccctc | actcaggacg | 110400 |
| tttacctatt | aaaacaacag | aacgtattgc | gctaggtaga | ttaacagatt | ctttacagtt | 110460 |
| tgttatctca | gaaatagaag | tagttaaaga | ccaaattata | gatgaagaaa | atgaagctta | 110520 |
| cattgatttt | gtgatggaag | actggaactg | ggattaatgc | ctatggactt | attaactatt | 110580 |
| gcttctgttg | cttttatagc | tgtagtcatt | attgatttga | ttaatgatga | tatgagctat | 110640 |
| atgcttactg | gtactgcaat | cttaataaat | atttgggcgg | gattttatgg | atggtttttc | 110700 |
| ttactacaag | caggtatgtt | acttttctta | ttattagcta | ggaaggttaa | agatgataag | 110760 |
| gagtcaatac | tatattccag | tgcttcatta | atatgtgcac | taggaatgat | aataaatctt | 110820 |
| ctttcatttt | cttaaaaata | agtattgaca | cctttgtact | tttgtattat | acttagtata | 110880 |
| taacaagtac | aggagatgat | taatatgagt | aaagaaacaa | tcagaagaca | attttcaaat | 110940 |
| gcaattgaga | ttatggcaac | aactaaagaa | tggtggaact | tccctaaaag | ttttgatacg | 111000 |

FIG. 19HHH sequence.txt

| | | | | | |
|---|---|---|---|---|---|
| aataaagaat | ttaaaattaa | aacttttaaa | aatgatacac | ttgtatttga | agttagagaa | 111060 |
| ggtagtagaa | acttaggaag | ctttgtagtt | tttacaaaca | ttgattttga | ttatgataaa | 111120 |
| ctagaaggaa | cttcaacaca | atatatgatt | aattactttg | ctaagaaatt | aactaaagat | 111180 |
| atgtttaact | atcataagtt | acaattatag | taggaggtgg | aaagatgaga | gaagagttaa | 111240 |
| aaccttttaa | taggaaacaa | gttaatgtta | aagggtattt | agatgatgtt | aagtactcaa | 111300 |
| agcgtagaag | acataagggt | aatcaacatg | ggtgtgttaa | aatcacagtt | actgatgtaa | 111360 |
| agattaatgg | tatacctatt | gaccacgtta | acattgaagt | tggtatctct | ttctatgaaa | 111420 |
| aactaaagga | gcttcaagga | aagagaatcc | aatttgtagg | cactgtttac | aagtatgtta | 111480 |
| aacatgctag | agggcgcaaa | ggtagaatta | aaggatttta | taaagaggat | tatagcgtaa | 111540 |
| ctttagataa | gaagttacaa | aaggaggaaa | ataatgact | gaatggtatg | ctttatgcta | 111600 |
| ttatgataaa | gtaggtaaaa | agaaaatacc | taggcaagtt | agagcgcaca | gagatatttc | 111660 |
| agtattagaa | gaattaaaag | aaagattaga | agaaagaaat | cctaatacag | aatactctat | 111720 |
| aaaaacaaca | aaagaatttg | atgaggagag | ataaggatgt | taacaccaca | acaaaaagat | 111780 |
| tcattaaaag | aacaacaaaa | gaattaagt | aaaaagaaga | ataactgtt | gacaaatgag | 111840 |
| tgtgcatagg | ttatacttaa | gttaacaaat | aaagaggagg | tatgacctat | gttattcata | 111900 |
| atttttattc | tagcagtatt | ctttgtacta | ggatttatta | acggatggaa | ctcagaagac | 111960 |
| taaaaaagga | gtggttatag | tgaagttaga | agataaagta | ttagaaagaa | ttgattctct | 112020 |
| tggaggtaag | ttaggtgata | ttagccaaca | tgcttgggaa | gctttagtaa | agtaccaaat | 112080 |
| tatatatggt | attatagacc | ttatagtagg | tattgtagtt | atagcattaa | ctttattttt | 112140 |
| atggaaggta | tttattaatc | aacataagaa | ggtaaatgat | atggatagag | atgatgatta | 112200 |
| tagtttacta | tttgaagatt | gtgaagattt | atcaggcata | ggtttgtttt | atgtaatagt | 112260 |
| tacatcatta | atatcactat | ttgcatttat | atacttaatc | tatggaatac | ctatggatat | 112320 |
| tataaagata | ttaaaccctg | aagtatttgc | agtaaaagac | ttaatagaac | aagctaaagg | 112380 |
| aggaaattaa | tatgaaacaa | agagatttcg | aatttgaaga | ggattttgta | ttaacttatg | 112440 |
| aatgtgagga | ttgcaaacat | ttcgaggatt | ggggtcatga | tgaagagcct | gaagaatgca | 112500 |
| gtgaatgtgg | tagtagtgac | ttaattaaca | atacaagtca | tgaagacact | gagtgtgata | 112560 |
| tgtgtaaagg | atacattgat | atgtggcaag | atggttatag | atacatggga | gataataaag | 112620 |
| cataccttga | aaaagaagat | tcaggtttaa | tttgtgaaga | ttgctatgag | aaattagata | 112680 |
| tttaataagg | aggaatttat | atgaataaag | cagtagaaca | agcaagtaac | gcagtaggtc | 112740 |
| aaggattttc | agccatggta | tggcatcaag | tattagtagg | tctagggttt | attttattag | 112800 |
| ggttgatatt | atccttacta | gtttgggtac | tagtgaaaaa | atttcatgta | ccttttaatc | 112860 |

FIG. 19III sequence.txt

| | | | | | | |
|---|---|---|---|---|---|---|
| acccaacagc | ttttgttgta | tattcaatta | tgttagttag | tattgttgct | agttttattt | 112920 |
| ggggcggttt | acatgtaatt | aaccccgagt | attacgctat | cttagaactt | aaaggtttta | 112980 |
| taaagtagga | ggaattctat | gactaaagaa | gagttagagc | aaagagtaaa | agaacttgaa | 113040 |
| gcagagaata | aagaacttaa | aaaacaaata | gaacgttttg | aagacgaggg | aggaaaaaca | 113100 |
| aaagatgaat | agtagacaaa | agaaaatttt | aacattaaca | gtaagtaact | ttttaattct | 113160 |
| agccttagat | actgtagcac | taattagata | taaaaaaggt | aaaattaaac | aagagaatta | 113220 |
| taacacaggg | caaattacaa | gaatgatagc | tacaacagct | aactcattag | gtattcttta | 113280 |
| cttagaagag | caagagcgta | aagaagttaa | agatattaaa | gtaggtactt | ttgaaattgg | 113340 |
| agccttaaaa | agatttacaa | ataataaata | aaaaaagttt | aagaaaccta | ttgacattag | 113400 |
| gtttctttta | ttatatacta | atattataag | aaataaggag | gttaacttat | gaaaggtatt | 113460 |
| atcatatttt | acaaggaaga | gaccaaagag | gatttaggat | attttcttgg | gtttataaac | 113520 |
| tttaagctag | aaggattatc | ttacacaact | gaaggtactt | tagtagataa | tgatgtagta | 113580 |
| gttttaaagg | ataaccaaat | taatgaggat | aatttagagc | agtttagtat | gtcaaacaat | 113640 |
| aatttagtta | ttggaatact | aggtcattca | tctctttcag | tacgcatcta | tgaaaaaggt | 113700 |
| attagacaag | agtttgatag | agtagaagaa | tatttagagg | agttgagaca | ataatgatat | 113760 |
| ttatattaat | ttttggttta | ctatttattt | tatctttact | aggtattttt | atttattcta | 113820 |
| tagttttacg | aaagaaaaaa | caattaatag | aagaaagaga | atcatttggt | atttataata | 113880 |
| gaacaaaaga | aaaactgggt | gatgtaacac | gtttagggta | tgaggaagat | gtatataagt | 113940 |
| taatccataa | ccaatctaat | aaaacaatca | tagaggataa | aaagagtaaa | gttgtagata | 114000 |
| caattaaaaa | gatgtatgaa | ttagaattaa | catctgtaga | tgtttctaag | gtagaaggat | 114060 |
| tatctccact | tgatacagaa | cctatgacaa | atatgaaatt | actttcatat | aagctagata | 114120 |
| gagaaggatt | atatagttta | agtaaattta | tttaggagtg | atacaatgga | atttatagat | 114180 |
| aaaaataatg | taattaaagc | ttatgatata | ccaaatgttt | atttaaaagg | ttatgtatta | 114240 |
| caggcatgtg | ataaaaatgg | agatacaaca | gcttatgatg | gttatgacca | aatacactat | 114300 |
| aaagaaggta | gagtattaac | attcccttt | gataaaccat | taagaaagat | aaatgtacta | 114360 |
| tcaggatatt | acaaactatt | taaaaaggag | gacataatat | gatttatttt | gttagtgatt | 114420 |
| tacatttcgg | tcatgataat | attagagaat | tcgaagcacc | tacaagaagt | cactggaact | 114480 |
| cagtagaaga | aatgaatgaa | ggtttaattg | agttgtggaa | taatacaatt | acaaataacg | 114540 |
| atattgttta | taacattgga | gacttctttt | tcaatatgaa | accttctaaa | gtagaagata | 114600 |
| tacttaatag | actaaattat | aaagagatga | tactgattgc | aggtaaccat | gaccataaga | 114660 |
| aacttataaa | actatatgaa | cgtaatggta | ttacagtaaa | gtacgcagac | atgattaaaa | 114720 |
| aggatggtaa | gagattttat | ctaagccatt | atcctacact | aataggtaga | aaaaacatgt | 114780 |

FIG. 19JJJ sequence.txt

| | | | | | |
|---|---|---|---|---|---|
| ttaatattca | tggtcatata | cactcacaat | taatgggtac | tgaatatcac | atcaatgtag | 114840 |
| gttatgatgt | agagggtaaa | attgcctata | gttttgatga | tattataagt | agagcaggtg | 114900 |
| aatataatgg | agaaattcaa | aggtaaagat | ttatataaaa | ctagaattag | aaaacaaaca | 114960 |
| attaaaaatt | tagttataaa | aacagagaag | ctacataata | aacacggaaa | gtatagacct | 115020 |
| attggtcatg | tttattatta | tccaaaaaca | aaagagttta | ctttatctaa | acctgagcag | 115080 |
| aaaatattta | tagagtatat | gaaggcatta | ggttttagtg | ttaaacataa | gagacgtaag | 115140 |
| aaaataatta | tagtatacaa | gaatgtgtta | gatgaatatc | ttagtatgta | tcaggaagca | 115200 |
| attgaaagta | cgtgttgaca | attaaggtat | actatgctat | agtatagaaa | aggaggttaa | 115260 |
| ctgatgaagc | attttatttt | gattttaggt | attgtaattc | tagttattgc | attaggtatt | 115320 |
| gttttacctg | catggatttt | acaattagta | ttatctgcat | tcggtgttaa | agtaagtatt | 115380 |
| tgggtatgta | tcgggatatt | tattttaatc | agtgcagtag | gaagtatgtt | tagtagaaat | 115440 |
| taaaggagga | actataaatg | gcaaaatatg | aatcaaatat | caatggagaa | aattatattg | 115500 |
| caacaccgtc | acaagcttta | agagaggcat | tggcagaatt | aattagagaa | gaaaagaatt | 115560 |
| ttgcagagta | tcaaactaag | ggtgaggaac | agtatgaatc | acagttacaa | ctaagacact | 115620 |
| ttgattcaat | gatttctcag | tatgaagagg | ctattcgagt | actagaggat | agatattcac | 115680 |
| ctcagatttt | tattccaaaa | gataataagg | aggaaaagta | attatgaaag | cagaatcaat | 115740 |
| agcaagattt | tttcaggata | aggtattaca | aatagaaggg | tataaagtaa | gattcactca | 115800 |
| agctagttca | tcatatattt | tagatataga | tactatggat | gaatcagtat | tgttttaga | 115860 |
| tactgtagtt | ttcactctat | caggcaagta | cttattagat | acgcacatta | caattaataa | 115920 |
| acctgagaca | ctaagttcta | atgaattata | cacagagatt | agtaataaac | tacaagagat | 115980 |
| tgtaggagac | caaactaaaa | cagatataga | gttatcaaaa | tactttaagg | aggtaaaata | 116040 |
| aatgagttca | gaagctatta | caaatcattt | attaaattta | aatcaaataa | aaattaaaga | 116100 |
| atataatatt | catgcttaca | ttaaaaaatc | tgtttgttcc | ggtattgaaa | atgcagattt | 116160 |
| tgaagtaaga | ataaactata | tagcagacaa | agaccctaac | tatattagaa | ctattaattc | 116220 |
| tattattttt | gttgattaca | gtaaccgtaa | tccaaaagaa | attttactac | agtttaaaga | 116280 |
| aaaaattctt | tctattgtaa | aagaacaggt | agagattgat | aatgatttta | ttgaggctat | 116340 |
| taaagatatt | aatacaaatc | atgaactaga | gaaattagaa | ccttttatta | ataaagaata | 116400 |
| ctattctatg | tttaagtcat | ctattgaaaa | agaggtacca | gtagctttat | catctgaagt | 116460 |
| acttaataga | tgtacaggta | aaacaagcac | actagcttat | ttagctattg | aaaaggattt | 116520 |
| acctttaatt | gtgtctaaca | attctatgat | gaaaatgctt | aaaaaagatt | acccttctgt | 116580 |
| taaagtttcg | tctgttgaag | atttctcaaa | ctataatatt | aaaggtgaaa | ttgtacttat | 116640 |

FIG. 19KKK sequence.txt

| | | | | | |
|---|---|---|---|---|---|
| agatgaagta | gatgtagacc | agttatatag | tgcagataga | gtttctgttg | atgcactact | 116700 |
| agtaggtatc | ataaaaaatt | aaataaatttt | gtaaatacct | gttgacagca | ggtattttttt | 116760 |
| atagtatact | ttagatgtaa | agaaaaagga | ggtagtaata | tggttggtat | tataattttta | 116820 |
| attgtcggtt | taatattatt | tttagctagt | ggatataaat | tagttttagg | taaatattat | 116880 |
| gatgacatag | atttaaagat | gttatttaca | atctttggta | ttggtgctat | actattactt | 116940 |
| acaggattta | tattataaag | gaggaaatta | caaatgaact | ataaagaagt | actagaagtt | 117000 |
| attaaaaaga | ataagccatg | taaggttaga | tttactggaa | gtattttagc | aatcgttaat | 117060 |
| aaggaattta | atgcagatac | tgataaaggt | atactacaaa | ttgatgtatc | aaatattaat | 117120 |
| aaaaatgact | acattaagtt | acaacagtat | tgtttagaaa | gagatgatta | tactgtagca | 117180 |
| ggagctattt | tattttaagg | aggagtaatt | atgaattata | gagattttat | tacggattgt | 117240 |
| attagttgtg | gttataaagt | ccacattagt | gttactgaga | aaagagttca | cattattttca | 117300 |
| gaaatgacat | cagcatctta | tccaaagaaa | gaaattaatt | tggatgaatt | acaagcttat | 117360 |
| gtttattata | tgaataattt | tggaagtcag | attcaacgg | agggattata | aatggaatta | 117420 |
| gttattaata | ttatagcagt | attaattggt | atgtatggta | tttactttta | tgttacaaaa | 117480 |
| tttagtactg | gtctatcagg | tatcttaatt | gtactaggta | tggctgtagg | tctttacttt | 117540 |
| tacttagatt | acttaaatgt | tagagagaat | gttattcgat | tagtatctgt | aatgtttggt | 117600 |
| gctttcttat | ttagtatcga | gatgatttat | aataagatta | tgtttgaaat | taaaaaatct | 117660 |
| aagtatgata | agactgttag | aacgtacaga | ggagaccaat | aagaattttta | ctataaagag | 117720 |
| tacttaaaat | aggttaagtg | ccctatatgg | taccttaaaa | tggcttagaa | ttgaaattaa | 117780 |
| ggagatgaaa | agttattata | gctactaaat | atattgtatc | tattgaacga | tggtaaataa | 117840 |
| ggaggagtag | ttatgaatgc | taggaaagca | cgtaagaaca | ctaaaaatca | taaagactct | 117900 |
| agtgtagtaa | ctaaggagca | acacctaact | tatatctata | ataagataaa | ctacttgatt | 117960 |
| gcaaatagta | gtagtcaggg | taagacatat | gtggtaatga | acctaagaac | aggttatcct | 118020 |
| gacgagttct | ctttatctaa | attaaaatat | ctaaaagaaa | ttaaacagca | ctataaagac | 118080 |
| ctaggattta | ccgtacaaac | tcaagtaaga | aagtcacggt | ggtcagagaa | aagtataatc | 118140 |
| aggtactact | ttaacttagg | ttatatagat | agcgtgttag | ttcctattat | acacattagt | 118200 |
| tggtaattac | aaggaggaat | agttatggat | aatccaaact | taaataaaaa | gacactgaga | 118260 |
| gctgtaataa | gagaaatgga | taaagatata | gaagaaagag | cagaagcatt | aagaagagaa | 118320 |
| gagactagat | taagtattgc | tagggataat | agaaaaaggc | tttacattga | attagagtct | 118380 |
| atactagagg | aggaataatt | atggatttta | atttgaaaga | ctatgctgta | agacctataa | 118440 |
| cagacaaaga | aggaaatatg | gtagtaagaa | cagtgtatgt | gtgtttaaag | agagaataca | 118500 |
| gtgattgggt | agtagataaa | gtatatggta | gacaagagag | ttctgaaacg | tggttaaaat | 118560 |

FIG. 19LLL sequence.txt

| | | | | | |
|---|---|---|---|---|---|
| ttatgcaaga | aattagaaac | atagagagag | caaaactaag | agtggagaaa | tggcaagtta | 118620 |
| attagaataa | ttagttaaag | gagggaaaga | tatgagttta | tcagaattat | tagagtatca | 118680 |
| taaaaatagt | ggtaaggaac | gagcagagta | tataagtgat | aatggtaatt | gtagagtagc | 118740 |
| tattatgcat | tatgataaat | gggcagttgt | aggagattta | gagaatgcag | tctttacaat | 118800 |
| tgagaagtaa | tagttatgta | cttatttgct | aaaataatta | ttatatctat | tgatgttata | 118860 |
| cccttaatgt | ctattattgt | tgtacagtta | attacagatt | ataatgatag | acattaagta | 118920 |
| tcgaatattg | ttgactagta | agaagaagaa | aatattacta | ttaagaagtt | aaagttaccc | 118980 |
| gggaatattg | ttgactaaca | ataataagaa | gaaaaaaata | ttattactat | taagtacctg | 119040 |
| ggaattcttt | tacctctccc | actcagccta | ttacttacta | ccgacttccc | taactactta | 119100 |
| ttctatagtt | atagtattca | tttattatac | aatacttaaa | ctatagtatt | ctaaccttaa | 119160 |
| tctatgctga | agcggtatta | atctattgtt | attatataat | aatcttatct | aatagtggta | 119220 |
| taatctaggt | tattacatta | gaatgattct | aatctagtat | tttaatcttt | agaccctagg | 119280 |
| aaaagtggta | ctaaaatata | gaaccctata | ggtacgggat | tcttatttttt | aaaattacta | 119340 |
| aaaagtatta | ggttttccct | agggtaaagt | tttaatgtac | ttaaaatcgt | aagtagctcc | 119400 |
| ttatcattta | ggtctgttta | attgagaata | ttagaagata | tccgcttcaa | ttacaattaa | 119460 |
| gtgttgacaa | tcatgaagcg | gtatgttata | cttagtatat | aaattaatag | gagatgaatt | 119520 |
| aaatgattat | accattaatt | atactcatga | tgaccttcgg | tacatttgca | ttcagttatg | 119580 |
| ttgcacatga | tgcatacagg | gtagatgaaa | aaggtatcat | gtatgctatg | gtagttggta | 119640 |
| ttgtagttat | aaatgtaatt | ggtttagaaa | tgataattgt | agaatgttta | tagaggagat | 119700 |
| gatttaatat | gattgatatt | tatttacaca | gtgaatatga | taaagataag | ttaaaattta | 119760 |
| tccttaaagc | aataagggat | ttttctccta | gagaattaac | ctacgatttt | aggaatccaa | 119820 |
| aagcggatgt | tagtatccag | gaactactag | gagatgacat | agacatattt | gaatctatag | 119880 |
| cattagatta | ccctaatgat | attaatatcc | ttgtaggaga | tagtggatac | tcgatagttt | 119940 |
| atcagaatga | ttttcttaca | attagtggat | tgagtacggc | tatgaaggag | gtaataggat | 120000 |
| gataggattc | acaatattaa | gtacaataat | ggttatctta | gttatagcta | tgtacactca | 120060 |
| ggtgttagta | gatatgattc | agtcaatcag | gtatgataga | tttgataagg | tacttaacat | 120120 |
| agtaacgttt | atagttatga | cagttgtact | agtatcaggt | attttaatta | tgtttgacat | 120180 |
| ttagagctta | tttaagaagc | ggttaagtag | ttaaggataa | attggtctag | aaatatacta | 120240 |
| ccgcttctct | atggctcttt | aaataggctt | agaattgaaa | ggagatggaa | taatgaaagc | 120300 |
| aattgtatat | tgtgctaaaa | gatatagtaa | gcatacactg | aagcatattt | tagaggaatt | 120360 |
| agaagcggag | aatagtgact | taacatttag | tacagaaata | tcagatttag | gggaagtaga | 120420 |

FIG. 19MMM sequence.txt

| | | | | | | |
|---|---|---|---|---|---|---|
| tattgttgta | caacatacta | aattaccttt | ctcagaacta | atggatttgt | gtagtaaagt | 120480 |
| aagtaaaggg | tctgaccgct | tctatgtatt | tgttggtaat | cactcagggt | attatataaa | 120540 |
| cggtgattta | tatatcaacg | agataggtaa | gtttattaca | tctagagaaa | ctaatgttat | 120600 |
| gatgtagagg | aggagatatt | atgatagaaa | ttagattagt | tgaaggctat | gataaaagtc | 120660 |
| agttgaagtt | tatgttaaag | aaaattaaga | gagtagcacc | tagggaatta | acttatgata | 120720 |
| tagaagcggg | gatagattcg | gtagatgtta | atattgaaga | tgtacttcct | cataaatcac | 120780 |
| cccaggagta | tgaaagatat | tcaatgttac | ttgaagaaga | cttatggata | gttatacttg | 120840 |
| agtcaggtta | tatagcttac | tgggatggaa | agaagtatgg | tggtgaagct | ttagatgata | 120900 |
| ttatatataa | tatgtttaaa | gggagaggga | gactataatg | atagaagtat | ttttaagtaa | 120960 |
| agattatgat | aaggatttac | tcaaagctta | tttagagtat | attagaaagt | ccgcttcaag | 121020 |
| agagttaaag | tataatacta | accatactaa | aggaacggat | gttaatattg | aaaatattat | 121080 |
| tagttatact | aatcaagagg | ttcatcattt | tagctcttac | ggtatgtata | gagatgactt | 121140 |
| atgtgtattc | atagataata | caagagtatc | tgagtatctt | aatggtgaac | ctgtaggggt | 121200 |
| agatacaata | tataaatata | taaaggagat | gtaatggatg | tttaaagtat | attatacagt | 121260 |
| ttatcataga | caaagtatga | agactattaa | ggataagtta | gatagaagcg | gtttaatcta | 121320 |
| tttcttatat | gaaacttggt | ataaagatat | aaataatgta | tgtccttcta | actataaccc | 121380 |
| ggaatttggt | agtcttaata | aagatataga | catagataga | ttaattgaag | cggttaatga | 121440 |
| agaagggata | ctacttatta | accatggtaa | ttatgttaca | gtagaagagt | ggtaggatgt | 121500 |
| tgacaaatca | taagtagtgt | ggtatgatta | aggtagaaat | tttacgataa | actcgtagga | 121560 |
| taaaaccgta | ggataaaaaa | ggaggataga | atatgataga | tattgagata | aaaatttggg | 121620 |
| atgaaaccct | taggatgcag | gttgaagaag | aggatgtact | ttccttctta | tctaagttta | 121680 |
| aaaataaaac | aacaggtgat | aaagaagaat | cttatggagt | agggttagat | gaatctaaat | 121740 |
| ggaaagtaca | cccattctat | acacgttatg | aggtacaccc | tgaaggatac | gttaggttga | 121800 |
| aggatactaa | aacacctgta | atatttacta | agtatagaaa | agaacttcac | cataaaccac | 121860 |
| agtttattag | ctctaatata | atggatgatg | aaggtaagca | tacagtagct | ctacataagt | 121920 |
| tagttgctga | tacatttata | cctattccat | ggtatttaca | gggatataac | tatacagatt | 121980 |
| tatcagtagg | cttgaaggat | ggagattatg | aaaataaaga | agcggttaaa | gcatataact | 122040 |
| tagcttggta | tgtaggaagg | atacgaggta | atgctccaat | gattaaactt | atggacttag | 122100 |
| aagatgatag | agtattatac | tttgctagta | ttcctcaaat | agagaacttt | attagagata | 122160 |
| ataaattaga | ccctaaacgt | tttaattaca | aaactgaata | aatgataagt | agagagggct | 122220 |
| taagtagtcc | tcttttattt | aggttagaat | aattagtaag | tagctcctcg | taatactaag | 122280 |
| tagttcctga | ttttttgata | tagttgtaag | tagtcccctg | gtaatccccc | cagtttatcc | 122340 |

FIG. 19NNN sequence.txt

| | | | | | |
|---|---|---|---|---|---|
| caaccgcttc | aagcagaccg | caataagaat | ccccaggaat | tatattccca | gggatttcta | 122400
| taatttttt | atttaattaa | gatatgtttc | aatatattct | tcataaattg | cacttgctaa | 122460
| atcattgtac | ccgtctttt | gttttcctc | cattaaccaa | ttgtaatcta | cacttaaact | 122520
| gaataaataa | tcttttctt | ttacatcaat | taaatttctt | aattcattct | caaagatatt | 122580
| aacttgatac | acatagttta | cttttttaa | taggttgtgc | acctctttat | tcaattcttc | 122640
| tttagttccc | tcaaatttaa | attccattgt | tatcaatcct | tttcatttag | ttgttaaggt | 122700
| gtttgattac | cttacaaata | ctattatatc | agattgagga | taaattgcaa | taggtttttg | 122760
| aaactttttt | aaattctttt | tgtgttgact | tgatcgacct | ataacaacta | tttagtaggc | 122820
| ttttttgaat | atgttttttc | tgtttcttcc | attataaaca | aaaaataggc | tcataaaact | 122880
| ttttaaaaga | atttgtaaat | atgtattgac | ttattaatca | tatgatagta | atataaaggt | 122940
| acagcaaggg | aacagcaaca | agatattaga | attatataaa | aaaattattt | aattggagat | 123000
| gatttaaatg | gatgtaaaag | aaattgcaaa | tactataatg | gagttgtggc | aaatggacgg | 123060
| ctacagatgt | acagaaccac | cattatatga | aagcacatta | aaccatacac | gcacatatac | 123120
| ggctttaatc | gtaagcatta | aaggaaacta | tgacactgtt | caaatgttcc | gcaaaacgcc | 123180
| tataatgagc | atgagagggc | aagcccaacc | ggctagtatg | ttagtaaatg | taattgatga | 123240
| tgtgattata | atcgtatatg | aaaatgttgt | ttacggggta | cagaataaag | aaataaaatt | 123300
| tattgaagaa | atttaaaaat | aggggttgca | ataccccta | agatgtagta | atataataga | 123360
| tgtaagggat | agcaacacac | cttaaaaaac | tttttaaaaa | gttaaaaaaa | gtgttgacac | 123420
| cttacaagat | acatgttatt | attagtatag | aagttaagac | aagccacata | gcaaataacg | 123480
| aaattaaata | aaaaaattat | agaataggat | ttgattatta | tgacaaacaa | aaattactta | 123540
| tatgaagaag | ctcacacagt | acagggaac | gaaattacgg | ctttcagaat | tccaaatgac | 123600
| gcaaacggca | acccacgtta | tgtagtgcat | ttcatggatt | taaatattaa | actagcagac | 123660
| tatgacaaca | tcaataaact | ttacggattt | aataaatatc | gtgctaaatg | gtttggcggt | 123720
| ggtgtagtat | tccaaagcta | taatatagaa | gatacattaa | attttgcact | agataaagtt | 123780
| aaagaaatag | aagcggttaa | gaattaaaac | cgcttctgaa | ttaaataaaa | aatttatata | 123840
| aaaggatat | gataatatga | aatttaaaat | agaaaaaaat | aacagtgata | taaaaacttt | 123900
| atggaattta | gctaaaaatg | gatatatgag | ttatcaaact | gtacacaata | tatttaaaaa | 123960
| tgaatcagat | gaatttatta | tatttaacag | taaacaaact | tataataaat | ttatggaatt | 124020
| aagatataat | agaagtgcaa | tccaatagta | taaaaaaatt | atacaattcc | ctgggattaa | 124080
| attcctaggg | attttatt | gttttaattt | atataaaaaa | attatttaat | aaataagtta | 124140
| gtgtaaaatt | gactattgac | aaggttgtat | tttttatggt | ataatgaagt | gaagaccttt | 124200

FIG. 19000 sequence.txt

| | | | | | |
|---|---|---|---|---|---|
| tttagtataa | aaaaattatt | atataaaaaa | tttatattaa | atggttttaa | agcgggtctt | 124260 |
| tctcccaacc | ttgtcattta | tatagcggaa | gggttaggct | ggttaccgct | gttttacttt | 124320 |
| ctatatatag | aatactatga | ataatggtaa | ttgtcaacac | ctttcagaaa | cttttttttac | 124380 |
| tttcttttat | tattatataa | aaaaattata | catatttag | ggctccactt | ccattatata | 124440 |
| ataattcggt | attaatgtca | atagataaat | gtaaaaagt | tttttaaatt | aatttcatta | 124500 |
| aatccattga | cttgtgtttc | tttctatagt | aatatatagg | tataccaaca | agggaggcaa | 124560 |
| tacaaatgct | aaaattcaaa | tggaaaaaca | aaacaattaa | atcaactcaa | aaaacggata | 124620 |
| acattctatt | acttattata | ggtggtttag | ttgcaacaat | cacacctaaa | cttgtaaact | 124680 |
| ggtttttact | actacaagat | aatataaata | tttttttaag | ataactattg | acaacctaga | 124740 |
| aacaacatgt | taatattaag | ataacaaata | aatcaataaa | ggaaatgata | aaaatgaaaa | 124800 |
| aaatcacaac | aactttaaac | ttaatcggca | tgaaaaataa | tgaaaggttt | acagaagagt | 124860 |
| taaaaaacta | ccgtcaagat | gttactttct | tgaaagcaaa | taaaattgta | aaatattcaa | 124920 |
| aataaggctt | gacaacttaa | acactacatg | ttattattaa | ggtacaaggt | aagggaagcg | 124980 |
| gtcaaccgct | tccaacctaa | ataaaaaagt | ttaaaaaaac | tattgacagt | cacttgaaac | 125040 |
| catgatatta | ttaagataac | aaaaaacaaa | cagaaaagga | attgattata | atgaaattta | 125100 |
| tcaaaactat | cgaaaactta | ttaactaaag | cagaaaacaa | agggcaagca | attttaaacg | 125160 |
| gtcgttatta | tgacggatat | agaaacggtg | agcttgaaga | aaaatacgca | atcgaaattg | 125220 |
| agggaaacaa | attagttatg | cgtcactggg | gaacacaaac | aattgagatt | gacttaggta | 125280 |
| tgaaagaaat | tgtttcatac | tatggagaaa | gcaactcaga | ccgtgacagt | ttaaacacac | 125340 |
| ttgtatattg | cttaggaatt | gcgccaaact | ttagatactt | accaagcaaa | gacttattta | 125400 |
| tttacgaaaa | ttaattaaat | aaagggcttg | acttccaagc | cctaccatgt | tattattaaa | 125460 |
| ttgtaaggta | atcaagcaca | acgacaaaat | aaactgaaaa | ggaattgatg | aaaatgttca | 125520 |
| aattacaaaa | taaagtggaa | attatcgtac | ctaaatatac | taatagtggt | aaagagattt | 125580 |
| caagccctgc | aattaaagaa | gcggttaaca | atgcaactaa | aatatgtgga | ggttgtacga | 125640 |
| taactgaaat | caagggacaa | tggtggtcag | acgatgaaca | acgtattatg | gaagatgaca | 125700 |
| acttaaatct | tgagtggtac | tatgacaaag | gtatgcaaga | catgaacgac | caacaagggt | 125760 |
| tattacaagc | cttatcaaag | attgctagac | aattgattgt | attctatgaa | caagaggcaa | 125820 |
| tcagtataaa | aattaatggt | acactatata | ttatagatta | tgaagattta | gatttattat | 125880 |
| cttatgactt | atatgaatta | atgtttaaaa | attaaataaa | aatttatat | aaaccgcttc | 125940 |
| ggattaaatt | cttgaagcgg | ttttttatgt | aaaatttatg | cttgacaaat | gtattaaaaa | 126000 |
| atgagataat | agagtgacaa | cttttttttag | tataaaaata | atattatata | aaaaagttat | 126060 |
| agagttttta | aggctccaag | tccattatat | caatttact | actggttgtc | aatactttct | 126120 |

FIG. 19PPP sequence.txt

| | | | | | |
|---|---|---|---|---|---|
| tttttatat | aataatttaa | ttatcttaaa | gataccgtcc | acctccatta | tctcaaattt | 126180 |
| tgcccccaaa | gtcaagaact | ttctttcaaa | taatttattt | aaaaaagttt | ataaaaaggg | 126240 |
| ttgacttatt | ttgtactata | gtgtaatata | taaagtgtag | taaggaagcg | gaggaaataa | 126300 |
| cctaaaaaaa | gaatttaaaa | aactttaaa | aaggtgttga | caaacttcca | aatacatgat | 126360 |
| aatattaaga | tagttagaaa | aacaaaaaac | gaaaaggaat | tgataattat | gaacagatta | 126420 |
| gaaatagtaa | aagatacggc | aatggaatat | atccttatga | tggataacag | tgttatggac | 126480 |
| ggcgttatga | cacaagagga | atacaacgaa | gcggttagct | ttgaaaaggt | gtatgactat | 126540 |
| actctatcag | aagcaaatca | agaatgtaaa | ttcttaggtg | gtaaggtttt | aactttccta | 126600 |
| gtacatgaag | caatcgaaga | atacgcataa | aaaaacttaa | taaagggggt | tgaatgtcaa | 126660 |
| cccctaccat | gttaatatta | atatatacca | aatgagagga | attgataatt | atgagatacg | 126720 |
| aaatcgtaac | attagttaat | ggagaattat | tcatgtttgc | aacatttaag | aaagcagagg | 126780 |
| cagaaaataa | atatcaagaa | tggtgtgact | tgtacggtca | agaaaatgtg | agcatggaaa | 126840 |
| aaaattaaaa | taagcggttg | acaaactaac | cgcttcatgg | taatattaaa | ctatactaaa | 126900 |
| gaaaaggaaa | tgattacaat | gacaaaaaca | atcaaacaat | tagaaagcca | acttgaaaga | 126960 |
| ctagaaagaa | aatcagatga | gcaactagca | aacggatatt | atgaagcctt | tgaaagaact | 127020 |
| tgcgcacaaa | ttagagaatt | agacctacaa | atcgaattaa | aaaagaattc | agaaactgtt | 127080 |
| taaaaaaatt | aaataagggg | ttgacactta | acccctttaga | tgttattatt | aatacataag | 127140 |
| gtaaaacaaa | taaaggagga | aaacaaaatg | atgatttgga | tattgatttt | tatggtaatc | 127200 |
| cctttttgtac | ttggattcat | taacggttgg | aactcagaag | aagaaaatta | aaaaaagtgt | 127260 |
| tgacacttta | aaaaatacat | gttaatataa | atatatacta | aagaaaagga | attgataaaa | 127320 |
| atgaaattat | taaacagaga | caatgaaatc | gtaattagca | tagcaacatt | agagagcgta | 127380 |
| aaacaagcct | taatttggga | atacatcgac | cacatagata | ataacatcct | agacagtgaa | 127440 |
| atctatgacc | aagaagcggt | tgtcgttact | tctaagactc | tacaatcaat | aaaatttgca | 127500 |
| gacactatgg | aagacctgca | ggaatacatt | gcagatatca | attggaaatt | agtttaaaaa | 127560 |
| agttttaaat | aactgttgac | accttagcaa | atagatggta | atataagagt | ataagaaaaa | 127620 |
| acaaaaaaac | gaaaaggatt | tgattataat | gacaaacaca | ataaaaggat | ttttacaaac | 127680 |
| agaagaagca | agcacagtta | aggacgtagc | aactcacgga | gtacaaagcg | gagcaattgg | 127740 |
| cagattaatc | tatacatcgg | acgtagtaaa | attctttgat | agacattatt | cagatattga | 127800 |
| agcggtagta | ttagacttct | tagaaggctt | tacaggtcaa | agatactatg | acctattaga | 127860 |
| ttatgacttg | atgagagaac | tcgaagagca | tgcaaatgta | gagtttgaag | acgaagacga | 127920 |
| atataataat | attcaatttg | acttagcaga | aaatattgct | tctgatgaga | ttgaaggatt | 127980 |

FIG. 19QQQ sequence.txt

| | | | | | | |
|---|---|---|---|---|---|---|
| cgaagacatg | gacgaagccg | agcaggcgga | tgcagttatc | gaagctatgg | acgatgtaga | 128040 |
| attagagata | ctagacacgg | ataaggtgca | gtttgttaac | ttagcagttg | agattgtagc | 128100 |
| acaacaaatg | caagaagcat | aagaccctgc | aggaagcaca | cagagacaca | cagagaagct | 128160 |
| taaccgcttc | tctaatataa | aactattagg | agatgttgaa | catgacaatt | aaagagatta | 128220 |
| taaaccaatt | acaagcagta | gaaaataagg | aacttgaact | attcgtatgt | gacaaggaag | 128280 |
| gaaataacat | ttcaattaaa | gatattactt | tgtttgatag | tgaagcggag | cacacagaaa | 128340 |
| acaacccatt | agggattaac | tattaggagg | tttataattg | aacattagag | aggttcataa | 128400 |
| tgtcgttaag | agtgcaaaga | gcaaactcct | acaggagcag | aataatatta | ataatgtaat | 128460 |
| gatagatgac | tacatcacag | aagagcttca | cagacgcaca | cagagaagcg | gaacaataca | 128520 |
| gatgaacaat | aacaccgctt | catatagtaa | tggctcatat | ggtagcttag | aagagattag | 128580 |
| agaagcttat | gacctatctt | cattatctac | taatgagatt | aaagaactgc | ttgaaacatt | 128640 |
| tgtttaaatt | attttatcaa | aacgctttac | aactatttaa | tttgtatgat | ataatgaact | 128700 |
| taacaaatta | aaagaaaagg | aaatgatgaa | catgagagac | ttacaagaaa | gaaaaagaga | 128760 |
| attgaaaaca | ttactattta | acttagctat | agagaagaac | agagcaactg | acgagacact | 128820 |
| aagaagtgta | ttagaagaag | cccatcaaga | ggtaggaaac | caactaagaa | aagtaagaaa | 128880 |
| agaaattgaa | attttagttg | aagaaaaaga | aagagaattt | tggaacgatt | tcgactttaa | 128940 |
| tggattagac | taagagggaa | taaaatccct | cttttatttt | tatcctatta | tataatttt | 129000 |
| ttatattata | cggggggcagg | ggtaaaatgc | cactcaatgg | gggtgggtct | atataccect | 129060 |
| atggtctacc | caggtactta | ttttttgggg | aaaattatga | aaataaatat | tctaaaagtc | 129120 |
| aacacccccc | tattataagt | caacattaca | accctaccct | ataagtcaac | aatttataat | 129180 |
| ataaatagat | agcccttaaa | tataaagtca | acatatctaa | aataaaaaag | ccaccccttt | 129240 |
| aggagtgact | tagtgtttta | atattttatt | tcttctccta | aaatgagttt | gttttgataa | 129300 |
| ctacctaatc | ttgtatatat | cttactatta | gggtctgatg | aatttatact | atttgtgcta | 129360 |
| ccataagcta | tacaactatc | taaccacata | tgactacctg | atgaagtttg | gaaatctttg | 129420 |
| ccttggtaac | tttcgaaagc | ggtacatcct | aaattccaag | attctgtacc | ttcatttaca | 129480 |
| tctgcgacat | taccgccatc | atttctagca | taaataccgt | ttactcgtat | agctttaaga | 129540 |
| ccatcatgag | ttgtggaacc | attatttgat | ttagtacctg | ctgttccttt | ttcgaatcca | 129600 |
| ttttctaaag | ctgtacaatt | aatttcaata | actaaaggtt | tagagctatc | tgcacctata | 129660 |
| tgataattaa | atccatccat | atagttatta | ttagctacac | tattattgac | gataacttct | 129720 |
| ttacctccaa | caatttctaa | accattacca | ttgacttggg | aagcatagct | cagtacacag | 129780 |
| ttattaatat | atacgctatt | gtcttggttt | aattcaaacc | tagcaggtct | agctccaccg | 129840 |
| tacagattta | aattttcaat | ataaaagtca | gttggtacac | tagatactat | taggtgttgg | 129900 |

FIG. 19RRR sequence.txt

```
gatgataata gcggtacaac ttttttgtta ggttctatgg aaccgttatt aacataaact    129960
tttgtaccat cagagtacca agaaaaaagt gtcgtatcta ctttatctaa ggaggtaaca    130020
tttgtaaact ccctatcatt attaaaatct actacccttc taacggcgga acgtgtaaat    130080
tcataagtgc tatctctacc tgatgtttta gtccaagttg gctcatctgc cataaataag    130140
tttacatttg agcccaaacc aataatatta atactcttat tacttattgg tggaagcaat    130200
gtgcctccta ctctaaagta atccccgtca ctaacataaa gtgtatcccc attatttatt    130260
atgccttgag cttttttaaa tgttttaaag ggggttgatt gagaaagacc gtcattagta    130320
tcattaccat tttctccatc aacatagtaa gatttacctc ccctaagttt aaagttctcc    130380
atatttaaag aagtggaaaa cttacctaaa ccatctgtaa aaatattatt gacaagcggg    130440
tggtctttaa ttaagtaatc tacaggagtg aaaacaggta ttttatacga tgtttctttt    130500
ttcatagaaa ttttcatatt atcaatttct ttgattaatc ctttaatgaa ttcctcatta    130560
ttaactgttt gtattttctt agtagaagaa ccatcaaaaa gtagaaactg ttttatattt    130620
acaggtgaag taacttgtct tgtatctatt cttaaactaa ttttgcttga attttccggg    130680
atatttatat tattaattgc aaatgtcgtg tcattatttt tattaagttg agtaattgtt    130740
tgtatatatg aaccatcaga atcttgtatt gaatactcaa atgatgcttt cgggtcaggt    130800
acgtcatctg ttattatttt agcactaaat gttttacctg gtgcaagttt ttcaacagct    130860
ttaactgtgt aaaataacca accatttgaa ttaagtgtaa agaaccatc ggggttcatg    130920
gtatttccg gtatactgtt tctaattgta atattagaga aatatgtttt atctactgtt    130980
gatgggtata aacgaatgtc ttctccatta tcagggtaca ctattaaact atcttccatt    131040
gttttattta cttcttgtaa attagagtca ctaggattaa caaaaactct caatgaatct    131100
aattgttctt cggtaaatct atcaaaagta aagtcttac ctggttcccc tgttttacct    131160
ggctctcctg gttttcctgg ctctcctggt tttcctggct ctcctggttc acctttaatg    131220
gacttaaccc attcttcttc tgtacctgta aaaccattat ctactgctat atcataagct    131280
gttttaggtt taacagttaa gatgtcttta gcataaaaag taatttctttt gtaagaagat    131340
tctaatgtag taaattcagg aactacagtt ttttccgact catagttatc cccttcccaa    131400
gaaacataaa actcccttg agggtactta gtatgaggtt ttaaatttgg tataataact    131460
gaaccttgct cagtatatac attataacct atggctagta tattgccttc tttatcataa    131520
gcttttaaat gtggcattta taaatctcct attctaatgt gttagtacat ataatatatc    131580
aaattgaata aaagaagagt attagttacc cttctttatg tttatatcgc agtctacgat    131640
attaagttca tgaatagtaa tcatatccat tccatcgaat cctcttgggt ctcctttaat    131700
gaactcttgt tctcctctat aattagtctc ttccctatac ccttcttctt taatacgttt    131760
```

FIG. 19SSS sequence.txt

| | | | | | |
|---|---|---|---|---|---|
| aattaatttt | tccttatttg | tatatacatt | gtcttctcta | aaatgaaaat | tatcttcata | 131820 |
| aggttcacaa | ttatcatgtt | ctacttgata | tagtttcatt | catttgtcct | cctttactct | 131880 |
| ctataataat | catatatttc | taagtaaggt | gaaaatggtg | aatcacctct | agtattaata | 131940 |
| ataacttcac | cttcatgttt | acttatctct | gtaagctctt | ctagactatt | aatttctaca | 132000 |
| caccatcgtt | ctagtgtaaa | tggattacct | ttttggtcta | caagttctag | tttctttata | 132060 |
| taggcaccct | ctataggctt | tttattaatg | gtgcttgtcc | tatctataaa | aaattccatt | 132120 |
| agttttcctc | cttttcataa | gaccattcac | catattctgc | gttaaaatgg | gctgtatccg | 132180 |
| taccctcgtc | ttcatattct | acactatacc | atgcatcctc | ttctgtttct | gcatctatat | 132240 |
| atcttacttc | ctctgtagta | ataatacgtt | ttactttaaa | tctctccata | ttagtttttcc | 132300 |
| tccttatatt | ctttataact | tttaataaca | atcttacaga | tacctctatt | aacagctaaa | 132360 |
| aacaataaaa | atgataacag | agttataact | gctctagtat | ctcctgtgaa | aggtaatact | 132420 |
| ttaaatagta | aaacactttc | taaacactt | gtagctgtga | tagttgttag | gtataagata | 132480 |
| gttagtaaat | aatcttttaa | ttttagctta | acaaaaggtt | ttttattatc | ttgagttctt | 132540 |
| actataccat | atagaattat | aaaccattct | acagttacga | gcatagttat | aaagtaatta | 132600 |
| tttatgtcta | atgcatataa | accataaatg | atacctgcag | gaataccaat | aatgaatgct | 132660 |
| aaaaatacag | agagtataat | tagcattata | agaagagcta | caaggaatcc | taagccttgt | 132720 |
| tttgagtact | ctagtgtatt | cttttcctatg | gctttaaaga | atgttttatt | catctgctac | 132780 |
| ctccttgtaa | tatacagtat | ctatatggat | aatattgtct | ttgaaccata | tagatgtatc | 132840 |
| acctttgtta | gattctaaaa | atttaacacc | attaaaaaca | agaccccga | taaaagaatt | 132900 |
| taaattagtt | ttagtatctt | tttgctttat | aatagtagaa | gtccctgata | catcatgaat | 132960 |
| ccttataaaa | ttaatatctt | tttttacttc | ctcttcttta | tgttttttaa | atatcattat | 133020 |
| tcttcctcct | ttatattctc | ttctaatatt | tgttttaacg | tctgacaatc | tttttggtct | 133080 |
| aaagtattcc | aacttttctag | attttgtaat | tgatagtgaa | attcatttac | aatttcatcg | 133140 |
| aaggcttctg | ctttttggta | gacttcttgt | aactcttcta | attcttttttc | attatcaata | 133200 |
| caccagtagt | tctcgttgtc | agttataata | tcttgaattt | tattttata | ttcataagcc | 133260 |
| attatttatc | cctcctcttc | tatagaatta | ctttccgtaa | tagttacctc | tagcatgtta | 133320 |
| ttgtaatact | cattcttttg | attgatattg | tagtagtcat | tatattcatt | aaagtctaca | 133380 |
| taagtgtatt | catttgtatc | atcatcataa | ataatatcta | tagctgtaat | atctgagtat | 133440 |
| gctgtaatca | tttcataagc | atttgtatta | tccggataag | caaaccaac | ttgagatatt | 133500 |
| tctttagggt | tatcaataag | aataccaaaa | taagtacatc | tacgtgttcg | acttatatgt | 133560 |
| gaagtaccat | agtaatctat | accttctgta | attccatcta | catggaacct | ttttacatct | 133620 |
| ttaggttcta | gtcttacaac | atcacaattt | tctaatacta | aatcaatata | ttttatattc | 133680 |

FIG. 19TTT sequence.txt

| | | | | | |
|---|---|---|---|---|---|
| attttaattc | tcctctttat | ttaaacctat | tatatacgca | atggactcta | acatcttcca | 133740 |
| ttactttacc | taatagattc | tgacctttcc | agttgctttc | atctaatatc | ttagggtcat | 133800 |
| ttgctttaat | acctacaccc | catatttat | catagggtga | tgcttctacg | aaatctttac | 133860 |
| gtaaatctgt | atctagtatt | ttttgtttta | agtgtgtagt | cataaattta | tctttaacca | 133920 |
| cttctaccat | aatgtcatat | ctcaccttat | tccattgctc | ttcattaaaa | ttacgaactt | 133980 |
| tacgacctag | acttttagca | tggttcggat | gcttagcatt | taatatttct | cctgctattt | 134040 |
| gccagtcttt | aaaatattga | gctttacgcc | acataaaggc | ttgttctgag | ttattaaatg | 134100 |
| ttcttccttt | gtgtttaaat | gttattgggt | aaaagttaga | atagatatct | tccttacccc | 134160 |
| aaaacataat | gtattcttta | gtctctttca | tattatctct | cctttaattc | cataatgatg | 134220 |
| gtaatacgat | tttaaagtta | tctagaattt | tgttttgtac | ctgttcaatc | tcgtcctcat | 134280 |
| tatcaacatc | aaagctatcc | attgattcgt | ggtagaattg | aattaaactt | aatatatgct | 134340 |
| ttatcatatc | tatctgtgtt | cttctttc | cttctatatc | agtaaatgta | tggtactcca | 134400 |
| tatccacatg | attactactt | tctacaaaag | catttaaatc | agcatatagt | tgaataaaga | 134460 |
| aggacatatc | atagttccaa | tatttaggtt | catttctacc | taattcttta | ttcattttt | 134520 |
| tgtatttttt | attcttttt | aatccaaaaa | cttctttttc | aaagtcattt | aatttaagtc | 134580 |
| ctttaaaata | tcttttcttc | atgagtttcc | ctccaattta | ataaaaggta | aatctatatc | 134640 |
| cctgaataca | gcacctacat | cacacattaa | catgtctcca | ttaatttcta | cttctccact | 134700 |
| gtcagttggt | gtatgaccac | atacataggt | aaaaccatct | tttctaggtt | gaaagtctct | 134760 |
| tgaccatatt | aattggtcaa | ttgtttgttc | ttctacaggc | ttccaactaa | ccccgcctga | 134820 |
| atgagagaat | atatacttgt | cttctttata | gtactttcta | caattaacca | taagtatttt | 134880 |
| aaattttcta | tagtcgtctg | attctttaag | tttctttagt | tcacttttaa | taaaatcata | 134940 |
| attacttctt | aggttttctt | ctacactact | atactttaaa | gttaccgtac | tcacaccgta | 135000 |
| agagttaagt | gtttctatac | aatatcttga | gagccattca | atatcataga | tacttaatcg | 135060 |
| gtctacgttt | tccataacat | tataaaactc | atcatcatgg | ttccctaaca | gagttactac | 135120 |
| attatcatca | ttagacatta | aatcaaatat | atagttaaca | acgtcttttg | accttttacc | 135180 |
| tctatctaca | taatcccta | aaaatactat | tgtttcttta | ggttttcttt | cattgtttat | 135240 |
| tttatccata | attgttaata | attttggta | ttctccatga | atatcgggaa | caacgtatat | 135300 |
| agccatctaa | tctcctcctt | attgtatata | actatcttac | catacttagt | aaaaaaagtc | 135360 |
| aataaaaaaa | cacctattaa | tttaataggt | gtttatcatt | taatgttatt | ttaaagtatc | 135420 |
| attaccatgt | gctaatttt | tatcatctat | tgcatggtca | ttataaatat | atttaacctc | 135480 |
| tatatactgg | tcttcacttt | tcagtgcatc | tactatagaa | gcattattag | ttattgagct | 135540 |

FIG. 19UUU sequence.txt

```
tgttctaggg taagtaaatt tttgaccgtc agataaaata atagtaacat caacttcaaa   135600
gttaacaggt agtctgtatc cataatcttc caaataatta ataaagttat taagagaaaa   135660
tggtttatac ttgccatcta aggtatagtc aatatattca tttaatgcat cagtaagttc   135720
tgattctgtt aactccattg tatcataatc tttttcgtta tagaatacta caacattatg   135780
ttgttctata ctagaatctc cgtctttata cttagatata aaaaatccaa tatttccttt   135840
atgctctaaa taatctgctt tcataatttt aaatacttct tctgctatag gttttgctaa   135900
tagtgttacc cattcacctt tttctgcgtc ataaacacta ggtagtacgt ttaccatcat   135960
ttaaatctcc tcttcttaat ttattggttt aaaccacaat ttactcttat cacttggttc   136020
tgtttcacta actacgaaag agttagaatc aatgtttaaa gtattaaaaa caatttcttg   136080
tttgtcttca ttactttttg ttgtaaattc gggaacatct gttaatatag actctttacc   136140
attaatagtc catgatattt taaaagaccc ttggctatac actgtattcg gtgtcagttt   136200
ttcaattata attttagcgg atgcacctgt aattttttct gaagatttta ataatttacc   136260
tttggaatca tataagttta atgttctctc cacaaatttt atctccttta ctatattttg   136320
tacaattaat ataacaaaaa aacacctatt agtttaaata ggtgtccgac agagctcccg   136380
tactagatt acggttaata atattttacg caactatat gagaccctct gtcgttgaaa    136440
ctcttgtcac tgcgttattc cacaagatat tttagaaggt agcttgtgga agaagattgt   136500
ttttaaaggt acaattagcg tttttaagcc tattcgatac ccaggacact atgtccgtac   136560
taactattac gtcaataaag gttctacggt ctcaattacc tactctttat tgttaaaact   136620
aaaattaagc ttgagtgctc tagaagccaa aatcaattaa ttaactatag atacggaatg   136680
gagggacact accatccgga gtctacggtc agatacaaag cctctgccgg gcaacatacg   136740
gtatctctcg tacatcaggt tgactagacc tttagagttt ttcactcctt ctcttataac   136800
cagtaactta ggagaaatag gttttactta gtagatatga aacaataaat ccacatacaa   136860
tattaaatca tagtcaagtg attgcacata tgtctaatac ctataagttt tttgctagcc   136920
tggtatatgg actctgcagg attcgaacct acagtcaaac cgttatgagc ggttggcttt   136980
acctttaagc taagagtcct agaaatatcc tgagagagga ctcgaacctc aacgactagg   137040
tagctacatc tagccaatgc cattactcag gattgctagt aacgctaaat agaattataa   137100
cgttaccgta gaccttttct acgcttggta gataggtaaa atataatgat ttcaaagtac   137160
ccatatagtt aggctcttat tctcattata aggttaaaaa ggctaactgt gtttagcatt   137220
atataagagg ctttagttaa ctactatact aatagtatac cataaataat acttaatgtc   137280
aagttaattt atcaattgaa tccataattt ttgatgtact tcttatatcc gcttctttac   137340
tgtgtttaag aagatatttt                                               137360
```

FIG. 20A sequence.txt

<210> 781
<211> 166679
<212> DNA
<213> Unknown

<220>
<223> Description of Unknown: Bacteriophage F387/08

<400> 781

| | | | | | |
|---|---|---|---|---|---|
| cgttagcacc | tttataaccg | atggtgaagt | aatcctgacg | agcatactgg | tcgatgtata | 60 |
| cacggtagcg | accacccaga | acaccagcaa | atactgcttt | agtggtgtcg | gtattataac | 120 |
| cacgacccag | accctgagct | gccggagata | cgttggtatc | aacagctgcc | agtacgttaa | 180 |
| ctacgttacg | ggaagcgata | atgaagttac | cttcaccgcg | accggtctga | cgagcgattt | 240 |
| cagcggattc | tttgtcaatc | tggaacagca | gagctttaaa | gctttcacct | gcccaacgag | 300 |
| caccgcggat | atcaatcggg | tcttggaagt | cgaatacacc | agctttagaa | ccaacagtct | 360 |
| gggtcatacc | agatttacca | acctgagcgg | agtagttaat | ccagtcaaca | acttcacggt | 420 |
| tgatttccag | cataatttcg | gtagccagga | ttgaactcaa | ttcagcatca | gcgtccatac | 480 |
| cgtgaacagc | acggaggtcc | tgagccagtt | cgatggaata | ctgtgctttc | agctgacgag | 540 |
| atttcgcttc | gatagtttgt | ttatcgatac | ggaagcccat | ttcattccac | gggttatctt | 600 |
| tagaaccgtt | aaatgcttct | tgcagttcag | caacggaagt | agccatacct | tcggcgattt | 660 |
| ctacaacttt | accagcttcc | agagcagcag | taactgcagc | gtccagttta | gcagcatcgg | 720 |
| tagcaccagc | gtctacagtg | aaatcttcaa | caacctgcag | atgagcacga | ccggtctgtg | 780 |
| cgaaatcgtg | aacaacgata | tcaccaacag | tcagagcagc | accagcttta | actgcttcaa | 840 |
| acttctcggt | tgcaccctga | ccagagaaca | ttgcatccgg | agcgtacatc | ggatggaaag | 900 |
| cttctttagc | accagcagcc | agagggtctt | tgccgtaaac | agcgcggaga | gcgaatacct | 960 |
| gaccggttgg | gttagacatc | ggctgtacac | cacagatatc | gaaagcaatc | aggttaggga | 1020 |

FIG. 20B sequence.txt

| | | | | | |
|---|---|---|---|---|---|
| tagcacgacg | aaccataccc | ataactgccg | ggccaatctg | ggttacagca | ccagaggtct | 1080 |
| gaccagctgc | gatgttctgt | gcatcataac | cgtggtcacc | gccaatttct | gcttcagaca | 1140 |
| ggaaagaacc | aaatgcttca | gcgattttt | catcgcggta | ttctggagcc | tgattaatat | 1200 |
| cagcttcctg | gttttcaaaa | atcttagcga | tcagagcttt | tttgctagcg | ccaacaattt | 1260 |
| ccggcagagc | ttcgttctca | agcagcggct | gccattttc | gataagttta | ttcttttca | 1320 |
| tgtgttgtat | aaccttttaa | attaagaaag | acgagccgct | tgggccacat | aagcatccat | 1380 |
| aacggatggg | gttttagtcg | caggagtttc | ttctactgct | tcagttgtga | agtttaaacc | 1440 |
| gtctgcttct | ttgtcgatag | tatttatatc | ggcagattcc | gttacagact | gctctacaga | 1500 |
| accctgcacc | atttcaacaa | tagctttcag | cttagttgaa | aatgcgtcag | aataatccat | 1560 |
| gccctctgtc | agagaaacta | cttctctttt | ttgggtatca | gtcagttcac | gggttgcttc | 1620 |
| ttggatagca | tactcacgtt | gggcataatt | gatatactca | tcgcgcttag | aaacttcttc | 1680 |
| aaataaacga | gcagtttctg | cttttgctc | agcaagttct | tcttccatct | cagctactac | 1740 |
| gtctactgat | tcttcaggaa | ttacaacgtt | gtgctcaaca | aacagctctt | tcataccgac | 1800 |
| aaacatggat | tcaaacaggt | cagctttaat | accgcggtca | accgccagct | ggttttctgc | 1860 |
| catccattct | gcagcgatat | ggtcaaagta | tttagaagca | gcttctttca | gctcttcgcg | 1920 |
| agcttcttct | ttagcttttt | ctttttcttc | ttctactttt | tcttctgctt | tctcagcaat | 1980 |
| cttttcaatg | tgagattctg | ccagagctac | ggcgtgtttt | ttgactgttg | cttcgaatac | 2040 |
| agtgctgaag | ttagctttag | cttccggaga | aagctgaact | gattcgaaaa | tactgtcaag | 2100 |
| agcgacggaa | gcatcgatag | ttttagcttc | ggtcattaaa | agttctttaa | gcattttga | 2160 |
| tgtcctgtgt | taagttacat | aattatttat | aacgcttta | acttctctgc | gagagccata | 2220 |
| aaagcatcat | cagcactatt | ggcaacttgt | gccgaggtat | tttccgaaat | ttgtttcggt | 2280 |
| tgtacccatg | catccggagc | actaggaccc | caaactgcgt | ctacaccaac | agtcaggcga | 2340 |
| aagccttctt | gtacgatgtt | atatccttt | cctgagtctt | ttaaagaacc | gagcccgcgg | 2400 |
| cttgatacac | caggaatcca | accagcacgg | atgttagcgg | ctaatttatc | acctggaccg | 2460 |
| tggtctcctt | cgatgattct | tgcacgccca | taaacatcgt | tgcctttcca | ccacatatct | 2520 |
| tcgataatga | ttgcggcttg | catcgggtca | acatttgcgc | gaggtggatg | gtttaattct | 2580 |
| cctagagcct | gacgagtagc | aacctgttcc | ttaatataac | gacttaccgc | agtctcaaga | 2640 |
| atgcgttttg | gataaagacg | tttattacgg | tttactactt | ctgcctgcat | aaaaacacct | 2700 |
| tcaatataca | gaccaggttt | taagccagat | tcattttcgc | cttcaacgat | aatagattct | 2760 |
| agcatgggtt | taccatcaat | tacatcgccc | ggttgacccc | aatgctcaat | taaaagttgt | 2820 |
| tcattgaggt | tttccattaa | cttagcccca | gagcctgacg | gcgtttaagt | gctttcttac | 2880 |

FIG. 20C

```
                                    sequence.txt
gtttacgtaa tccacgagtt tgagccgatg gattagcacg ttttgatttt actgctttac    2940
gcgcgatttg acggcgttta gctttagaaa gtccagttgt ttggaacgcg ttacgctcac    3000
gtgttttacg atccttagta cgtgtaatag tacctttaga atcaacatgt ttaacgataa    3060
attcatttag ttgtagagat tcattgattg aacctaaagc aattgctaaa tcaggctcag    3120
aaacaacaag attctctaca attttattta tatcatcttt agagagcgct gcggacaact    3180
tatcaaaacg cgcctgggct tcaggaagaa gagcttcgac agtgtcgata actaattcat    3240
gattttcagg cagtataagc attactcgtc ctcttcgtcg tcttcgtctt tatcagactt    3300
atcttcgtct tcgtcgtctt catcttcgtc ctcatcgggc tcttcaccct caatcatgac    3360
agacgctgcg ataaattttt tgcgctcttc aattaaacca gatgtccgtt cagccataat    3420
tgcaccaaaa gcttttttgg ctgctacgag gtctctggat tcaattgcgg aaatataatt    3480
ttccattaga aatcctcttc attttcttgg tcttggaagc gagcctcttt agactctaat    3540
tcaatttgct tggcttcttg ttcaatttct tcatctgaca tctgaaggaa gtctttcatt    3600
gctgtcttat gagaaatata cttgccgata aacggttcag ccattgtgag catattgatt    3660
ctacgctcca taacttcagc atctttcaac tcggtgaaat atgaatcttt atggaacaca    3720
atcttaatat tatttatttc gtcttcccac tcatctttag acaaaacttt tttaagaatt    3780
agattagtgc gaagtggatc aagcataatc tcttcgaatt tatgctgtaa tctacgaata    3840
aatttagcaa aatcaagctc atcgcgagta attgctgtgc cagcatcaaa ctgcacaccg    3900
ccttgattat ttgcatccgg catgcgcgaa agaggaactc gcaatgccat gtataacgct    3960
gttctaaagt aacggacgtc atccatatca ctcatacctg acataccagg aagagtatct    4020
acttcagtaa ctgctttacc atctctacgc tgcaaccaat agtcttctgt cattgacata    4080
ttatgttgct gatttttaat cttaccggtt gatgcatcat atacaacgcg attttttcatc   4140
gtgttcataa tatgttgcat atgagctgcc gctttacgag aaggcatatt accagtgtca    4200
atgtaaaaca cacgacggtc aggagcacga gtaatacgat aaattaccaa cgcatcttct    4260
aatagcttta actggttggc gggtttaacg gctcggtgta aataaccgat gatgttttga    4320
cctgaacaat caactagtcc agaatgtgca tatacgatag catcgcgtgg aattttaatt    4380
ttcgttccgg cggaatataa tctgccatct gcataataac tttctttgcc agtatcgtaa    4440
atgaaatact cttttgtaccc cttaacgatt ttagtaccag cgtcatcagc agtaacgatt    4500
tcacggatga attgtaagtt gcgcgggtca agacgtctca gttcctgaat tccgtctttc    4560
attttcttgg tgttgacgat tttatggaag aatattcttg agtcaacata ccaacggcgg    4620
aaatggtcag cgccctttcg ctcgaaatta aggcatgtta aaactgtatt aaactcttca    4680
agaatgcggt cttttaattgc ttgactgaag tcagtagaat ctaaatcaag agaaactact    4740
ggatgaccgt cttcgtatac aactgcgtca gaaactattt cttcaacagc attgtcaact    4800
```

FIG. 20D sequence.txt

| | | | | | |
|---|---|---|---|---|---|
| tcgtagttat | tcattaaact | acgataagtg | ttgattaaat | cagcagttgt | tttcattcca | 4860 |
| ggttcattgg | aaccaaacat | catttggttg | aatgaattgt | actggatttc | gttttcgttt | 4920 |
| gattcaactt | cacgagctcc | atcatcaaat | tttggagcag | tgattgactc | taggtcattg | 4980 |
| ttgatttgtt | gcttatattc | agcttcgtcg | cgttttccc | acggagcgaa | taagtccaaa | 5040 |
| atatgaaagg | ccattggagt | ctccgaaatt | atctataagt | atatttatat | cgaagataaa | 5100 |
| catgctttat | gatatctcat | aattgcacta | cgtgttgact | ccactccgca | tactggacaa | 5160 |
| gtcattcgtg | gctggtttat | cttttttcct | ttgttagggt | gctcttttcc | gaacatagga | 5220 |
| tttctttcac | ccgacattgc | tttagaatgg | tcaggtcgtt | ttcttccgga | taatttaata | 5280 |
| gagtgatctg | gacgttttat | tcctaaccgc | tgatgacgtt | gttttctttt | agactcttca | 5340 |
| ctcattttc | ttcctttagt | tgacatccca | aagaaaccgt | ttggttgtgc | taaagccata | 5400 |
| tttatatacg | aactggattt | aactacgtcg | tattttattt | gcaactcaag | ttcagcttta | 5460 |
| gaagcttcct | ctcgagtttc | atatgtgttt | aatatccggg | ttttgaataa | atgaggatta | 5520 |
| tcatgttgct | cactcttcca | gaggtcttta | tatttcttgg | atttaactga | gccatgataa | 5580 |
| ttttcatcaa | taattcgtga | tacactagta | gaaccgatgt | agcgacgggg | aagtttattc | 5640 |
| cccgtgtata | ttgtcaaata | agtacagaac | attaatacct | ccacttcgtt | gttagaggta | 5700 |
| tttattcagc | attattccca | ccaatcgata | gcaaaggtag | tttcaaacgt | ttctatctca | 5760 |
| ttattcgaat | cccaatccat | ctgtacttca | ccaacgttag | ttggccacag | accagtaatg | 5820 |
| gtgtgttcat | ttgtgatagt | tttgccatca | cgactaaact | ggcgtaccgt | agcaaccttt | 5880 |
| ttgtaatcgg | ctggagtcat | accagagata | tcattgcctt | gagcgtgggc | ctgagcctgc | 5940 |
| caagcaataa | ttgccttacg | tacttcgtgt | ttatcatcgt | tatagatggt | aacagtccag | 6000 |
| tcgtcataag | tacggtcacc | agcgacgtta | atcttacggt | tcatgtaccc | gactggaact | 6060 |
| ttttctacga | tacctgccgg | catcggtgct | gctttacatt | tgaaactgaa | gttacgaccc | 6120 |
| agataaggaa | tttctacctc | aaacaggtta | ggacgcgcaa | agtcaccaga | ttcaaacgca | 6180 |
| cgagtgatgt | ctgttaattc | catcgttgtt | tcctatagat | atttatatag | cctctcgatt | 6240 |
| gactacatca | tcgtagaggc | tattaaagtg | tgcggtaata | taatttatca | tctaaagatt | 6300 |
| agatgacccc | agaatgtcct | ggggttcata | ttactgtggt | ccgattaact | catcgaaatc | 6360 |
| tgcaccagtt | gccgtagcaa | cgaagttcag | agtgatatag | ttaattgaac | gtgccggctt | 6420 |
| gatgtagaag | ctcgctacaa | actcgttgcg | gtcgataact | gctggagtgt | tattcgtggt | 6480 |
| atcacataca | actcggaagt | catatacacc | acccagagct | ttaatacctg | cgaggtattg | 6540 |
| gctggtttcc | atacggaaag | aactacgggt | aaagttatcg | tttaattcaa | acagctgcca | 6600 |
| cttagaagaa | tcaccgatgt | tgttcttcag | catgttaaac | aagcgacgaa | cgttaattcg | 6660 |

FIG. 20E sequence.txt

```
gtcaaacggt gttggaacag tggttgcagt cttatcaccg aacagaatga aaccttcacc        6720
tgtaccttga ccagtcactg ggttaatacc tgcttggtac atgcggtcac gatgtgcctg        6780
acgcggttca attgccaatt tgatgcaatt taaaatctga ccacgacgat atccagctgg        6840
tgacatccaa ggctgagcaa tatcatcagt acgagcacac aggcctgcaa tatcagcagc        6900
taacggaacc caacggttta cgtcgttata tttatcatac tgatatttat agttaccatc        6960
aattgctgcg tacgtagtat tgatgttcat gttagcagaa tcataagttc catcgccttg        7020
gcgccagtcg attaaattat caacagcacg agtcagagga atatttacaa tcgttgacct        7080
tggaggcgaa atgagtgcta agcagtcttg acgctcatct gcaatagacg aaacgtgttt        7140
ttgtactgta cttgcgattt catcggtttc accagcacaa gcaccagcaa tcagaaggtt        7200
tacacgcaat gcttcacggt caccaaataa atcccagcct tgaattaaat cgccagccgt        7260
aactgattca ttagctgaaa ccccaccacc cagacgaata acgccggaaa atccttcagg        7320
ccatccttgc gcagtagcaa atacatagcg tgaagaaccc ttggagaaat aatcgtccat        7380
aaagatgttg tttccgtaga tatctttatc ttggcggctt gttgataaca ccgctgattc        7440
aactacagca ccatctctac gaacaatgat agcgtactga gtatcggtct gaggaccata        7500
tccaaatacg gcttttgcgg ttgatgcacg ctgtccacca ctcggataaa tcgtcagttg        7560
ttcgccttta tcaaaagcgg cttttgatac aatttcaatt tccagttggt ttccgagctc        7620
gccaggatac gcagctacaa ttccaggcat tttatattgc gcaagcgcag tctggaattc        7680
agtttttgtc atttcttcat gggcagtttc atgttcagtc agtagaactg tagactcaga        7740
aataatttta cctaaagtaa tgacagcgga aacaccagaa ctctgtgaag taatggtagt        7800
tgtccacgaa gaccctaaat caggatattg attaatgctt tttgcatatg caataatctt        7860
cgatgtcgga atgaacaccg acttaatttt tccgtcacta tctacttcag taactgaacc        7920
ggtgtcatct acggtttggt ctgcatattt aaccgtaatt ttatcaccaa cttcatagtt        7980
actaccagca gtagtgatag tccattcaat attatcaacc aatggagatg cgttttagc         8040
agcttcacgg ttaactacac ggacggtgcg tagatcatta ccatattgca gaaagttcat        8100
tgctgacata agtaatcag cagtttggtt attagggccg ccaaacatat caaccagttc        8160
aacttcatta gtgatttgag taacttgata tgcaggaccc cattggaact tcccgacaat        8220
tgcggcacga cctgtagcgt taagtactac cgtgctctgt acgctcgttt ctttgagctc        8280
aattccagga gagactaaag gcatgatata tcctcaatgt tgtttgcttt ttattattta        8340
tacaaatgaa agaccatgtt cttgaggcgc atattctgcg ctattcacgg cgtcaacgaa        8400
cactacagga gcgtaatcgt cgttcatatc ttctaattcg cgtttaaaaa cttcagatgc        8460
taaacgcatt tcatctttat ccacgaaatc agcaaatttt tgctgtgttg ttaaccatgc        8520
gaaaattacg agtgacataa ttaaatcgtc atgatatcca tcttctgccg cccaggatac        8580
```

FIG. 20F sequence.txt

| | | | | | |
|---|---|---|---|---|---|
| tcctttctca | gagaaagtac | gaaattcttg | aacagtagca | cgatggtgaa | taatgagttt | 8640 |
| atcttttcg | ataaggtctt | ttagtgcaga | acatccaacg | gcttttgacc | ttttcgtctg | 8700 |
| tttcattcct | aaatcaacta | ttgaatcgca | aatgacattc | tcatattcta | aatccatata | 8760 |
| aagactcttc | gctacagaaa | cacctgtaga | gttaagttct | atatagatcg | gagcttcgtt | 8820 |
| gtactccatt | agatatttaa | taactatatc | cgggaggatt | aagtgagaaa | ttgtattaga | 8880 |
| atgtaatact | ccaacttgtt | cccattcaga | tgtagtaacg | tcaataatat | ttagtgcatg | 8940 |
| gtaatcctga | ccgcgtcctt | cagcagagtc | aagagttgca | atatatttgt | ggtctgcttc | 9000 |
| cgcttcttta | aatttataaa | acccgtgcga | gtcaggagta | acttcaatcc | aatccatatt | 9060 |
| ggcaagtttc | ataccggaaa | tgagagtacc | ggatgtgcca | tgaaattccg | cacagtgctc | 9120 |
| ttgtttaaac | tgttcaagag | aagaagcact | gatagtttga | agtgaccatt | gccacccatc | 9180 |
| atcaaacata | tcttcgtcgt | tatatagacg | ttctttaacc | gagttccaaa | ttgcagtata | 9240 |
| aggcgtaaag | ccggatttac | cttcaacagc | tgcagtccaa | atatcataga | agtggtttaa | 9300 |
| tccacttggt | gtagtcgtga | taataatttt | agaacgacga | cctgatgaaa | taacaggttg | 9360 |
| gatagcaagc | catgcatcta | tgaagtttgg | aataaacgca | cattcgtcaa | tgtaaatcat | 9420 |
| tgcaaatgag | ttaccacgaa | cggcatcagg | actcgaagcg | tatgccccaa | tagatgagcc | 9480 |
| attatctaat | tcgattgagc | ctttgttcca | ttcaacaata | ccaggctgaa | gaaagtcagg | 9540 |
| aagtaattca | attgcttgct | tagtacggtc | gagaacttcc | gcagacattg | agcctttatg | 9600 |
| cgcaagaata | cctactgctt | tatccttatt | aaaacacacg | aagtgcgcaa | gaaagattgc | 9660 |
| tactacagta | gttttaccga | gctgacgact | gaggttacaa | caagtcatac | gtttggctgc | 9720 |
| catgatttcc | agcatgtccc | tctggtaatc | acgaagctgg | actttaatgg | taccatagtc | 9780 |
| aatgtgagta | attgcacagt | aggtctctgc | gaagtacaca | atatcgtctc | ggcatttctt | 9840 |
| ccattctgca | actatttcac | gggttagttg | catttaata | tttgctcgtt | taaggtttgg | 9900 |
| caatcccata | tagcgggtgc | gcttattatt | tttgtcctta | aacgttggaa | aatgagctgg | 9960 |
| gtcttcacct | tgcaaacgaa | ttttaactat | cccatgcaac | ttaagatagt | cttcaaattt | 10020 |
| ctcaggatac | cacttatcat | cccattgcga | tttaaagaaa | cgaactccgt | tttcaatttt | 10080 |
| cgtttccatt | tcagacgggt | gacgaataac | cgtcagtttc | ccgtcattta | aaggatgggc | 10140 |
| atcactcaga | acgttaaacg | gttgagtctg | ttccatttac | tattttctct | cgagcttctt | 10200 |
| gtgcttcata | ggcatcaccg | aattcatcca | tcatatcagc | ggtagaccct | acaaagactg | 10260 |
| ttgcattttg | aatattcatt | ccttgctgag | gattagctcc | ctttccggtg | ccaacctgct | 10320 |
| cagaagtaat | gtctttcatt | tctttatgaa | gcttaagaat | ttctttgttg | gttgtagtca | 10380 |
| tctgacccat | aagagttgca | aatacttcca | tatgtctagg | agaatcagca | ttcttagcag | 10440 |

FIG. 20G sequence.txt

| | | | | | |
|---|---|---|---|---|---|
| tttccaaaaa | tattttagct | gcgtccatta | acatctgttg | ttggaagtgc | atgttcttgc | 10500 |
| gaacaaccga | ataatcatct | tcgaggtcag | gtttacggtc | atttggatta | gatttaactt | 10560 |
| caactaattc | aagtttttca | taaactggaa | tttcttgtcc | ttctattcca | ggaattcctt | 10620 |
| cgatgtctaa | taatttagcc | atatctaatt | gtaattcact | catttttcac | ctctcggtcc | 10680 |
| aggagcctcc | ggatttaccg | gaataggaat | atcgtgagaa | taagtttgtt | tactagaacc | 10740 |
| atcccaattt | tcgtgttgaa | catctcgtgg | agtgacttcg | ctatctactg | attcaaagtt | 10800 |
| tccttctgga | gttaactcct | tgctgttagc | gaagaaatct | aaataaatgg | ttctaatttc | 10860 |
| gccatcaatt | tcagctacag | gcggatacaa | ccagccattg | acttcaaaca | tcagcgacca | 10920 |
| ttctaatcta | cggcgagtga | tattatctcc | atcaacagct | tcatcctgag | aaaatgactg | 10980 |
| taatacaatt | ctaacatcac | gattaaagct | tgtgtctttg | tcgtaaagct | cagttatagt | 11040 |
| cgtgttaaaa | tgcggctgaa | aataaggaac | gatttgctcg | atgatttgat | acatatcatc | 11100 |
| ttgattgcgt | gtataaattc | ccaattcaaa | aatcatctta | atcggagtag | gattatactg | 11160 |
| agatgtaatt | tttgaagggg | ttttatatga | tttggttcta | ttcaactgtg | atgttttata | 11220 |
| catcgcattg | tattgcatat | caaccaagtg | caaattcatt | cttggcaaaa | cagtttctat | 11280 |
| ctttgcttta | ttctcggtag | actgaatagc | agtccatttt | ccgagttgag | aaaggaactt | 11340 |
| ttcctttgaa | gcataagtga | taggtacttt | aatatatttt | agtccagtgt | cttcacgcca | 11400 |
| acgagcaatt | tgtacatgag | aaaataaatc | tccaagcaat | acaatgtatc | ggcgtaagga | 11460 |
| cgaattatac | caatgtccaa | acatgatttc | tcctaaggga | cccaaaggtc | ccatctttat | 11520 |
| tttatttatt | cgaagaaccc | gtcatcaaac | gaatctgctt | taggagggga | ctcaagtcct | 11580 |
| cttccgttat | taacataata | cggatgaaca | tattcagagg | cttctttatt | gatttcatca | 11640 |
| ctttctgcgt | attgtatatc | agaaatatca | gcaagagcat | ctatattttt | gattggttct | 11700 |
| aaatcaagct | cagaaaattc | aggaatatta | atgccttcat | tacgttgcaa | ttctggctga | 11760 |
| agctgctcac | cagaataaat | gtattttgt | gcagtaatct | tgcgttgaac | attttgacct | 11820 |
| aactgataaa | atggatcgta | tggctgaacc | cagttaattt | cgaataatga | gttatccata | 11880 |
| ggaaaataaa | ttaggtcacc | ggcttttggt | tcagaattat | tagtttgatg | cttgaatagg | 11940 |
| ttgggattaa | tagtcaaatt | gacttcatca | ttaaccatca | taccaaattt | actaaagaat | 12000 |
| gtgttatcgc | cagaatatcc | ttcaaatgaa | tctaaataag | cagcaaattt | ccaagctttg | 12060 |
| gtgaatttac | ttgatgggtc | ttctccaaaa | agcaaatcag | gattgttata | ttcacgagga | 12120 |
| aggaaataaa | actcaattcc | tctcatttga | atagcctcag | ccgataaagc | atctgctaac | 12180 |
| gtttggctat | ttctgtgatt | ataaaaattc | acataaggat | tgagaatttc | agtctcatta | 12240 |
| gttttattat | atcctcgata | atcttcgagt | ttagcgaaga | gcctagaatc | aaatgtagac | 12300 |
| atctttacc | ccaacagaat | aggacaaccc | gggtcaagta | aatcaagttc | ctctcggagc | 12360 |

FIG. 20H sequence.txt

```
ctctcgattt cttcttgggc ctctacctta agtgtttgac catcaactgt aactccacct   12420
gccaattgca gaccctgatg tttaaaaaga atttcacccc acagcttttt agttaatgct   12480
gtagcataat cttttaccca acgattatta tatgcgcctt ctctatttgt attaccttca   12540
ccagcatatt gaccattatt acgaaggtca ggattctgat atctatctcc taatccccaa   12600
tgatcagcag tttgcggccc agcaaatccg tatcctgctg tattgcctac catcgcatct   12660
gtattcataa atgatttggt ccagcattca cagacaatga tgtcaccctt catgaagttg   12720
cccattactt taagcatttc attatcagag ttataccaat aatccgggag aggagcaagt   12780
aaatcttgca tcattgacca gtaagtcatc aattgagtaa aatagccaag gtcagcacca   12840
aacgcatttg gcccatagct tttattacag cttgacccca ttccgccatt aattcctgcc   12900
attcccatta gaaagtcggt aaaccatggg tatgtcgcat taccatccat tgaagttaat   12960
gaacctacat ttgttctaac aatttgggtg acagcaaata cattacggcc gcgcaaatca   13020
aatacgccgt tcaaaaatct tgcgttgtca gcttcgtctt ttccaatata aaaaacttga   13080
taacctttat tcaatccgtt aaagtggtat tcaccataca actctaatgc tcgttgaata   13140
caatcataaa tttggtcttc agttacttct acattaatta ccggcgctcc tagacgtcga   13200
agtatagcgt cttttaagcgt ttttgggttg tacgtgttgt atgacatatg aactcctctt   13260
tatattccta tttatacgaa aaagggaccc gaaggtccct tttgttatac agctggatga   13320
atagtaatat ccaaagattt aattttaaca agaacctgtg attcttctga agcagctcta   13380
tacacgattt tgattgcatc accagatgaa aactcaatga gtttcttggt tttaatcaac   13440
tgttcgcccg ttacagcctt aacaccgagc ccgtaggaaa acacctcgat gttattaacg   13500
agaataacaa ttttcacgcc tttatctgaa tcagaagctt cgataaccgt atcagtttct   13560
acgcaaaata cgccatcgtc atcaacaaca atgtcatcga caatacgaat gccagcattg   13620
aatggagcag cgaccaatga gttaggattt accaatgcat cagaacttaa atcaacagtg   13680
aaatcttctt tactgaattc acctattgat gaaggttttt taaaccattc gccctgttta   13740
cggaggtatg ctccagcttg ttctacgtca gtaactgcag tcacgaattt atcttgcaat   13800
tctactacag tagcgtatac accatcacgt tgaactgggt tttctgacga aaagtcacca   13860
ttcatttgag tctgtaatgt aaatacagaa ccctttaacc cttcattgtt attgccaagt   13920
tctacttgaa tgtcctgaat agcagactgt tgagagtttt gcataccttc aacattggtc   13980
attctcgcta aaattgaccc aggaggaatc ggctgctcgc taggaacaat accaacctgt   14040
tggtttatcc atgctacttg accctgaagc cctgatgaag tatcacgtcc tacaacatca   14100
gaaatgtacc cttggtcagt tgaaagagaa ctaattttc cttcaatagt atcaggctta   14160
tcagaagacc ctaaacgagc atcaatatta ttgacacgag gaactaaccc ggtttgtgca   14220
```

FIG. 201 sequence.txt

| | | | | | |
|---|---|---|---|---|---|
| aagttaagtg | ttgcgtcaac | tatacgataa | tcgttttcta | atctagtagt | acgagctcca | 14280 |
| atttttactg | gattggtaaa | atcaatggct | tggttaatag | caaagatttc | attattagct | 14340 |
| gcggaaatag | catcagcgtt | attcacaagc | cttgcataaa | ttgaagctga | cgtagctccg | 14400 |
| gatttaggac | caacttcttt | acgcaggtcg | tttacttcaa | tagtcagaga | acctacgtct | 14460 |
| gaatcattgt | atgcatcctc | tagcgcctga | atacgctcgt | catgttttac | tatagctgac | 14520 |
| gcattattga | tgattcggta | tttcatacca | gaacccggag | agtcttgctt | cggctgtccg | 14580 |
| ttaatatctt | gcccaggata | cgcaccaatt | tcacgtttaa | cccaaactat | attatcacga | 14640 |
| actgttctgt | aatagtcatc | tttactagaa | tcataaacac | ctacatcctc | ttcgagaaaa | 14700 |
| tcaaggtcag | ttcgaagttt | ttcggtgtct | tcttctaatt | taagaatttg | tccatcatgc | 14760 |
| ttttcaatat | tctttttatt | gatataaacc | tgctcaatgg | cgtcagaaga | acctgtaatt | 14820 |
| tctaacgatt | ttttgatttg | gtctacatct | acttgaatat | tttctacagc | agttccaacg | 14880 |
| ttgttcaaat | cgttatgtac | ctgaacaacg | tttttctgga | tttgaacaga | agctctattc | 14940 |
| agttctccat | catttccata | gcgggttgaa | gccccattaa | gaggctctgt | attttttatc | 15000 |
| cagttaattc | tctgttgaaa | atcgtctgga | attccgtcta | cgaacggaag | cgaatctact | 15060 |
| agtttggtca | tattgttcct | tacggtctat | ttgtacagaa | tgtaagcatg | cagtcataaa | 15120 |
| atataatacg | actgtcttct | gttggtctta | tttgaacagt | ggcatttgga | ggaatgttat | 15180 |
| tgaagaaaaa | gttgctagat | gcgtaagctt | caaatctcca | tgaatgacca | tttcgtccgc | 15240 |
| ctttagtatt | ttcgatgtta | agagtaagtt | caccgcccca | tgggaaccg | ttaactatta | 15300 |
| caacaaatct | gaaaatacga | ttgtcatatc | cgtcgttgtt | acgctcaaat | tttacattaa | 15360 |
| catttagagc | taatctacta | gaagcttccc | atggtgcatt | acatgtaaac | gttgcacctc | 15420 |
| gactaatcca | agattgacct | tcaacccaag | taacattacc | tactctggtt | ccagctggca | 15480 |
| tgtaacgccc | gtcagattct | tgtcttgtat | aacaattaat | atcattgtta | gtaatcgtta | 15540 |
| tgtcattgtc | aagagttttt | ccgttattc | tacggttttt | aaagactgca | tctgttgcag | 15600 |
| ccgctgccaa | tgaagcatca | gtagttggag | aacctgataa | tctggttaat | ccatatttat | 15660 |
| ccttggtgga | ttttagcgct | tgaagacttt | tggagtaac | agccaaattg | ttagaagtag | 15720 |
| ctgaagccac | atctgagtct | ttagcaaatt | ttactatacc | aaatacgctg | tcagacgctt | 15780 |
| ttgatgccat | gaaggttttt | ggagttactg | cgtatccatc | gtgaacagca | cctgctgcta | 15840 |
| cctgggcttg | ggttgcgaca | cgaactaatc | ccaagttgct | ttctgtcgca | gaggtataac | 15900 |
| taggaggact | gacactgaac | tttccaatca | tttctacaac | acgcttagga | gttactgcgg | 15960 |
| tagtttcgtc | agttcctgct | tgcgcttgag | ccgcagtagt | taacctaaca | gttccatcta | 16020 |
| cgttttcttg | ggctttcaca | gttttaaaca | catgaccgag | agccgccgcg | gtaatagttc | 16080 |
| tatttcctgc | ggttaatgct | gcggcttcag | tattagtagc | ataccgtgtt | aagccaagaa | 16140 |

FIG. 20J sequence.txt

```
ctgttgtagt tgcttcagga cgggtaactg tggattttaa tgtagcagga gttaccgcag    16200
cattaccaat agttccagca tcaacttcag cctgtgttgc tgtgcgaatt acaccggcta    16260
ctgtaggaga tgctacaggt aatccggtat cagttcttgc ccagctacca atcagctcta    16320
acgctgattg gacgtctttt atagcaacag gccattgtgt atttgttggg tcaaatatcg    16380
tatatttggc caaatcactg tagtgattat agttattctg ggccattatc ccatccttct    16440
aaaatagtgg aaagtaaatg tgttcgcgcc gaaggtttta gattcgttgc cgatagcatc    16500
ccattgccca taacctgctt tagctggtga agtaatagta aattcaacag ttaaaccata    16560
cttttatat gtttcaaaat tatggttctg ataatctaaa tgaataatat caacatactg    16620
tggtgttgcc ggcgattgag taacctgttg aacaaccttt ccaacagctt ctaattcttt    16680
tactttatca taccaacgtg ttgctactgc tgcaaagtca tcaccgtttg caattctaat    16740
tggtaagcca agaatatgaa ttattactgg gtcaccgaca gagccgtctt cttttggctc    16800
taacgcaacg acacctgaaa aagtagcacg cgtaatttgc tgtgcgggct gtggagatat    16860
tccagtgtca ttgcaaataa tagttccaat ttctgctgac tgcaatgaca tcaaatcatt    16920
aatagcagct tcagtatttg gataccaaac ccctaaatcc atttgttcaa aggttaggct    16980
ccctatagga gccgtatttc ctaccgcaat attttgcggg tcaacgcgat attctgaaaa    17040
agcagctaat cttgaattaa ctttagctcc ttcacgagtt ttagtttcaa tcgtcatttt    17100
aacctaccct aatccaacga taaacggtga ttgttggctg aattttagtg atgtcatttg    17160
gaactacacc gttgtttacc gcaacagtgt cttcacggta tttagaataa cctggtccct    17220
gcgcgtctgg gtctaattga catccaccga taactacgct tccatgttca gggtctgaaa    17280
ttagaacttt atctcttgac attagttcag gaatgtgttc ttttcctaac gtaaatgtca    17340
aatctccaac cgttccacct gctgttaatg atggctgacc attttcgttt aagttattgt    17400
tgttacgcga aaaataagga tcagatgaat cattattcca accagcagta acacggcctt    17460
gtgaataaag cttccacacc ccaaatccca tatagtcagc agggtttgcg tggttgtgag    17520
cgttttcata aatcgtgcca atcggataaa ttacgtcaaa aaatgctgca atattattga    17580
cttaatcat aatatcgtca gcaaccggac gcatattttt ctgattaggt tcatcataat    17640
ttgtgtattc aatgcgattt tttagagtta ctaattgctc agcattcata tacacttggt    17700
cggtttctgc catgatatcg tcaatatcca tagtagtacc gatgttatta ttgaaccaac    17760
ggacggtaag aaggtcttta tcttcaaacg cctcaccaaa aataatagct tcgacgttag    17820
taccagttga gtcaaattcc agtctatagt cttggttaga atttacccat tgaccaccat    17880
tgtttataca gtcttctgcg tatccacctt ccgcaccttc acaataaaat aaaggaagac    17940
ctgcagttcc agcttcgagt aattcctttc cgttcaacga aatttcaagc gaattgggat    18000
```

FIG. 20K sequence.txt

```
tcacacccac acctggaagt acacccatat catctagagt gattcttcga agagcagtaa    18060
ggttatctac tataattgac ccaggaatcg tctgggatgt agtctgggct gaatctcgta    18120
tctggatagc caacttgttg tatgaagacc gataaacacc aattccatct aggaaggttt    18180
caaatgttat tacttcccct tcaacacatg gaacttttaa acgaatgtct ttaccgttta    18240
attctaccaa ttgacctgct actgttccag gagaaccgta atcagcattg gctttatcca    18300
taacgctggt ttcaccgtaa tataaaatat taccacgacg atatacatta agcgagtctt    18360
cgttatattc tacgccatca aaaatgttaa gaaagtcagt ctgacccgca gtagcaataa    18420
ttgattttt cgctacagta cttaagttac cattagttag cttatctaca gttttatttt    18480
caatatattc ccagcggcca ggggcgcaat aaaccaattc caaatcttgg aagttagtat    18540
tgaaaatttt aggagaagct gaacccttta atgtatcgcc ttgagcagga ataactgtga    18600
ttgggcttaa tcgccaggtt gaccaaacat cacgaagttt aataactttg ttatagtcgt    18660
tggctgtacc ctttggaagc tgaacgttaa ctcttgctgc ctgggtatta atagcaaagg    18720
cctgaccaaa cttagcattt aaagtagttc cagtagggct agctttaaaa gttttccatg    18780
cacctgctgc gaatggaact gaaccatcac ctaactctga atataaatca tcaaagttgt    18840
tattaatttt aagaccacct ttacggaggt aatcaccaga cccatcatct actgattggc    18900
ctactatcaa attttgtttc attattgaga taccctacg gtctgtgtag caataacttt    18960
aactgccaaa cgtgcgtttc cataagatgt tgaagctgtg catattaaat ctttctgcgc    19020
gttaatagag tatgaaatag aatacatctt ttcattttca gatgattcac cacttcttaa    19080
cactgcatat tcagtgtcaa atactcttcc gtttggcgct gatgaagtaa tagtcgggtc    19140
aatcataagc atgacttcag atgattgcct tttgatggtt tgaccacctg gatttgcgct    19200
gaagcttaat agcaatttaa cagtagagta atcatcatta tatccaagtc gaatattaat    19260
aggagaactc gttaaattat atgtagcttc taacggcgaa tatgtgctgc caaacatact    19320
tgaaattgaa taatcccaaa cagcagcacc gttagctttt acctcaacac accacaattc    19380
aattctacat cttggtgtgt tgataatcaa ttctcgcgat ccgtctttaa atgcatctgc    19440
tacgccttcg ccgtttgttg ttatttttat ggatctagct tttgatgctg agccattact    19500
atttacaacg aatacagctt ctcccgcttt accttttgaa agacgtattt gaactgcgcc    19560
ttctgaacaa tcagcatcta tgcatgaccc cattggaact gtccctgcag agttagcatc    19620
tccaaatttt atcttttggt aatagcttgt tgcatgaatt ttttggttca atgctccgcc    19680
gccagctgca ataatcgtt ggtcggcgaa ggcgttgtaa atggcgtcga agttatcatt    19740
aattttcaca ccgccatcat acagaatgtc gccggtagaa gcattaccaa tctcaccgac    19800
gtcaattatt ttttaccct tatctgtata cataggttaa cctcatatca aagtatagtc    19860
ttatttatat aaaatgggga gccaaaggct ccccataatt aaaactcgaa aattaagttt    19920
```

FIG. 20L sequence.txt

| | | | | | |
|---|---|---|---|---|---|
| aattcttccg | tttggtccat | tgaacgaata | ataggttgcc | gattttccat | gtaaatcatt | 19980 |
| tcacctgact | gtctttcaag | accagaagca | ctataccagc | cttttcagc | cttaacatta | 20040 |
| ggtgaatttg | gcattggctt | aacttcaagc | ggattagtta | taattgacag | ctgtctaaat | 20100 |
| ccagtatttc | ccggaagact | gaactccgga | aaataaaccg | catcaagata | cgctttaaac | 20160 |
| ctgatagtat | tgcatttcat | gcgataaatc | aaattaaagt | cgttttgttg | ccaagttaag | 20220 |
| ttgttttgaa | atccccaacg | ggctggagat | tcttcaatct | cttctggcca | aggaactacg | 20280 |
| atatattcat | ttgtacatct | gttaattgat | acgtcggctg | gaatttcata | tagatattcc | 20340 |
| caaagatatc | catcgcccaa | atcgacggta | ccatttgcat | caccacgacc | tcgaggagct | 20400 |
| gaaccagaaa | tagtggatgg | tgtccattta | cccccaagct | taatacattc | ttctttgctt | 20460 |
| gtaagattgc | caattgaaca | cattccatcc | tttggaacat | caatacatct | ataccatc | 20520 |
| catccaaatc | cagcatcagt | tctgttatat | ggcgcagagt | tagcaacaac | gatatcgcca | 20580 |
| attagaaatg | tgcgtgggtt | aggatatctt | gtatctcccc | agtctcttct | tggaacaaca | 20640 |
| cagtcaagca | ttgatgattc | aattttgacc | gcgcccatca | tatttgtcca | aacatcaact | 20700 |
| accccatctc | cattatcagc | gggatatgga | ggtgcaaatc | cgggttcaga | ttcgttatct | 20760 |
| gaccacggag | tgcttttgcc | aaatgaaaca | tacagtgtgt | tttggtccgt | tcccggacca | 20820 |
| atcgatttat | aaaatgtgta | catcttttca | gttctaaact | tagatgtaat | gatagcacga | 20880 |
| taaatcgtgc | tacgcgttga | acttgctctt | gttgaattac | tcatcaattt | ttacctgtgt | 20940 |
| cggattttca | ggatcgcgag | gattacctgc | atcgtcttta | agacgttggt | taactaaatc | 21000 |
| gcgataatta | gcaaacgtta | ctgctgattg | gtcaaacgta | ggacttaacg | gtttacgtcg | 21060 |
| ttgtccaggg | ttttgtccag | cgataatgct | gttattattt | tcttgattgt | agttagcagg | 21120 |
| taacgggaaa | ggttcaccag | cttgagcacg | tgaagaatac | ctaggctcat | tggttattgg | 21180 |
| gtctcttct | attgtatcat | ctgaagcgat | aatagcaact | ctatcaggat | aaactgatgg | 21240 |
| cagtcctgca | tcccatttat | agttcttgag | tttatttatg | atagtctcaa | catgcttcat | 21300 |
| atttaagcca | ctattgataa | acattgtcag | caatgttata | ccaatgaaac | cgaaacctac | 21360 |
| cggatgaaca | aaccttaata | catcgtcgcg | gaaacgagaa | gtaggaagct | gagacttaat | 21420 |
| tttcataaca | tagtaagaac | ggctgcggtt | tatataatca | atgttattac | tcagcatatc | 21480 |
| cttttccacga | acaccttgaa | ctataatacc | ctcaaagtcc | gtacgctctg | atttaatttc | 21540 |
| ctggccttca | atgaaccgtc | ctgataagtt | atgaatagta | atacgccata | acagacgacc | 21600 |
| atcccggtat | tctctctcga | tataagtcac | attactacga | ccggaagcag | tataaatcgt | 21660 |
| acgaccaact | aaatcgtcag | aaatatttgt | actttcaaca | ataatgtcat | attcggtagt | 21720 |
| gttctttgac | tcaatatcga | tttcaacatc | ttcattataa | agaagtttaa | acaagaattt | 21780 |

FIG. 20M

```
                                     sequence.txt
gtatgagtct  tcaattcctt  tggtagcata  gaaatcattc  ttacgggctt  caaagaaacg   21840
gacaacagca  tcgcgagcgt  ctttactcag  ataaatattg  cgtttataaa  cttctgacca   21900
caggtattcc  catgcattttt cttcacgagg  atatttgttc  ttaacaagat  taacgagact   21960
gttgtaatgc  gttccatttc  cgtctgaaag  gaattggaga  tagtacttac  aaaattgctc   22020
aaaattacta  tcttgtagca  agtaactatc  cggcatcatt  ttagtaagat  acggacgcaa   22080
atctgggtca  cgtaagcctg  gagtatgttc  aggtgtccag  tcttcttccc  gtgtttggtt   22140
ctgcagaaac  gctttaaaca  ttacatcagt  cggtttccag  ttaagcgtta  cctggtcacg   22200
aacacgataa  tcaaatgcgt  aatagcctat  cagttttccg  tctggttcgt  gaaacatgat   22260
gccagaagca  tactgcaaaa  atccattaaa  tgaaactgga  gggcaataaa  acgttgcgtc   22320
acctttatcc  cacacttccg  aaagaacacg  ctcggtagtt  ccctgcgccg  ctgcatctac   22380
tcttttttga  taaagaatat  cattataaat  gacaactgca  tggtcagctg  tacttatcca   22440
gcatctgtta  ccttcacgag  ccatccagac  aaaccaaggc  tcagcataaa  acctcatcgg   22500
tccaggaaca  aatgtttccc  atcttgaaaa  ttcatctgct  ctgaaactca  tcatgtgata   22560
atgcttatca  gagtgatact  gaattggatt  aacatttta   actgcagtag  aaattagttc   22620
tggatatttc  gtctcaagtt  caatatcctg  ggtgtactct  gttgtcttaa  aattagctga   22680
tgaaaagaat  atttccttt c cgtcagttga  catagacgtc  cataaatgct  ctatacgacg   22740
tttttcttca  tctgtattac  cgaatacacg  tttccatgta  tttgtgtctt  cttgataaac   22800
atagacgcct  ttagtagcag  aatccacaac  attccgcggg  tctgttgggt  ctaatcctaa   22860
ggttttaact  tctccggtaa  taagagcgaa  gattttgcct  ccgacagaat  ccattttaaa   22920
gcatacagat  ttaggattgc  ctgttatatg  agatgcttct  ttttcgaaca  cttttttcacc  22980
aaatgtaggg  cttaaagggt  cagtgtctat  tggagcatct  tttaatttaa  ctctgcgtac   23040
tgtatccttt  gcaactacat  ataagtggtc  atcattgcat  gtaaaggctt  ctgcatattt   23100
ggtaacatca  gcaggtagtg  atgcatatgt  accaaataac  tctacttcaa  atcccagttt   23160
taactggtct  cccaatttag  caaatgtaac  ttcgttatcg  ctaaatttaa  cctcatttga   23220
tgaccagcgt  acgtcagatg  attttcttcc  gtaaaagatt  ttatcatagc  ctaaaacata   23280
tgatgtggta  cttgattgat  aaattaccac  tctagaaacc  ggatttccta  cacggtcatt   23340
aaataactga  acgtattgcc  agttctgtcc  tttatcgttt  gatactttaa  ccatatgttg   23400
gaatctttca  aacagataca  aaattccgtc  tatttctcct  agcatggttc  tatttttatc   23460
aacacagact  gcttcaatag  gtccctgaat  ttcatgatat  ccagattcgc  ctactacgaa   23520
attttcaata  gctgacaaat  gagaatattc  aggactaaat  tgaaaagact  cagtcatcaa   23580
agatgccatc  atggcagatg  tgttgaagtt  aacatacgac  atgttattta  aagaaaactt   23640
ctgcttaatg  aattctttca  ctaaactgaa  ttcttgcata  tgctcaaacg  tgtacgcgtt   23700
```

FIG. 20N sequence.txt

| | | | | | |
|---|---|---|---|---|---|
| ttcttcaaaa | gtttggaact | cttctgtttc | aacccattca | gacggttcaa | atcctgctga | 23760 |
| cgtagtttga | acacgcattt | tataataggt | aagcggttca | atacgatttt | gttcgaacca | 23820 |
| atcattatcc | gcggtataac | ccagtgaaga | ccaactcaaa | ttatcagcgg | ggataatttc | 23880 |
| ccccgctctg | tttcgagttt | cggccagttc | tacaaaatag | tagaagtttg | caccaacgtc | 23940 |
| atcccaacga | atattgacct | gattcgcaga | tagcttatga | attcgtaagc | tggtgacgaa | 24000 |
| cggtgcaatt | gtcattgagt | aataggctcc | aatttaatag | ttgtgtattg | aggacgaagg | 24060 |
| tcattctcaa | atacgataag | tgttccatcg | cgggcgaaga | cgatatcctg | ggtaggagta | 24120 |
| gaataaagct | caatactttg | gtcttcaaac | tgaagaggat | cggctccaat | ggctccaaga | 24180 |
| ctccagtaaa | tgttatcacc | ataataatct | acttcaccga | ttttatacca | gcgagttctt | 24240 |
| tcgccgatgg | tagttctatc | aaaatcgttt | tcagtatatg | gctggatatg | agtattctct | 24300 |
| ttaatatcac | ctggtttaaa | tggtccaata | accatatttc | ctttgccatt | tttatctggg | 24360 |
| tcagttccaa | cgatattaac | tgaatacggt | tcagcagttg | gggtaacagt | aaagaccaaa | 24420 |
| tcaccagaac | gtaacgtccg | cggagtaata | gtattatagt | atttaatacc | tgcgctagga | 24480 |
| agagtgaaat | agttgacaat | ttcacgaacc | atctgaatat | ccacagaaga | accgatgatt | 24540 |
| gagtggtcag | tgtcatcaat | gtaagtcaac | aacttagatt | tactgaaatt | tttgttgaac | 24600 |
| atttcaactt | catcaacgta | atatctatta | atcgagtcta | taatttttga | ctgtaaccac | 24660 |
| tgctctgatt | cttgcaactt | attcaatgca | taagaagctt | taatattatg | acgaatgaat | 24720 |
| aagtaatctg | ggctcattac | cgaaggggta | atcggagcaa | gacagaaagg | ttttagataa | 24780 |
| tcctgaatgt | cttcccgttg | aaccgcagtt | aactgcaacc | cagattttgg | tttgattgcg | 24840 |
| ataaatgcat | atccgggttt | gtcctgatca | gtaaagcatt | gtactgcttg | tacgatagaa | 24900 |
| ccaaagcgtg | aactaacgaa | tgattcatag | tcagttttag | acacgcatcg | catttgagat | 24960 |
| tcgcgcttaa | tctgtgcgag | ctcacgaata | cgctcgatgt | cttcaggttc | accaccgcca | 25020 |
| tcagcgccaa | cataatcagg | agaatctgac | cagttttcaa | tgattctatt | tactacgata | 25080 |
| tattgcagag | tatccgcata | actaaattca | gtcgcgccat | tagcagcttc | accgtcagta | 25140 |
| cgaatatatt | caataacgac | ttgcgcaccc | ttagtaggct | tcaatccacc | gatgaagttg | 25200 |
| ctttcaagaa | ctcctcctgc | cacagatgct | tctgccacac | cctcaccaaa | gaagaattct | 25260 |
| gtatttccat | cgacagtttc | acgcatataa | taaattgttg | aaatagacga | agcatgaacc | 25320 |
| attgatcggt | ctgtccagtt | agtccattca | gcgccatcca | cccacagctt | aacttgcttg | 25380 |
| cggtcaattg | attgatcgcg | aataacaata | ggtttcttcg | ggtcatatga | caactgagta | 25440 |
| cgaataatac | gtccctgcgc | caaattgaca | ataggccaat | attttggtc | attatcacga | 25500 |
| atagccacaa | cgttttcagt | aacaacgaag | ttatatgggt | tggctttatc | ggattttgag | 25560 |

FIG. 20O sequence.txt

```
tatgctaaaa atttagttcc tcgtggaatt acaactctca acgtgctgct cgggttcatg      25620
tgagttacct caagcataat agatgcagta gccgctgatt tggaacttgg caaatacccg      25680
ttttgctgag ctgcttgaac aacggaactt ctcaagttag ctgttccaat aaagctttcg      25740
tataaagcag tattactaaa ttgctgtatg taaagcgtgt tatatgctaa taagtctaat      25800
agcacgttta aacgcgaacc agcaaaatca aagtcctgaa actcttttg accgctaagc       25860
cagttaataa gctgattttt aatttcgtcg aatgttgctc cagtaaatgc gtctgggata      25920
gcgtttgcag tacgcgttaa ctgataattt aagggttctt taatagccat tagtgtatga     25980
atacctttga acttgattgc gcgacagtgt cgccacaaga aattggatcg gccatttgaa     26040
cagctttttt gcctgttaca aataccttgg atgtgcgagg ttgaacaact cctccatgcg     26100
tatcatgagg gtcaaccgtc ttggtgtgtg gggtaattga gtcgccatca actaataccg     26160
ctattccacc agtgaatact ttactttgtg tagcatttac ttctgtcgga ggatacgcac     26220
tatgcccggc agttaagcat ttattaaatg atagtccagc catttaattc cccgcatata     26280
cataagcacg aagttggtcg ccccatctac tccagttgcc tttaacggtt tgagagtaaa     26340
tcttttgctt tttatgttct gttatgattg gagcgctaga acctccggat gaacctccag     26400
acgattcttc tgtcactgta tatattatct caactgtata ggtaaatgtc ttctctagtg     26460
ttctgggggc tttccataga tacaaatcag cagttttggg attaggtaaa tcctcccacg     26520
ctgaagcgga ctttagctca tcaccttcac ggtatttaag cacatcgttt ccaaaagtaa     26580
aaactgagtt ataattacct ttataatgag tttcagacac agagatatca gatactggtt     26640
gatagtcgat aatatttatt gattttaatg tttcgttagt agataattga gcagtaaagt     26700
actgctcaac atattcacct tctattactt cacgtaacgt tgtattaata ggaagtatat     26760
cagccatgat taacctacat caattcgtga accatcaaca gtgtattgac cttgggcgat     26820
tgagctcata gaagccattg tttcagtcca agccccacca acattccaat tcacagtacc     26880
tgctacttgc caagttaaat taccaccgac ggtcacgtcg tggttgccat ctactttagt     26940
agtggcatca ccattgactt ggatatcagc atttccttca acgactatct taatgttacc     27000
cttgacaaaa atagtaccat tgccttcaat cgttttagtt tcatttccac gtacgtaaag     27060
cgtgttatcg ccatcaattt gctgtcgacg attatacatg ttataatagg tctcgttccc     27120
tccaacgtta accttcttat caccagagat taaatatttt ccatcaccct gagtcatgtc     27180
atataaatca gctacagttt ttctggtacg acgtccatca ggagcaactt cttcatatga     27240
accggttgga tgaacaatac gatagcgttc atagccaggc gtatcatcaa attcttggat     27300
atggcctgat tctgtttcca tcgtatgtac atatggatat tgaccattat atgaagactc     27360
aggttctttg aaaagaattc ttgaatcctc tggggtccac gggtcttcag gattaccacc     27420
agacttcggt tctacataag ccgcagacag gttttttcct tctggctttg gagcaggaac     27480
```

FIG. 20P sequence.txt

| | | | | | | |
|---|---|---|---|---|---|---|
| tccatatgat | tccatattac | ctgttagaat | aatcatggaa | acacgagaag | cacgaccttt | 27540 |
| tgtctggtta | aaccacacgg | agtttcttgc | ttcagtatag | gctgttttcc | aatcaccaat | 27600 |
| gagcatggca | tcaagcattt | taccaaattt | tgctaatcca | cctacaccca | tttgaaaact | 27660 |
| catattttct | aaagccattt | gccttgattt | gttgacttta | gcatataccg | gtcctacgcg | 27720 |
| tgaattcgtt | ttaatatcag | aaagcatttt | atcacgatct | ttcttaaata | gtgcaactgc | 27780 |
| ttcgtccatt | gtaatgatac | cgggatttcc | tgtaacagta | cgaccaacct | gattagataa | 27840 |
| agttttatta | atgacagaca | tatcacgtac | ttttttgtgcc | atgataaggt | gtccaatacc | 27900 |
| tacagtagga | tatccttctg | tatcccaata | gactttcaat | ctaagacctt | catccctatt | 27960 |
| aagcatatct | gttattgtaa | ttgcaggatt | tgggtcttca | ggaatatcgc | ttaggtcagc | 28020 |
| atcgtcagga | ttaatgccaa | tatccaagtt | tctatcttgg | atgatgtttg | gtatagcact | 28080 |
| atacccagtt | tcatcgcctt | gaactagtgg | gttggtatct | gacccaacct | gtctaggata | 28140 |
| ttgacctgtg | gggtcagaaa | aaccttccgt | gtagtttggc | ttagttttc | tgtgcgcaga | 28200 |
| atatgttcct | attactaatc | ctgctgtttt | gaattcatca | agccataagc | caaataccga | 28260 |
| tgttccttcc | accattccag | ttatagacga | gccaactccg | gaaattccag | ctgagtttgt | 28320 |
| aggctgaatc | actgacatcc | aaggaaggtc | ttcggtagga | agaccggtta | tagctccttg | 28380 |
| tacctttttca | aacggatgaa | gcccgtaaac | acgtactcgc | actcttcctt | gctttaacgg | 28440 |
| gtcttgtctg | tcttcaacaa | caccagtaaa | ccattttaat | gaatcgttca | tttcaatcat | 28500 |
| aaaacttctc | cgatggtagt | ctgggatttg | tatcggcctg | attcgtattc | gctgtcaggt | 28560 |
| gcttttttcca | tttctcgtat | aatatcagaa | agaaatgcct | caatatcact | aggattgata | 28620 |
| atgtttattt | ggcgcagttt | ttcattttct | atgatagagt | cttcataaat | gtcaacacca | 28680 |
| gccaaagcac | cagtatattg | aggatactga | tgattaaagt | cccctttatc | ataccaaaca | 28740 |
| cctgaatttt | caggatattg | ctcgagattg | taatagcgat | tgccatacgc | atccacgtga | 28800 |
| tagagtattt | ggtctccacc | tacatctgca | tattttttgct | gcgcaaattg | atagcatgca | 28860 |
| tcttgggttt | taatccaatc | tctgaatggg | tcatatacat | tattacacat | taaaagaatc | 28920 |
| cagtacagct | gactatttcc | ataaagaata | tatgctaatt | cttctggtct | aggagctcca | 28980 |
| cttatgtaat | atgtttgtaa | aagatagttt | tctgccacag | tgtcaaaata | tttgcgataa | 29040 |
| ttacgaaata | tgtcagcggt | tgggatagct | tttgccttag | caccttttac | ggtctttgca | 29100 |
| gaataatcta | tcggactaaa | aaatgagaag | agcatagttt | atcctcttat | aaatattaat | 29160 |
| aacagtattt | ataaggaggc | cactatggca | tattccggca | aattcatgcc | gcagaatctc | 29220 |
| cacaaatata | aaggcgactt | cagaaagatt | acttatcgtt | ctacgtggga | acagtacatg | 29280 |
| atgagatggc | ttgacaatca | tccagatgta | gttcaatgga | acagcgaaga | ggtagtcatt | 29340 |

FIG. 20Q sequence.txt

| | | | | | |
|---|---|---|---|---|---|
| ccatacttta | gtaatgcaga | tggaaagaaa | cgccggtatt | tcatggattt | ctgggctaag | 29400 |
| ttttctaatg | gtcaacagtt | cttttttgaa | gttaagccga | agaaagaaac | tagacctccg | 29460 |
| gtcaaaccca | caaagttgac | gacatcagcg | aagaaacggt | acattgatga | aatttacaca | 29520 |
| tggtctgtaa | acgttgataa | gtggaaagca | gctcaagcta | ctgccagtaa | aatgggtata | 29580 |
| gaatttaggt | taattaccga | agattcactt | aaaaaattag | gatggaaagg | ctgatggcta | 29640 |
| tatttgaatt | tatcactgaa | gctgcagaat | cgcctaaagc | taaatcccgt | agtgaaaatc | 29700 |
| aatgggtagc | attaggagtt | gaatactctg | ctgctcgtaa | aaaaggcatg | acatcaaaat | 29760 |
| catttgctga | aagtaaagga | ataaatcctg | ctacgttcag | taaagctatg | gctcgtcatg | 29820 |
| catcaagaat | taaaacggca | attaaagtag | cagaaattga | gaaaaaacct | gctaacaaaa | 29880 |
| tgaccaaaca | agagcgtgct | cttgtgatgg | taaattcatt | tcgaagctct | atcaaagata | 29940 |
| aaattcgtaa | tgaaggcgca | gcagtaaaca | ataaatctgc | taaatggttt | gcagaaacta | 30000 |
| taaagaaaaa | tatacgtggt | cattctgtaa | ccaagcctca | acctggaaag | ctatatgctt | 30060 |
| acatgtatga | cgctaagcac | aaagacactc | ttccattctg | ggataaattt | cctttgatag | 30120 |
| tttatcttgg | tcttggaaag | caaggtacaa | ccacattgat | gtatgggtta | aaccttcact | 30180 |
| acattccgcc | aaaggctcgt | cagcagtttt | tagaagaact | tctgaaacag | tatgctaata | 30240 |
| cgccagtgat | atctaataag | accagattaa | agataaactg | gagccaggtt | aaaggatttg | 30300 |
| ctggcgctga | caaaatgatt | aaagcatata | ttcctggtaa | tataaagggt | gctttaattg | 30360 |
| agataaaacc | ggctgattgg | gcgaatgtag | tcatgttacc | actgcagcag | ttcatgtcga | 30420 |
| aaggcaaacg | ctactctgct | acttctgtat | ggaaatcata | atgtctactg | gactgtttaa | 30480 |
| tcaaactaac | acaactaact | ttatattaga | ggtccctgac | gggggcctca | cccaagcgtt | 30540 |
| taaagctaat | cttcaaacag | ctgtagttcc | tggaattcat | attcctgcta | ctgatactgt | 30600 |
| gggttcgccg | caaggcatgc | accgtgctaa | attgcctggg | tctacctttg | aatttgacgc | 30660 |
| tgttcctgtt | agatttttag | tagacgaaaa | ccttgattca | tgggtacaaa | tgtacaaatg | 30720 |
| gatgttaagc | tgtcaaaact | acattgaccg | agacaagtct | ggatggaata | acggcggtga | 30780 |
| aggatttcct | ggtgcagttt | taatgcatgt | tcttgataac | gataaacatg | atatagtatt | 30840 |
| aactgtccgc | tacatcggag | gttgggtgag | tgatttatct | gaaattgagt | attctttaac | 30900 |
| cgaagaatcc | gacccagcaa | tggtatgtgt | agcaactttg | cagtacaaat | acattgaagt | 30960 |
| tgaaaaagat | ggtataataa | ttactggtag | accttctgtc | aatgatactc | gcgaatccca | 31020 |
| gtatcaacag | aaagttatgg | gaatgcatcc | ttctatgagg | taataatttg | aagcttttat | 31080 |
| ttttgattgg | taaaaaacgt | agtggcaaag | atacaactgc | tgactacatt | atggataact | 31140 |
| ataacgcaac | aaagcatcag | ttagcaggtc | caattaaaga | tgctttggct | gatgcaatgc | 31200 |
| ttactgagtg | gtatcgcgat | acgtctcgtg | agtttccgcg | cattactcgg | tctatgattg | 31260 |

FIG. 20R sequence.txt

```
agggcattga ttacgatcgc gaacaagatt taaatctgtc tactaaagac gtgattcgta    31320
tcatggcgaa tgcgattgaa tatgttcatc atgatttgcc tttacctggc gtggtttatg    31380
ataacaaacg taaaatactt gacggcgata cgatggaagt catccgtaaa gttgtaataa    31440
ataaacctgt tgagccatgg tcaattcgtc gtctcatgca gacccttggg actgacattg    31500
tctgtgataa gctcgatcgc atgtattggg taaaacgatt cactttggtt atggctgata    31560
cttttggtga ttatgattat ttcattgtcc cagatactcg tcaagaccat gaacttgatg    31620
tagccagggc gatgggtgct acagttattc atgtagttcg tcctgagcaa gaaggttcta    31680
aaaaagatac tcacgtcaca gagcgtggac ttccgattcg cgaaggcgat atcgtaataa    31740
ctaacgacgg ttctctagaa gaactttatt caaaaatcaa cactatatta ggaattcaaa    31800
atgactactg aacaactgca agcccaagtc gatactctga agttcgtgt  atttgacctg    31860
tctgaaacta tccaaggcct ttctgctctg cgtgcacaat atgaagaagt actgcagaag    31920
ctgattgctg tatccggcgt tgaaattggc gaagacggcc aggttaaact tgatgacctg    31980
gttgcaaaaa tcgaagcaca gttcgcagaa gaaactactg aagaatctga gtgatgaaat    32040
tcagtgattt tagcactggc ttatatgtag ctgctaaatt ctctgagaaa actcttgatg    32100
ctattgagga ccttcagcgt gaattgaagg tccctaatcc tgtacctcgt cataagattc    32160
atacgacgat atgctattca agagttcatg ttccatacgt ttgtgcttca ggaagttttg    32220
aagttgctac atcaggtaaa cttgaagtat gggacacaca agacggacgt acgctagttc    32280
ttaagctaga ttcagaatac ttaaaattcc gtcaccaata tgcaagagct ttgggagcaa    32340
ctcatgattt cccagattac tcaccgcaca ttactctcag ctacaatgta ggtccagctc    32400
acttcgaggg tgaagttcaa gtacctgtag tgcttgatag agagtaccaa gagccactaa    32460
aactgaactg gtcagaggac cttaaatgaa gtcataccaa gaatttttaa tggaaactga    32520
ggctcttttg gagtctactc tgccagatta catgattgta aaaagcttta atgtaaaaaa    32580
tggctacgta attaaatttc ctatcgctag tgtcaagcct ggtgctgaca tgtcaaatga    32640
tgctggcatt agtgttaaag ttaatgtaca gtttattaat tacaactctg ctaaaaagtc    32700
gtatgatgct aaaatgactt tttccggtgg cgaaaaggta gttaaaaaca ttaagttaga    32760
ttacgatgaa tccgcagaaa gtgtcaagaa acgctttggt gataaactgg taaaatctat    32820
catggttcat ccaactttca acgcgatttc acggaactt tataaataaa aagttgttta    32880
cttttcctcga gggctatgat actatagccc tatcaaaaca aatgaggata aaacatgaaa    32940
cgctgtgaac tgataagaaa tgttgcttct gctatttgcc ttactgctgt gggcactagc    33000
attttcggtg ccatctttat gggtgcaaaa gaaataatgg ttgtgttagt agctgcattt    33060
cttatgggtt caatttcatt tattatggat aaaatttctc atgaaaaaga ttaaacaatg    33120
```

FIG. 20S sequence.txt

```
gtttgttaag acctatgatt taggccgtga agaagtaact aagtatgatt atgttacttt    33180
gggtgtagga ctaggtgcac tactggcagc attgcattca tcattacttg ccattgcagt    33240
gcttcttatt ttggctcact acagctggaa acgtaagtaa tgtatgcact tttaacttgg    33300
tctaattatt atcctgctcc tggctctgac caaatcagag gtgtttactc tacagtagaa    33360
gaatgctatg aagccctcca gggaacgtat caggactatt ttgagatact gaactctcgg    33420
tttgagaccg ttgctaaagg ttcaactgaa gcatacaaag attaattgtg aggaaattgt    33480
gatgaatatc agagctgcat ttaatacttt ctaccaagag aattataagc ttctttccca    33540
tgaatactat gatgcacaag gcgttccaat tcctagtgat ttagttacgc ctaagcatgt    33600
caaaaccgat tctcttgaca atgaaattca acctggtgat ttggtatcat actattgtgg    33660
cgggtcactt tctgcagcaa gcgttggtat tttgctagga tttacgccta aggttatcg    33720
tgtggttcct ttccatacaa gtccaattcc tgagcaccgg gtattgctct ctcatatgga    33780
ttcaccgcat agggtattcc tggttaaatc aaagagctca ccgattgtgt aatatgcttt    33840
aggttttctt tgttattatt aatctatcaa ctgctctgat taatttcagg gcagtataaa    33900
taaaattacc caatggggag ttagaccgta ggggtagcgg gacagactgt aaatctgttg    33960
ctcaaaaggc tcgagtggtt cgactccatt actccccacc aaatttaagg gatactagct    34020
cagttggtta gagcaccgga cttttaatcc gggtgtacga agttcgaatc ttcggtgtcc    34080
caccaaattc gggtcgttgg ctgagagggt aagcgacgga ctgttaatcc gtgtcagaaa    34140
tgactaggca ggttcgatac ctgcacggcc cgccaaatga agaagtcaga agacgttctg    34200
ataaatcgtc ggcatagaat tccctggcat ggcgtttgta ttaaggagta tgatttcatc    34260
ctgcttaata cttgttcatg ttataatttc ttacggcgtt gaaagttcgc tttcagggat    34320
acatcttaga acagagtgct aaacaagatt catctggtac caaggtgatg agagtcctgt    34380
tccccttgc ttcggcatag tgccagagta tctctgaaag cgaattatag tgctgtagtc    34440
gagatggtta agacactccc ctgtcacggg agagatcgcg ggttcgacac ccgtcagcac    34500
tgccaaatac gagagcaaca tgaaagatta tgaaaagtac cgcatgcaaa aagtgcatgc    34560
caaataaaga ggtattgaat ttaaattgac atttgatgaa tggttatcat ggtggaaagc    34620
tactggcaaa tatcatttgc ggggtagagc atcagataac tattgcatgt gtcgtaaagg    34680
agatgttgga ccatattctt tagataacat ctattgcgca actaatgcgc aaaacgctaa    34740
agacgctggc gctaacggaa gaataatatc tactggtttt actggacata accattctga    34800
tgaaacaaaa ataaaaatat cagaaaacca tgcacacaag ttaaatgcag acgaaatttc    34860
tttgcgaata gacctgtata attctataga ttttacacag cgtggtgcac tagtaaaatt    34920
tgcaaataaa cttggaatta gtcatactca agctagaaag ttcataaata gtttataaa    34980
gtaacgtggc agttcttgaa gatgagtttg agtcctgtaa gataatgccg aggacgaagc    35040
```

FIG. 20T sequence.txt

| | | | | | |
|---|---|---|---|---|---|
| ggtttgttcc | cacggaataa | gctctatatt | cgtaagatta | tatctttagc | gtgttctaca | 35100 |
| tcaagctact | tgttagtact | tcaagaaccc | ggataaatgc | ggagtaactt | cagttggtag | 35160 |
| aatgttgggc | tcatatcccg | cacgcgcag | gttcgagtcc | tgcctccgcc | tccaaacaat | 35220 |
| tgaatcatag | ccaagttggt | aaggcagtag | gttttgatcc | tacgatccct | ggttcgagtc | 35280 |
| caggtggttc | agccaaatta | atattcattc | aacgcgatgt | gtaggcagaa | gtcatgaacc | 35340 |
| tgctttagct | accgtatgaa | gtcctcatga | tggatggagt | gaatattgat | gtggtcgtag | 35400 |
| ttcagttggt | agaacccgag | gttgtgatcc | tcgatgtcac | ggattcgaat | tccgtcggcc | 35460 |
| accccaacaa | tgaaggaatg | gtggaaaaat | acacggcccg | caaaacgctg | tggctgtcgc | 35520 |
| taagcgaatt | gtgtctataa | tggcacttcc | ttcaccaatt | aatggagagt | agcgctagtg | 35580 |
| gtagcaaacc | ggacttgaaa | tccgggccac | cggaacggt | gagggttcaa | ctcctttact | 35640 |
| ctccgccaaa | tttatgaaag | ttaaacgctg | cccatagcag | tggtacatca | acaattagat | 35700 |
| gattagcttt | ccatgggagt | atagctcatt | tggtagagct | ctcgaccgat | aatcgagcgg | 35760 |
| tgactggttc | gagtccagtt | actcccacca | aataacaggt | tcttagtata | atggctatta | 35820 |
| tgctgggctc | caaacccagt | gatgagggtt | cgattccttc | agggcctgcc | aaatttgcat | 35880 |
| ccatcgtata | gcggatatta | tgtctggctt | ccacccagaa | gatgggagtt | cgattctccc | 35940 |
| tggatgctcc | aaattactcc | gtatagctca | gcctggtaga | gcgctccatt | tgggatggag | 36000 |
| aggtcgaatg | ttcgagtcat | tctatggaga | ccaaattaac | ggtatgacac | aatacaagat | 36060 |
| ggtgtaagct | gagtagcggg | attgcagtct | cgttcagata | tgctatcgag | tatgggtgat | 36120 |
| atattaaaca | cacggattct | gcaaagtcca | tgtgactcgg | ttcgagaccg | ggcataccgt | 36180 |
| ccaatcactt | gccattgaga | attatattat | gaaatattac | ggcttcaaaa | catcccattt | 36240 |
| cgggaaagca | tatcgtacag | aaaacattga | tagacgtcga | gcatattacg | aatcactgca | 36300 |
| taaagcagga | cgttctcgtg | cacgacaaga | aggccaaaaa | caagcgaagg | aaatagaatg | 36360 |
| aatatttta | ttggtgttgc | aaataacgta | aatgctatta | cggtgaaatt | acaatggaat | 36420 |
| cgtccaacta | attttgcttt | aggattatgt | aaatctgaac | gtgatttaat | gcttcatgct | 36480 |
| gattttgcat | acacttttga | tgaacgcaaa | ggtatgtggg | tatggattaa | atgcagatac | 36540 |
| gaagcattaa | tcaaatatga | gtacttcagt | gagcgtgata | ttcaagaagt | tattgcttat | 36600 |
| cattctggct | gtaaagtaag | taaactgcgt | caagttattc | cgtttactaa | tgcttcaaat | 36660 |
| gtagaagagc | taattactga | ttttaaacga | atttatcagg | cgaaatatga | tgaaagattc | 36720 |
| taaaggtcga | gacgtacaag | ttggtgatat | cgttttctat | ggagaacgta | catacaataa | 36780 |
| aggcggtcgt | ggttctatgc | gctgtggtcg | tattactgat | attgcttcag | gattggctaa | 36840 |
| agtagataac | gactacgttg | caatgcgaag | caaatcattc | gttaaggttt | ctcctatgtt | 36900 |

FIG. 20U sequence.txt

| | | | | | | |
|---|---|---|---|---|---|---|
| cgcaacaatg | tgggaaaacg | gaacgattt | cgagatttaa | tgctacaaga | ataacctgtt | 36960 |
| attattacta | catcaaaaca | aacaaggaaa | aagaatgaaa | cgtatcgcac | tgattgttga | 37020 |
| ccaagaagct | atgttcgctg | ctaccggtaa | atttcatccg | gtgagtaaat | ttgttgctcg | 37080 |
| cagcgagaaa | atcgttggtc | tggtagaaac | tgtcgcaggt | gatgtaattg | tttctattaa | 37140 |
| aacgtctgaa | atttctccag | tagttaaagt | agcagttgaa | aatgacttct | gggaagtagc | 37200 |
| tgatttatg | tgtgagtaat | tctgcctagc | aggtggataa | gcccgacaag | gcgccctctt | 37260 |
| cggagggctt | ttataaaagt | cataagattt | ctataaaggc | cctgtagctc | aattggtaga | 37320 |
| gcgttcccct | cataagggat | tggttgcatg | ttcgagtctt | tgccagggtc | accaaattaa | 37380 |
| tgaggaaaat | attatgatgc | gattagttaa | agtagttgta | gaagaatctg | aatacatggg | 37440 |
| cgatagccga | atgattgaag | aattcgttac | tgttgaggca | gattctgaat | ctgaaatcgt | 37500 |
| tgataaagtt | tatcgtcatt | ttgataatat | gtctgattcg | tatggcacaa | tgtatagcat | 37560 |
| ttatcgttta | gatgtaatag | tacatatcaa | ctgaggaaat | tgaaatgcat | attagatttg | 37620 |
| gacaagttat | tcctaaaggc | ttagcaatgg | caattaccac | ttgggaaaac | gatgctgatc | 37680 |
| ggtattctac | ccaaatggtt | tatggcttag | aaaaagaaga | gattaatcaa | gtaattcacg | 37740 |
| ttcttgaatg | gttctcttct | aatggtcggc | gtggtgaata | ccttggaaat | aatgattaca | 37800 |
| accatgaagc | aattcttgaa | aagcttcata | ctgaacagaa | gtatgtaact | cctgaatttt | 37860 |
| ccaagaaatt | ctttggcgtt | gatgttcctg | catatgattg | cacagacgaa | gagtttgatg | 37920 |
| cttatttaga | taaccactat | tcttgttcaa | atgaagttat | gtatgctatt | caggcttggt | 37980 |
| tgggtaatcc | aattgaatat | gattatgatt | tcatgcgagt | atttgagaaa | gtagaaatct | 38040 |
| ttgacattaa | agaagaaatt | cgtattcctg | atgctccagt | tgcattccat | gttggaatta | 38100 |
| cgtataaaca | aaaagaaagt | ccattaaaag | ttgattggtt | gaaatacgtg | aaggaaaagt | 38160 |
| aatggatatt | ggttcaggca | gttcatatcc | atcatgtgct | ttgagcaact | ttgctcctca | 38220 |
| taaatttatc | tatgatggcg | tagaatgtgc | ctcaatggag | ggattcttgc | agtccctcaa | 38280 |
| attttcttcg | cctgaaatgc | aagcacatgt | atgtacacta | gtcggaaagt | ccgctaaatt | 38340 |
| taaaggtaag | aagaaacgtt | ggtggccaac | tcaaacactt | tattggaaag | gcgtgccaat | 38400 |
| ccatcgtgct | tcagaagcgt | atcagaattt | actgacagga | gcatacgatg | cacttagtaa | 38460 |
| aaatgaagga | ttcagaaaag | ctttggctgc | tacccggaat | gctacgctca | ctcacagtat | 38520 |
| gggtaaaaat | aaaatttctg | aaacgatttt | gactgaacgc | gaattctgta | atcaacttta | 38580 |
| tcgtttgaga | aatgctataa | ataatcagta | atataattat | cttgttcagt | gttgaaatcg | 38640 |
| gtagacatgg | tgacgggcac | cttttgagct | cgcatattgc | atcatatgct | ggcgatggtg | 38700 |
| gtaaatcgcc | gacggaatca | gtcgtgcagg | ttcgagtcct | gcctgaacaa | atatttgcgt | 38760 |
| cgatgttgga | attggtagac | aaaggagact | taaatctcc | cgggattaaa | cccgtacgag | 38820 |

FIG. 20V sequence.txt

| | | | | | |
|---|---|---|---|---|---|
| ttcgagtctc | gttcgacgca | ccaaagccct | tatagtgtaa | tggatagcac | acgatcgttc | 38880 |
| taaggtcggt | agtccgggtt | cgagtcctgg | tgggggtacc | acgccgattt | agctcagttg | 38940 |
| gtagagcgct | tcacttgtaa | tgaagatgcc | gcgggttcga | ctcctgcaat | cggcaccaaa | 39000 |
| ttcgaaggga | aacttgcgta | taccctcgtt | gagtcgtcag | atagaagaga | atggttcgtc | 39060 |
| cattgccgca | agtcggttgt | tccctgtcgc | aagcataacc | tcctgacgct | atacttcttt | 39120 |
| ggatgagact | gatgcctccg | agtccaaaga | aatgaatttc | gcaggtcatc | tgccagtggg | 39180 |
| tgatgctgtc | gattattaga | gccctgtctt | cggacggggc | ttttagtat | aaatagtaat | 39240 |
| ttaatcggca | ctaaggattt | ttttgcaatg | aaatttaaag | attttttaac | cgaagaagag | 39300 |
| cttttgaag | cagctcctgg | ccgcatgact | aaatcgaaat | ggcgtgacgc | tctggtattg | 39360 |
| gttccacgtg | gtgaacgcca | tgattttagc | aaatttgcgg | cttctgtgga | aaagatttat | 39420 |
| ggtattggga | ttagcgatcc | taaagactat | gctaaggtag | cagctgcctt | tgaaagttta | 39480 |
| ggcggaaagg | ttactacacc | tgcacgtgga | gcttctccgg | cacaagcacc | ggccgcaaaa | 39540 |
| ccggctccgg | ttaaagcgaa | acctaaaaat | attcctggcc | ttaaaattag | tggagaccat | 39600 |
| ggagacatca | ttggttcagg | tgaactgttt | aaagctattg | ataaagctct | tccactagta | 39660 |
| agagataatg | gtcctctta | taaagcagtt | caattctatt | tcgataatct | gtggaagtat | 39720 |
| cgtgaatccc | aaggtgctaa | accttctgca | cgtgaaactc | agcatatcgg | tgaagtgaaa | 39780 |
| acactttag | ctaaactgaa | tcatcacctt | gttgaactca | gtcgtcagac | agaattatcg | 39840 |
| tacaatgtat | aataaaatgt | aatcctacag | ccctagaatt | catctagggc | attttgtat | 39900 |
| cctcggctgt | ataaatccat | tctatcttcc | agaaagttcc | tccagatgcc | ctaaaaattt | 39960 |
| ttgcacaaag | ttgtttactt | cctctatcaa | ctcggttact | atagctccat | caaacaaaa | 40020 |
| cagagtaacg | gagaataaaa | tgtctaaatt | caactttatc | caaattgaac | gtggttataa | 40080 |
| caattacggt | actcctgatc | gttatcgcgc | gatttggatt | aaaggtgaac | atgaacacgc | 40140 |
| agtgttcaat | gtagcagaaa | ctcgtgaact | taaagatttg | attaagcatg | ttcgtaaaga | 40200 |
| ttggcctgct | gttgaagagt | actacgttcg | agtttaccat | gaagaagctc | ctaccgaaac | 40260 |
| tgttcaaatt | aaattcgcaa | aaactgctag | tgctttaacc | aaacgaattg | aagctgtaat | 40320 |
| taactgctaa | taattttggg | gagttataat | gaactcccca | cctactgagg | aaataaaatg | 40380 |
| tctattctga | aaaaacttgt | tgaattcatc | cgttctaaat | tcggtacctt | tgttgcacag | 40440 |
| aacacttctg | ttgaagacca | gtatacgatg | gcagcaaacc | gtattattga | tgaaatcact | 40500 |
| aaactgcgta | ccacgcatgt | taaatcagta | aatgaagaaa | agcgtctgct | gaaacttgct | 40560 |
| gatgaaaaag | accaagcggg | tgcttctaaa | gagcgtgaaa | ttcgtcgctt | gatggcagaa | 40620 |
| ggtatgaatg | tagaaaccca | tgctaaactg | ggtcttctgt | atcgtcgtac | tgctaaggct | 40680 |

FIG. 20W

```
                                    sequence.txt
ttacgtgata aagctgccga atataaagaa atgcgggccc aaattgaaga aaccgtagtt    40740
aagcttgatg accaacgtct tgatttggca gtgaaactcg aatacatccg tgagacccgt    40800
aatgcttctg ctctgggtat tacctctgct gacgacgtga ttgaaatcgc agaactcgct    40860
aaagtagatg tacaagacat catgatgaaa gttgaaacct tcagcggtac tcagcctggt    40920
attgaaacca ccactgctga tgtccaggaa tatctggaaa gtctgaagta attttaccgg    40980
ggccttcggg cccctaact tggataataa aatgttatat gaatgcgctg gagatattcc    41040
aatggcaaca cctcaaatta aagaattaat tgcagcagga ttcccaacag aaatcactga    41100
tattcttgga aaatttgctt atcctgatac tcggcctgaa aattggaaaa ctcgctataa    41160
cgggtataac accacagttt taccgcgggc tatcgttctt aaagactatt ccaagctgaa    41220
aaacttaatt tctaatattt cgtctatttc cgacggagtt aagcttgtgg atattttgc     41280
acttcggtac ggaatctact cttttaacga ttctccatca aatttaaaat cagcccgtac    41340
taatgccggt gaatactcta cttctggttc aacaacgtac accatagtta ttgagattat    41400
tcataataaa aatagctatc gtcttggtat taacctagtt aaatatgtga catctcagga    41460
tgattatagc aattatttaa attactgtgt taatgaattg ccatcaaagg ttatgagtat    41520
gtttgactct aacaacatgg taggcaaaca attaatcatt gatgaattta tcaaatactg    41580
ccgtgagagg gtgcagaaat gagtaactta tatctgccaa gtgaacctcc cgtttataat    41640
tatgtctata aatttgatca gattgattat gcccttgttc ctggtattgg tgcaactgtc    41700
ggcgcaatgt gtacctttgc cgcgattgat atcatgcatt taactgatat tacaccggca    41760
gtgttattcg gaattctgct tgcatggtgg ggaactagtt tgctcatcat gggattaatt    41820
gaatgttccc gatgggttaa atggtctcgc aataattata agcgtaaagc tgaatggaaa    41880
gaacagtgca agaatttaac tcttgaatgg aatcgcaaaa agtcgtttga gtttattaaa    41940
gaggtgagaa gaaaatgaat gaatataaac ccgacggatt ttggaatcaa gatgggctcg    42000
cgccaggttt tggaattgtg acatggcttt tatattgtgc tttcgtaatt gttggaggga    42060
cattctttgg attgaacgtc tcagagttta tgattatgct tttattttta ggtgttttcg    42120
cattcagcct catgtggatg ctaattatcg cgttgattaa ttgctgtaca ttttagctt    42180
accgaatgaa atacaagaag tggaaagaaa aagaagattt caacacctgg attaggagct    42240
gcagaaaatg attaaaactt gctaccgtgg aatgattaaa agcgatgagc ctgggtattt    42300
cttcctattt ctgcttattt ggttttcatt atcagccttt gttggatttg gaacattctg    42360
ggggttctac ttcttttctc cagtatttgg cgatgcgtta tattacatag gctggatgtc    42420
aggtgttgga acttggtttg caatacttgc ccggtggttg caattcgttt cccagcggca    42480
gaggggtgta ttcgataagc ccaaagtaaa gaaagaaaaa tctaaagatg actctcgtag    42540
tgaaacttta tcctggatta aggagatgaa ataatggctg ttgcagtgca tgtaaaattt    42600
```

FIG. 20X sequence.txt

```
gaaaatggtg atactcgcct tctgtgttac agtgataatg aatcactgag cggtatcgag   42660
atttcactca aagaagaact gcttggtatt aatggaccta tctgtgattt ctcggtagaa   42720
ggttcggata attgtaatga tgatttggag tctatggtct atactgccat ggaagatatt   42780
cttgaagaaa gttggaacga atgccaatga aagagctcag tgcaggaatt ttattcttta   42840
ccgatgacaa acggctttta atgggtcgta tgacaaatac atatgtccag ggcagaggct   42900
ctagatggga tattccaaaa ggacatgttg agcctggtga acaccaaaa gaagctgcta   42960
ttcgcgaatg caaggaagag actggattta ctgagtttga ccaagacctc ttatatgacc   43020
ttggacgaca tgattatgca agcaataagg atatccatct gtttggatat atgctccctg   43080
taagcccaga aatgttcaga aattgccgtt gtacagctta ccataaagat gaaaatggaa   43140
ttaattttcc tgaaatcgat gcatttgctt taattaaacc aagccagtgg aaatatgtga   43200
tgggaccaag tttatacaaa atcatgacgc aaatgtatag cacagctcag tgaggttatt   43260
atggaagaag ccgttgaatt aggcattcca cacatttata acatgagct acgatttatt   43320
cacgatggaa aatggattag catatttcat cctagggata aaatgtcgcg tatactaatg   43380
aaatcacggt atgtcttcag tgatagtgag tatataaaat cagcatatta tatagcagaa   43440
cagctatatc cgggatttag tgaattgccc gaggacgata aaagagatta tgtgtggtgg   43500
aaagataaat ggacaccata cgagaagtgt agccttgagt tattcatagc caagtgcagg   43560
gccaaataaa tactcctata aattaatagg aggtccttat ggatattttt ggcatgttgc   43620
gtattgatga aggatacgac agcaaaattt ataagatag cgaagggtat tggactatcg   43680
gtattggtca cttactgact aaagacccgt caaatctttt ggctatttct aatctggaca   43740
aactggtagg tcgttctacc ggtggccaaa ttactcaggc tgaggcagaa gtaattttg   43800
ccaaagatgt tgagaaggca attaaaggta ttgttgctaa tgctacatta agcccggtat   43860
ataatatatt agatgatgtt cgtagagctg ctctgattaa catggtattc caaatgggtg   43920
tgtctggtgt agccgggttc ccagcttcaa tgaagttatt actcgctaaa aaatgggatg   43980
ctgctgccaa ggaacttgca aattcacgtt ggtatcgtca gacacctaat cgtgctcgtc   44040
gtgtaattga aactatgcgg accggaactt gggccgctta tcaaggaaaa taaatgaaaa   44100
cctatcaaga atttttaaat gaatcccgtt tagcaacagt tggcgtaatg actgaatctg   44160
ttggaagtaa tcttctgaaa tttaaaaaag gtcagaagat gacagccacg ctagaagatg   44220
gcacagaaat tgaaatggac gttgttggat ataactacgt agtagacggc aagttatata   44280
ataagagcca tgctaagttt gattcattcg atgattttgt ctcttcggtt gaagatgaat   44340
cttctcgcaa agcagtagca tctggcgatg cacgctcttt aatgcccat ggacatatgc   44400
gtattaagtc taagcagaac aaacctggtg aagataactt tgcattagta ggttatcagt   44460
```

FIG. 20Y sequence.txt

```
ctggtaaaac ttctaacggt taccagcgta cggttaccat gtacatgcgt aatggtaaaa      44520
ttgcattcgt aaacgatcgc ggcgctattc gttacgctaa atcaattaag taagcaattt      44580
cctaataaag ccgaacacga cctctcctca tgaacgtcga gtcctctgag tgaagtagct      44640
tttcctacct gtaataaggt cgagcgcaag tgcggtaagg ggtttacata gtgtgtcgat      44700
ggattaaaca tgtgccaagg aatggcccca tttaatttaa aacttttacc tttctggatt      44760
taaaaatgaa aacttataaa gaatttatca ctgaagcgcg agtgagtgca ggtaaattag      44820
aagccgctat aaataaaaag gcccattcat ttcatgattt gtcagataaa gaccgtaaga      44880
aacttgtaag cctttatatt gacaaagagc gtattctcgc tcttcctggc gctaatgaag      44940
gtaaacaggc caagcctttg aatgctgtcg aaaagaaaat tgataacttt gcttctaaat      45000
tcggtatgtc tatggatgac cttcagcaag cggctatcga agcagctaaa gtaattaaag      45060
gtaaataaca gttactttc tcctagaatt gtgatagtat attcatattt acatttaaac      45120
aacattggaa taacctggac ctcatgattc tatgagggat tcccgcctac ctgtaataag      45180
gtcgagccca agtgtggcaa tgccagttac ataaggtatc ggaatggact cactccatgc      45240
gccaaggaat ggcccccatta aaagagagct tatgaaatac ttaacaccaa tttatttgac      45300
cctgatgcat gctttcaaag acgctgcaga cagacgatta ataatccca actacagttt      45360
ttatgaaccg tcttgcctta tgcgagagta cggtacccttc cgtctagatg gtggaagaca      45420
aaccggaaag accgcagcct tatgccaatt cgctaccgat tggttgcttg aagatggttc      45480
ggttataatc ttatctactc gatacacaca atcatctgaa ctgatggaag gtattctacg      45540
agaatataat tcatcgcatt taattaataa attaccggct aacgagatag ctaaatcaat      45600
tgttccgatg acaatcaggg aatttctatc caatgattcc tcttataagt ttagaggaag      45660
aaagcttgga agagcattaa ttatcattga agaaccaatg aaagttcccg atatgatgaa      45720
gttctatgat atgtaccagg aagctatcag atggtctatg cctaatgata ccttaccttt      45780
atttttcgtg ataggaatgc aatgatgaca cagacagaaa ttgttgatat gattacagtg      45840
atggaaaata caggatttgc cgatatgaag caattaataa caatggttac ggctggcaac      45900
ctgcttgagt acaagcgcta caagtttctg tctggcccgt tcaaaggcgc agaattcatt      45960
tctaatgctc ctaacacgaa gtggatgaat cgctatccta attttagaat tgagtttata      46020
tctggtaagc taaaaggcgt gattagttca agcttaatca catatgacca acgcattcaa      46080
gagaaaacaa tgcaatggct gaaattgtta taaggtgtcc tccacaccta gttgagagct      46140
tctgtgaatg gttcagtaat tctggtgagc aagatttta tgaagctcac cagaatggaa      46200
cttggaatga acaaccaaa cagtgggaag aagctacaac gtatataggc actcgcggat      46260
atggagttaa cgagcctatt gaaattgtgg aatacgataa agaaactgat gaagaagtta      46320
cttatcatga agataaaaata acttatctag aagcagctgc aaagtttcat tcagacgaat      46380
```

FIG. 20Z sequence.txt

```
ggaataaaat gagtgtaatt accgcataca tgcgtggttg gaataaagaa tctaattaag      46440
aggaaatatg aaagcatatc aaattcttga aggtgaactt aaaggcacca tttacatcga      46500
agatggtgat gacgcacgag taatcgtttc aaaagttctt aaagaagata ctattacgga      46560
tgctgaaact ttttatggct acaaggctcg tgaagtagaa attgaatacc agccaacggt      46620
aaaaattgaa ggcggtcagc acctgaacgt taacgtgctg cgtcgcgaaa ccctgctgga      46680
cgcggttgag catccggaaa aatacccgca gctgaccatt cgtgtttccg gctacgctgt      46740
acgcttcaac tccctgacgc cggaacagca gcgcgacgtt atcgcccgta ctttcacaga      46800
ggcactataa tggcaattga agatatcaaa ggatataagc cacataccga tgaaaaaatt      46860
ggtaaagtga atgctattaa agacgcggaa attcgtcttg gattaatttt caaagcgtta      46920
gaagaagaac atgttgaaaa gtacatgaat ttagatgtta gcacaatgag cgacaaagaa      46980
tttgatttag cacatgagcg tattactcaa attcgcaacg cgattcaaca cttgaaggaa      47040
gcttctatgt gggcatgtcg ttcagtgttt caaccagaag aaaaatatta aaaagtagtt      47100
tactttcctt acgggccatg atactatggc cctacaaaca aaggagaatg aactatgtca      47160
actaacccag aagtattcat ccgcagaact aaactacgtc gtaagtttga ggaagcattt      47220
cgctctttga atttatcagt tcgtgcccga gctaaagctg agggcaaaga gcctttcttc      47280
actaagtact ctgatcattt gttggaccgt gctatccaac gtgaaattga tgaagagtat      47340
gtattctctg ttctttccaa aattcctaat catcttaaag aaattaatga attcttagca      47400
atgccttggc ttccaattga cccaaaggac attgatgaaa acattgagta taagccaatg      47460
cggttagaaa ttacggatgg aaatctgtgg ctagggttta ctatggatat tccaagacca      47520
ggaaaaggac ctagtataaa gtgtcgtatg gcattcgtta atgataaacg tttgaaaggt      47580
aaaatcagca caaagttat acacattaat tgaggtaaac atgaaaaaag cgcttatcgg      47640
tctaatggcc ttatgttcaa cggcctttgg gtctgagcca actttcagta atgttcaact      47700
tgacaacttg cattacgcat ataatttttgg tgaacaatat caaaaatccg gaaaagaaaa      47760
atctccgcat aaccgatatg ataataacgg cttaggatat ataatggctg ctatatcatg      47820
gaaagaatct tcggcaggag ccaatttaaa agcaggaaag gggcatcatt cttatggggt      47880
atttcaaaat tacttgccta cggttaaagc cagagctaaa ttagagggca aaaaccttag      47940
tgattctgaa ataagaaaaa tgcttaaatc tagacagaat tccgcggaat gggcatatat      48000
tgagctttca tattggttaa atatacataa cggcaatatg cgaaaagctc ttgctagtta      48060
taatgcagga tggaatgtca aaggggaaa ctcttatgcg tcagatgtcc tagagaaagc      48120
taatttctta aaaaaacata aatgctaca tacaaaggtg gaataatggt aaagtacgcc      48180
gcgcttcttg gattggtatt ggcattctct gctaatgctg aaaattcaat gacagattca      48240
```

FIG. 20AA

```
                                sequence.txt
cttcgtatcg ctaaaacatt ttgcaatacg aactctgaat gtgttgatat attagcgctt    48300
gaattagatt cagcattcag cgatggagta aaagattcac gtagcccggc tcagtggaca    48360
acactaataa atcgtaaggc taagagcatg aaagatttat gtgtcaatgc tcctaacgaa    48420
aatatatgtt taatgtatcg tgaccaatta atggctcgtt atatgtcagg actatcgtca    48480
aaatgaaaaa agcggctatt ttattatgct gcgcattttc agttaatgcc tgggaaaaac    48540
tcccaggcta tcctgaaact gtacttgcag cacagggtac taaaatagaa agcaatggcc    48600
cattcaagaa caacattgaa atagcatttg ttcctagcag cagaaaattg ctaatgtcat    48660
tttataatta tcaagataaa gatgaccagg tgatagttcc acttgtcgaa tataatgctc    48720
gtggatgtgg aatgcagagc gatggcgttt ctgttgatgg agtaatgcat cctaaagaac    48780
aaggagtgct gaaccctatc cttaattgta acaatgctat attttaaga gtatacaata     48840
atcttaatga atatgcaaca tataaaattc cataggtgaa taaatgatta ctggatatat    48900
taagggcaat attgtagaac tattcatgaa gcatgaatgc gatatcgctc atgggtgtaa    48960
ttgctttact acaatgggtg ctggtgtagc aggacaactt gctaaagcat atcctccaat    49020
tctcgatatt gacatcgatg aagaccgtta ttatgacaat aatttagcca agcttggaac    49080
tcatacacga gccattcaca aaaaggcac tgcatattgc tataatctgt atactcagta     49140
tgctccaggt ccaaacgttg attacggcgc aatttttaat gcattccatg aactaaattc    49200
tggtcgtatt gtttataatc gtcctctata cattccaaaa attggagctg gtattgctgg    49260
cggtgattgg gaactaattg agaaattaat caatttagca cacctgata ttgacattat     49320
ggtggtagaa tatgaagaag ctaaaagcta atccgtctt gtagaggtaa atagatgatt     49380
actgaagagc aaaaaactaa actgtggcag ttgattgacg attatgcagg tgccgagcaa    49440
gtagtagcta ttagtgccat ttacggaaat ggtctacctg aagaatacga tgaactcatt    49500
cgttctaaga atgctatttc tgattttatg gagacacttt aatggcacag ctttatttca    49560
actacgcgag catgaatgca ggcaaatcag ctaaccttct tacagcagct cataactata    49620
aagaacgcgg catgggaact ctcattctga aacctgctat tgatactcgg gattcggcaa    49680
cggaagttac ttctcgtatt ggtctacgtc atgaagctaa tacagtagac gaatctattg    49740
acatacttga attttcaag tgggcacaaa cacaacgtga tattcattgt gtatttgtag     49800
atgaagcaca attcttgact gctgaacatg ttcttcagct atgtaaaatc gttgacttgt    49860
atgatgttcc agtaatggca tatgggcttc gcactgattt tcgcggcgag ttattcgaag    49920
gttctaaagc tcttctttct gtagccgata aacttgttga gctcaagggc gtttgccact    49980
gtggacgtaa ggctacaatg gtagctcgta ttgacgaaaa cggaaatgct attaccgatg    50040
gtgaagtagt agaacttggt ggtgaagaca aatacgtttc tctttgtcgt aaacactggt    50100
gcgaactggt aggtgtttat aatgaagcca agaacgtata acactatcct gatgctagtt    50160
```

FIG. 20BB sequence.txt

| | | | | | | |
|---|---|---|---|---|---|---|
| ttaagtatgt | tattcatttg | gatgggtgta | gcagcatcta | ttcaaagcga | tagacgagaa | 50220 |
| gaacttcaaa | atcgtcttga | ttctggatgc | aaagtattag | ctcagggtaa | agactttatt | 50280 |
| gctaatacaa | atgggtgtta | tattaaatat | gagtagccta | tttgctatag | cgggtgtata | 50340 |
| gtactagtac | tcgtgattgg | gttttactaa | tacgtaatat | ttctttcgtt | attggtttaa | 50400 |
| tatgaaaaaa | tatgtgatgt | gctatcgttg | tcttcatgta | tatgattaca | acactgctcc | 50460 |
| aaagactgct | accaagcgtc | ttaaaaccaa | agaacctgaa | tgtccaaaat | gtaaatgcaa | 50520 |
| ggtcatctat | tcatgaatat | taaatttttc | aaatcaggat | tttactatcg | ttgaggtaat | 50580 |
| ttaacttaac | gaggtaataa | tgtctagaac | aattcgccgt | aaaggctggc | atgtagtaaa | 50640 |
| atcttccaaa | tggaacgatc | agaataataa | cgaatttgct | tatattaaaa | gctataacga | 50700 |
| atacgttaaa | actcagaaag | ataaagaaaa | ccagcagaaa | tatgttgaac | tgcgtatttc | 50760 |
| tgaaaacagt | gaaagaccgt | tagaggccaa | gaaactgatc | gctaaatcaa | agcgcgatgg | 50820 |
| attctggaaa | actctacgtt | ggacccgtta | tgctatgccg | gttccgcgtt | tatttcataa | 50880 |
| agccgaaatt | aaacgtgcat | tgaagtatga | tgaagaatat | aactgggacg | aagctggtgc | 50940 |
| tagaaccatt | gagcaaggca | tctgcgaatg | gctttgggat | taagtaacac | atacttatat | 51000 |
| aaatactatt | actaactgat | gaggtgtata | tgcagcattt | aagtgaaaag | caacttcgta | 51060 |
| atcttactgt | agagcagctg | gacgaacttc | gtcgtgagat | tgggcatggt | atttcgcacc | 51120 |
| ttcaggaaga | aattcgtcaa | catagttcaa | aagcagatta | tacccgtaaa | cgtacgctgg | 51180 |
| aaaaatacct | caaagaagtt | aaggctgtac | ttcagcacaa | acgtaatact | ggacaaaaat | 51240 |
| aataggaggc | cgtatggcct | ttaatcacat | ttgcttagcc | ctggtgttgg | gctgcgggat | 51300 |
| ttcattccca | gctgcatcac | acgacgacat | ttcagattat | aattcgtatg | ttgagggagc | 51360 |
| tctacaagtt | tatgctaaat | ttaaggagcc | tagtaagcaa | gagtctgaac | agttctatgc | 51420 |
| tttcgtacaa | agtaaatgga | agagcgagtc | ttgttctaaa | gattgcgatt | ctttaggacg | 51480 |
| ttcagcaggt | gaagaatacg | ctaaccgtat | gaggatacaa | ttcgataatg | aagttcaatg | 51540 |
| attttgtaaa | ggacggtaaa | cttactccgc | aggatgaatt | catcggttta | cttatggtgt | 51600 |
| ctcaagcgta | ttttcattca | gcgcattttg | ataccaaatc | gtatgccaga | cataaagcgt | 51660 |
| atgaagtttt | ctttaacgag | attccagatt | tgatagatgc | ttttggtgag | cagtggttag | 51720 |
| gattctcagg | taagagttat | acaccggctt | taccatcgca | gaaagagctg | ccaaaggaca | 51780 |
| ccattgaaat | gctagacttc | attctggcta | aggccgatgg | tatctacaag | tccgttcctg | 51840 |
| ccgccctcca | aagtgttctg | gatgacatta | caggcctatg | ctacaagact | aagtatttgt | 51900 |
| tatcattgca | gtaatacct | ccgcctcctt | cgggaggcat | tttcttttca | aaagttgtt | 51960 |
| tacttccctt | cattacatga | tactatagac | atatcaacaa | ccaaacgaga | aaaacattat | 52020 |

FIG. 20CC sequence.txt

```
gattaagtta actaccgagc ttcaacctgg aaaaatcttt tatcacgtgt gtggtgttaa    52080
tcgcacagaa actaaacccg gcgaaataac gcgttacatt gttgcttcag gcacatatga    52140
tgtagaactt ggtcttagtg gtgtatattc acgtaaatct cctttcttcc aagtgatttg    52200
tgaatatgaa aactatgctg gccaaactga aagctattca actgaacggt ctgcccatga    52260
tatgggtata ttcaagccag gtgaaaagcg ttcggttcat aatcttaatc gtgggttttg    52320
gacgcgtgaa gaagctgaac agttcatcaa agagctccaa gaaaataagt tcagcgatcc    52380
agatgatcaa gcatatgcag acagactgac cccttctgaa gatttccgcc gtcaacaaga    52440
atttatggat tcttatcttg acagttgtga ttatgattac tacgactttg atgatggcga    52500
agaatgagaa acgttttact tatcatctac attgtggtac aataccagca tccgatgttt    52560
acatataatt tggtgcaaat gattctggag agtttgaaat gaatggatgg ggcccatcag    52620
atgacggatt tgcaactcgc gaagctacaa tagcagacgg gattgaatgg gcccgtcttc    52680
agaaacaact ccaagaacag cgggaatccg aagagttctg tgttgattgt gatgaggaaa    52740
tcccagtagc tcgtcgtctg ttggttaaag gctgtcaacg gtgtgtagaa tgtcaaggaa    52800
agtgggatac agtaatgact tctgcttata atcgccgtgg ttcaaaagat tcacaattga    52860
ggtaattatg gaaagtattc ttgatagtac caatttagat aatccgtaca gcgatgtgca    52920
tgtaaaggtt gtgaattcgt attttactaa aaagttgagt cgtgtcgtgc taaaacaagg    52980
taatgatata attcatcttg atactaaaca aattgattca ttaattcaat tcttgataga    53040
ggcaaaagat ggcgagtaaa ttagtatggg acggaaaacc ccgtaaaggc gatgcagtaa    53100
ttgaagatga agcccgcat gttattgatt tgtatcttac ggtattccac acgtatgaac    53160
ataatactat catcgaaatt gaacgtgacg gagattgtgt agctattgat aaaagcgacg    53220
ctattgaact ggtcaaatat cttaccgcaa tgattccaac tatgaaacag gataacttat    53280
aatgaatatc aataaaaatt cttggcattt caaaatgaac ctatggttta aatctggcaa    53340
tatatggaaa atgccaaaaa ctctatgtgg atactttggg accacagtac ttcatattct    53400
gttctcttca gcaattgcta tattcattgg ttctgttgca tggatgttcg gttggccgct    53460
tatagcgcag acgggtattc tcgcttggat aggtgttagt ttatccgcct tttggctaaa    53520
tgttgtagca gtaccagttg gtgcagtgtt tatagcaaca tttgtgcttg cgtttgtagc    53580
aatagtgttt ggatttattt tcggtttaga aaaatttaaa gaataccgta aaataaaca    53640
atttacgaag aaacttgctc gagtaaaagc tggtcttccg gcagaatccg aaccgttagt    53700
attcatccag tatttaaaag ctcgtaaacg gaaagtttgc ccaatgattg attatgtaga    53760
aggtaaaact agtgaagaat gatcaagttt atatcgtgaa cggccgaaag gccgtctttc    53820
gtgctaaaac tgaacgtggt ataatttcta catacccta tgccgaattt acttttgaag    53880
atggcgagca gattaaaatt aaatatgttc cgttatctca gacgtaccga ttcatcggcg    53940
```

FIG. 20DD sequence.txt

| | | | | | |
|---|---|---|---|---|---|
| gcgaaattga | tttagacatt | tattatgaag | gtggcgtatg | gaaattgaaa | tcgtaacaac | 54000 |
| caaaaagaaa | ctctctatga | gcttgcttaa | gcagatgaaa | atggcaagct | cttctgaaat | 54060 |
| caaattcgca | atgtttgacc | gagttcatcg | tgttcttgga | tatgttaatg | cctttaaatg | 54120 |
| gaacaaaatg | gatatccaag | tagcaatcat | taacactggg | aacgattggg | cattagttcc | 54180 |
| tatgtatgat | acacatgtta | ttaaaaccgc | ccggcgcgaa | ccacatccag | acggtcaaga | 54240 |
| atatcatttc | catgacgtag | tatactacca | tactatgcag | aaaatcggga | atgttcatcg | 54300 |
| caattctaag | aagagtactg | ataaagaaca | tgttgaagcc | tgtgctaaag | cctcaaatga | 54360 |
| tttgattaaa | ttcgctaaag | ggaatcatat | ttacttatga | aaacaatcgt | aaaatcttat | 54420 |
| tttggttcac | atctgtatgg | tacttcaact | cccgagtcag | atgtggattt | taaagaaatc | 54480 |
| tttgtacctc | atccgcgtga | tattctaatg | tgtcaggcga | tgaaccacac | caattgtaat | 54540 |
| actaacaaca | gcgcaaccaa | aaatacgaaa | gacgacgtcg | accatgagct | gttcagctta | 54600 |
| aagtatttct | tcaagctcgc | tgctgacggt | gaaactgtcg | cgttggatat | gctgcatact | 54660 |
| ccaccggaat | tggtagttgc | atctgacctt | cctgaagtat | ggaaattcat | tcaagacaac | 54720 |
| cgagctcgtt | tctataccac | tgacatgaaa | gcttatctcg | gatatgtccg | taagcaagca | 54780 |
| ggtaagtatg | gtgttaaggg | ttctcgttta | gctgacctgc | ataaagtcct | ggatgttatc | 54840 |
| agagatgttc | ctgaatggaa | atatgacgat | cgtcctcagc | agaagggtat | caatgagcgt | 54900 |
| tggaaagtac | aggatatcgc | agagaaactt | cctctcggtg | aattcctcga | atggaccacc | 54960 |
| ttcgttgacc | acaaatcagg | cgagcagaag | ttttataacg | ttctgggtcg | taaattccag | 55020 |
| acgactatca | ctatcaaaga | gatgaagtat | tcccttgaga | agcttgatgc | tgaatacggt | 55080 |
| gaacgtgctc | gtaaggcaga | agctaacgaa | ggcgttgact | ggaaagcact | gagtcatgct | 55140 |
| cttcgtgcag | gtctgcagct | tcaggaaatc | tatatgactg | gtgaccttca | attccctctg | 55200 |
| acccatgcta | aaatggtcaa | gatggtcaaa | gcaggtgagt | taccgttcaa | agaagtacag | 55260 |
| gagcttctcg | agtctgtagt | agatgaagta | gaaattctag | ctcatactgc | tgaaaagaac | 55320 |
| ggaatgccta | agaaagtaga | catgaagttc | tgggacgatt | tcgtcgagaa | ggtttatctt | 55380 |
| gaaaccaca | attcttacta | caaatgatac | aatgaaggtc | ttcttgaatt | atggaagacc | 55440 |
| tcataaaggt | agacggtggt | atttggaagc | agtttgcaga | gagactggtc | gtagagaaaa | 55500 |
| tgctaaattc | tctgctcgac | caactcgaaa | acaaatccac | caatttatgt | catgggccgg | 55560 |
| agaaactctc | cggttctcac | tttactgggc | tgaaatatga | ttttactttg | gagcgtagta | 55620 |
| gtgccaatcg | ttgttgcaat | aatttacttt | atcgtgggtt | ggtctgtctg | taaacatcta | 55680 |
| atcaaaaacg | gaactattga | gaaggtagga | gagtattggt | tctatctcat | cttttggttc | 55740 |
| cctgctttta | ttgttggagc | gattatcatg | ttcttccgct | gggcaggtaa | acttccaaag | 55800 |

FIG. 20EE sequence.txt

```
cgtatcgcag aaaacgctat caacaagcac gcataactga ggagccttcg ggctcctctt    55860
tttgtttcaa aagaatgcat aaagtagtat acaaactcgc gggctggtga tactatagac    55920
ctgtaccacc caaacagata cattggagaa taaaatgaaa actttagaaa tcgtcgtaaa    55980
caacattgat aaagccttta aagctgctga agcccacggt gtagaatttg aaccaatgat    56040
ggtgggagaa gcgttctcta agcttgctat catccgtggt gaaactgaca acttgattga    56100
ttttgtggat gacttctatc tcggttcaaa ggtccgtcct tactacatca atgaaatttt    56160
agaaaaataa ttaaaaagta gtttactttg gagctgtaga atgatactat agctccatca    56220
aaacaaaaca gagtaacgga gaataaaatg tcaactatca ccatcaagaa agggatttac    56280
ttcggcaaag agatttcagg tacttatgag ttactcggtg agtggttccc ggatagctta    56340
agtgctgaag attctcgcca gggtgatggt aaagtctttg ttgaactgaa tggcaaaaag    56400
cgtggtgttt gggtattcaa agatgatatc acaattgacg gagtagctgc taaaattgaa    56460
gttgttgaat ccgttgatga aatgaaagag cgtatcaaga aacgctttaa cgttatggga    56520
ttaatgacta acggtttaat ccacgggaac attcgttctc tgattatctc cggagcagca    56580
ggtatcggta agacttactc tttggataaa gcattacaac atgctcatga tactaacgct    56640
attgattaca aatcagtgaa cggtaaaatc tcaggaattg gtttatactg ccgtctttgg    56700
gaatcacgtg aagcaaattc agttctgctt attgatgatg tagatgtatt ctctgatatg    56760
gacattctta accttctgaa agctgctttg gattcagggg agaaacgtaa agtatgctgg    56820
agcactgcat cttctttctt ggaagataaa ggaattccta atgagtttga gtttgaaggt    56880
actgtggtct ttatcactaa cgttgatatt gaccgtgaat tagagcgcgg ttctaaactt    56940
gctccgcatc ttcaagcctt ggtatcacgt tcggtttatc ttgaccttgg tgttcacact    57000
aatgaagaga ttatggttcg tgttcaagat gtaataatga ctacttctat gttacagaac    57060
cgtgggttaa gaaattctga agttattgaa gttttggaat ttatgaaaga taacgtaaat    57120
cgtctgcgta acgtatctct ccgtactgct ctttatatcg gtgatttcgt tgcgactgac    57180
cgtaaaaatt ggcggacaat cgctgaagta acaatgctga ataatttaa acgggaggag    57240
aaatcctccc taactgagga aaatataatg gctactttaa tttctaatga tgtaaaacgt    57300
gttttgttta aaggcggaat gtatatcgtt gatactccta aaggtgatac ctcttcctgg    57360
actattaacg agtggattaa ttacattgat gaaaacggag cgtgggtaca atgagtttag    57420
cagctattaa agatattgaa tgttggttaa acgatattaa agtatatccg cctggtcata    57480
tctttgcagg taaacccaag ggtaaagcag agaaagcttg tgaagcaatc tgtgaaaaac    57540
tttataagtt taattttggc gataagaaaa atgtattagc tgaagtccat tcttcttatc    57600
atgaattacg tgtaatggta aacgtatttc gtgctcctcc attcattgag ctcaggaaag    57660
aatacgctaa taaagtattt gatactttcc ttgcaaatgt gcaggatgca gtaaagcatt    57720
```

FIG. 20FF sequence.txt

| | | | | | |
|---|---|---|---|---|---|
|tagacgaaat|gcataaacaa|caccaagatt|taaatgccta|ttataagcct|tggcgtaaat 57780|
|cataccaaga|gcttaaaaat|cgtattgaac|ttattcgtta|tgaggtgcta|aaatgaaaaa 57840|
|ctgggtaatg|acggaaagtg|aagcctatgc|agcgtatgtt|tcaccagacg|atcgtcgtag 57900|
|tgagttgttt|ggttattatg|gttcatattg|cgttgccgaa|gaagcagtta|aggggcagtc 57960|
|ttggtggggc|tcagatggta|cagttaatcg|taagccaacg|gaactaatta|cattcaccga 58020|
|tgaaaatggc|gaatcatgga|cttttcctaa|aagcgctgct|attagtgttc|aggaagaaac 58080|
|acctgaagct|aagcgtaaac|ggttggaaaa|aattaaagaa|tccgctttgg|ctaaattaaa 58140|
|tcctgatgaa|cgcgaggcgc|tcggattatg|agtaaagaat|ttagtactac|tcgtatggta 58200|
|gatgcttttg|gatatccgtg|caacggttat|cgtgaattta|ttcacccgga|agttgaaaat 58260|
|caatttaaag|aagtcgtaag|aaatattttg|ctcaatgcat|ttaaaactca|aggaactaac 58320|
|ccgagagatt|taggcattta|tcttgaagaa|gccatcagag|acgtacaaaa|gagcgtatcg 58380|
|gctaaacttc|attgggctga|agaaaatatt|gcttggtcaa|acaagaaacg|ttctgattta 58440|
|aattggcccg|ctgatcgtga|acaaatcgtc|aattatgcta|aagggtaacc|catgtttaat 58500|
|actatagtgt|ctatacatgc|gtattacgaa|gggcagttaa|atgctgcccg|aaccaagtat 58560|
|aagcgaggaa|tggaggaatc|tgtggaatgc|cttaaagata|ttcagacatt|tgcccagaag 58620|
|acccagaacc|tcatcttgat|ggaccgtaaa|caggtctcat|tggctgaaga|gctaaaagcc 58680|
|tctaagatga|ttatagaaga|caataggaaa|caccaactga|aattgcttaa|acggcgacaa 58740|
|caccagtcgc|catggtttaa|cagtgatttc|cgatcttttt|aagggccttc|gggccctttt 58800|
|gttgtttaca|tcttagaaaa|gccatgataa|gatagcttcc|gttaactaat|gaggagattg 58860|
|aaatgaaagc|acctacttgg|aacgaacttc|aagaaatgtt|caatactgaa|gaagcttttg 58920|
|gaactatttc|tgaaatggtt|gagaatttag|tagattctcc|ttcagaagat|aatcttctgt 58980|
|gtttagcaca|gttcatcatt|gaaacttaca|tagagaatca|gaaatgacag|tatacgtaga 59040|
|tgtcttgatg|aatcatggtt|ggaaaatgag|aggtcatcaa|gtaaagaact|gccacatgtt 59100|
|tagcgacaat|cttgatgagt|tgcatgctat|ggcagaagcc|atcggaatga|acgttcttg 59160|
|gttccaggat|aagcgagttc|cacactatga|tttgcgtgat|gttcgtcgca|agcaagcagt 59220|
|tgctctagga|gcagtagaag|tatctcgtag|agacgcagtt|ctgctttgga|gaaaatttt 59280|
|cacaaagtag|tttactttcg|gcgaggctgt|tgataagatg|gtctcgtcaa|ccaaactgga 59340|
|gaataaaatg|aaaactttaa|ccgagattat|ctctgcactt|gttgaagaaa|atcgtgtagc 59400|
|ccgccaagca|caccgagcga|aagttgaaaa|acgcgccgag|gagttgaatg|ctggatgggc 59460|
|gaagacccgc|ttcggtcgtg|aatactttga|taaagtggta|gctcctactt|ggggcaaaga 59520|
|tgatcgtcct|catgctccct|ttgatggtta|tctttgggaa|aatgaattag|gtgaagttga 59580|

FIG. 20GG

```
                                     sequence.txt
agcttatcac gcaggcagtt acttgccgta tgttacagaa ttggattcac tggataagcc    59640
tgagtatacc ggtgaccacg gttggtggaa aatccgctta actcaagaag agtacaaaga    59700
acttcgggag tatggttatc ctcttgaagt acgcattcca tataaagagt ggaaattgca    59760
agatggcaca aatgttgtta tggcagaagt tagagctcat aagagcatct tagaggctat    59820
ccaggaacat tcaaaagagg tctttgataa tatattcaat gagctgaata agaataaagg    59880
ggatgcaccg gaaggacgag tgaccgtctc tggtacagta acgtcagtaa aagtttatga    59940
agactattac ggcgtacaat gtaagatgat ggttgtgctt gagaatggag ctacggttta    60000
cggctccctt ccaaaaagta ttccgtttga atacagaggc aaagtacagt ttactgctac    60060
atttgaatta gcgaaagatg ataaaactca tgctttctat aagcgtccaa gcaaagttat    60120
tatgcttgat gaatagttgt tgtataatgg gttcagggag attttgagat actctttgag    60180
cccagtccaa aatagaggaa aagataatga ataagaatga attaaagatg tttgtagaag    60240
ctgaatttaa taagttgaaa gataaaactc tcacgaagcg tgagaaacat gttaaggtgt    60300
tatcagcttt acatgattta aatccaaggg cttatgatgt agcaattgct ggtaacgtag    60360
ctcgtcgtgt gctaaatagc atggcatcac atgaagccaa ttatgctggt tttgttgtag    60420
aaaacattcg tcgttctcgc tggttaggtg caatgtcagc agagaaacag ctcaaaaagt    60480
ttgctatcgg caatgctaaa atttacggtc agcgttatag ctttgcggca ggggcgttta    60540
aaactgaaga aagacatgac cgtagcgctg ctcaaatctt ctgttctgaa tttaatgcaa    60600
acctgcgccg tattcttaat cgttcaattt gcttgcttaa aggcgatgac cgcgtgaaat    60660
accaggcatc ttctactagt tctagaaatc ctaaggggtgt ttcatttatt cgtgccgaag    60720
aacttgacaa tgtaactgta cgaattcata ttaatagcca tttatccagc ggaaagtatc    60780
cggctcgggc gcttttagcg caagttcgta ctgcattaga tcatatggat gtagttaaaa    60840
aatcatgctg taaacagcag ggtgaaaact catctgttct tgaagtacat ttggacccat    60900
ttaagatttt tcctaaaaca ttgagcacca ccccagttat tgatgaagat gtagcacata    60960
tgtatctcaa tgttgttaag cctcttccgt taacaccagt aaatcatatt gaaatcgcta    61020
agaatagtat tactgccgaa atggaatcgg ttaagcgatt tattgacaca aaagaagctg    61080
aattggctaa gcatgaattg acgatggcag atttggttaa atcgcttaac gaatacaaag    61140
agcgttatga atctctcgag tatgcccgga gcttactgtg aaaaatcaat taaagaaga    61200
catggtcgtt gatgataacg accttgaaat tgagtttgag tatccacctg tacctgaatt    61260
taaaattgac tgggacgcct gtcttgaaat ggtagaccgt cgagaagctg cagctaaaca    61320
agttgtgcct tgcgaaaaat gtggtagtat tcaagtacag cttgtcgatt ggacaaccga    61380
tattctgaaa atgaaatgcc ggacttgtaa acacagattt gagagaaaat taaaatgatt    61440
actaaaacta ttactggtgc taatactaag tttttgtcg agtatgctaa taacctcata    61500
```

FIG. 20HH sequence.txt

```
aaagacaaaa actttgataa catcattgca gatatgattc ttgacgcata cgaaagtggc    61560
atcgaccta  tgcagcttaa agaatatctt cgagcgacaa tggattttac agttcttaac    61620
atgatgctta gaactgatac tgaattcaat gaaatgattg ctcgtcgtaa tgaaggcaag    61680
ttcaatttga ctgatgatga agtattagca tgcgctgctc acgaagcttg gaagaaggtg    61740
attaaatgaa aacaactggc gcgctttgga aagaatttta taacgatgaa gccttctggg    61800
aaggctatta tcatgatgac actttaatac tctttgatga tgttgaagta gaagaatatg    61860
aagacccttc gcctgatgcg gtagtaaaaa ttgaaagcgg atatgtttac aaaaccgatg    61920
atgattcctt cacttcccat gatttgagtc ttgaaactt  ctttaaacgt tggaaaaaga    61980
aacagaccac tgcactatg  gtagtcactg ttgataaaga tgacttcgcc aaagtatttg    62040
aaactatctc taatattcct ggagtgaaaa aggtaaaatg attgacatta aattagatac    62100
ttatgcagta cgccagttat tcccagaagg tacagcagcc cgtgctcaac tgcaacagtc    62160
agtaatcaat aacatcgtta aagaaatggt gttaaaagat tcacagaata agctgaagca    62220
agcagtacaa tctgaagtta atattgctgc tgtgactatt ccagatgtcc gagcagaagt    62280
taagaagcaa gttcagcaga tgttccatac tcgcggttgg aatgatatgt ctgctaaaga    62340
agaaatgtca cagatgatgc gtaacgctgc ccaatcatgc gctaaaaatg ctattgatga    62400
tatggttcgt caaactattg atgacgctgt taagcaagct gaaggtcgta ttaagatgtc    62460
tattgaaaga gctaatctcc gaattcaaga aatcattgtt aatgcaatga ataaaaattt    62520
cgctgatcaa attaacgctg ccattgctgc taaattggca gaacacttcc cggtaactgc    62580
taatggataa aattgatttt agcaaattaa atataccacg tatgggaatt cctgatgata    62640
ttgccaagca attagctagc gttcaaccaa tgccagataa ttgcatcaaa gatattttcg    62700
atgcgttaga tggtaaaaca ttagttataa ctactaaggc tgaaaatggc tcgtaaacga    62760
tatatggaag aagccgaacg agtaatgcta ctcatgtatt cggtttatta taatgagact    62820
ggtcaaatag ttgatagttc taaactcaaa ggagctatga ctcgtggccg aggttttgca    62880
caagcagcta ttgataaaga aattatttct cgccttggaa ttaagtatag ctccaagatg    62940
tatctccatc ctggctggaa ccaagttcaa gctcaagtat ttaaggaaat agaagaagat    63000
gttcacagtt tttggctacg acagcaacat ccataagtgt gtattttgcg ataatgcaaa    63060
gcgtctgctc gatgttaaga aacaagagta tgcattcatt aatgtaatgc cagaaaaagg    63120
cgtatttgat gaagtggtta tcagtgattt gcttcgtcgt ttaggtcgtg aatcacaggt    63180
tggattaact atgcctcaga ttttgctcc  tgacggtaca catatcggcg gttttgatga    63240
actccgtaaa ttcaaattca atgcatgatt atcgtggaac cctccttcgg gagggtgata    63300
ttgtagccct ttattatggc tatggcggat tagaaaccgg tgagattaaa caaatcaaaa    63360
```

FIG. 20II sequence.txt

```
atcatcgagc aaaggtagag gtaacttact ctaatggagt taaggttatg tctaaatgga    63420
aatacggtga gtgtatggtg aaattatgat tagcatgagg aagagttatg agttatgata    63480
ttggtgattt aaaagctccg tgcacggtaa caatttcagc agaagagttc atccgcttgc    63540
aagctattga agaactgttg tgggaaattg aatgtgcgct tccgtctggt ttagaaagct    63600
ggattgatga tgaagaccta caaaaactgc gaggttaaaa tgactaacgc tgaattagta    63660
aaagaaatca agcatatcgc tggtgtcact ggcgaatggg acgacaacta tgatttcgaa    63720
tatccgccta atgcaccaga cgatgatgca gaagaaatct tgtttttagt agaagatgat    63780
gaatggacac aggaccataa gtatcaaagc cgttctcaga tttggtatta cccagctcgc    63840
ggcgtccatt tcatggtatc agagtctcgt tcaggttcat atcataccga ttggtattat    63900
aatcctcctg aagtagatat cgtcactcgt cacgagaaag tagttactcg tactgaagtt    63960
gaatggcgta ttgaatacga ttctgttaat gattccgctc cggcaccatg caaagcagca    64020
aaggcataaa accttggtac acggctcgat gggaaactgt cgagccagag gaagatgcta    64080
ttcctgaaga agattataat acttctgaac ctaccattaa cgaactactt gattatgagg    64140
acaaagtgaa tggaacttat tggtaagcag tttgaagtta tagaaaatga tgatgaatta    64200
actgaacaat ttccccagtt tgttcctgga tttaaatttc aggttatcaa tgcagttaat    64260
gaagatgacc ttgaaacatg tggcattaca gcagtaattg atttgctcac aaataaaatc    64320
atcacaatta atgacccaac tccattcggt gaatcttggt tctggtgctt ctatagtgaa    64380
gataccatgc accaaattaa agaaatcggc caaggtgaag acgttccaaa tatttctgaa    64440
attaaactcg accattttca tggaaaaatt gttccaatta ccaaagctct ttatgctttc    64500
gcaggtcaag aaaattgtga ttctgaagaa tacgatttaa tgcagaaagc agctgattat    64560
atcgtcgcct tggaaactcg tcttggagtt caatatgtct aaatcatgcg taaccaaaac    64620
tattacagta aaaattttgg attttgtga tattcatcgt attgcaaggg aaatcttacg    64680
tagtcatgga tataaaattg gtgacattat taaattcagt aatggatatt atgacgatga    64740
catcggtgga atggcttggc caaaaatgag tattattcac aaagaaacta attcatatat    64800
tgagttcaat gcggatgatt atgaaggcat ctatgctttc tgtacttctt tctgcataaa    64860
agagtctaat cataacatct atagtagtta ctcgttaatt taactataaa tactcttatc    64920
taatcgctga ggtaagagta tgttattaac cggtaagtta tataaagaag aaaaagaaaa    64980
actatatcag gcacagaacg gattatgtcc ttgctgcaaa cgtcctttag atgaggatat    65040
tcaaaagaat cacctcgacc atgaccatgc gttagaaggt gacaatgcag gaaaggtcag    65100
aggcttgctc tgtaacctgt gtaatgcggc agaaggccaa atgaagcata agttcaaccg    65160
ctctggttta aaaggtcaag atattgacta cctcgaatgg ttagagaatt tgctggttta    65220
tctccgccag aatcgtaaag acagtaatat tcacccgcaa tatgttgccg atatggctaa    65280
```

FIG. 20JJ sequence.txt

| | | | | | | |
|---|---|---|---|---|---|---|
| acgcttttca | cgtcttggta | aacctgagat | gattgctgaa | atggaattgc | atgggtttac | 65340 |
| atacgaggaa | agtgatggaa | aatcacaact | tgcttcaaaa | tacaagaagc | agcttcgtaa | 65400 |
| gagtttaaaa | tgaatatcga | attagaaatc | cagggactta | ttaataaaac | caacaaggac | 65460 |
| ctcttaaacg | agaatgctaa | caaagattct | cgtgtttttc | ctacccaacg | tgacctgatg | 65520 |
| gctggtatcg | tatctaaaca | tatcgccaat | caggtcattc | ctttctctgt | aatggaagca | 65580 |
| cacaaagaag | gtgttatcca | ttttcatgat | atggactaca | gtccagcttt | gcctttcacc | 65640 |
| aactgctgtt | tggtagattt | gaaaggtatg | ttgcagaatg | gctttaaact | tggtaacgct | 65700 |
| caaattgaaa | ctcctaagag | tattggagta | gctactgcta | tcatggcgca | aatcactgca | 65760 |
| caagtagcat | ctcaccaata | tggtggaact | acttttgcta | atgtcgattt | agttctggct | 65820 |
| ccttatgtag | agaagacatt | cgctaaacat | gtacgtgatg | ctcgcaaata | tcaagtagca | 65880 |
| ttagtaaaag | attatgctat | ttcaaaaaca | gaaaaagacg | tatttgatgc | tttccaggcg | 65940 |
| tatgaatatg | aagtgaatac | tttgttcagt | tcaaatggcc | aaactccatt | tgtgactatc | 66000 |
| acatttggta | tgggaacgtc | atgggaagaa | aaattaattc | aacgagctat | tcttgataat | 66060 |
| cgtattcgtg | gattaggacg | tgatggaatt | actccaatct | ttccaaagct | tgtgatgttt | 66120 |
| gtagaagaag | gcattaatct | acgcaaagaa | gacccgaact | atgatattaa | gcagcttgca | 66180 |
| ttagaatgcg | cagctaaacg | catgtatcct | gatatcatca | gtgctagaaa | taatagagca | 66240 |
| attacaggtt | cagaaactcc | tgtatctcca | atgggctgta | gaagtttcct | tggtgcttgg | 66300 |
| agagactctt | ctggcaaacc | cgttcttgac | ggccgtaata | atctaggggt | agtaacattg | 66360 |
| aacctcccta | ggatagctct | ggatgcaaat | tataaaagtt | cagatgatag | taataaaactg | 66420 |
| ttcaaactac | tggatgaacg | tcttgatatt | tgtaaagaag | ctcttttaac | tagaattaaa | 66480 |
| tcccttgaag | gtgttactgc | gtcagttgct | cctattcttt | accaggaagg | tgcttttggt | 66540 |
| gtgcgtatga | aacctgatga | tgaaattctt | gagctattca | aaaatggacg | tagttcaatt | 66600 |
| tcattaggat | atattggcat | tcacgaattt | gatatgctta | cttttaaagg | aagcggtaaa | 66660 |
| ctcgtcctga | agtacatcaa | cactaagcta | aacaagtgga | cggaagaaac | cgggtatgcc | 66720 |
| tttagtttgt | attctactcc | ggctgaaagt | ctgtgctatc | gtttctgtaa | gattgaccaa | 66780 |
| gccaagtttg | gtgatgttaa | gggcgtaact | gataaaggct | ggtacactaa | tagtttccat | 66840 |
| gtgtcagtag | aagaaaacct | gtcgcctttt | gaaaagattg | accgtgaagc | accatatcat | 66900 |
| tccattgcta | aaggtggtca | tatttcttat | gttgaactgc | ctgacatgaa | gcgtaacctt | 66960 |
| gaaggtcttg | aagtggtatg | ggactatgct | atcgagaagt | tggattattt | tggtgttaat | 67020 |
| atgccagtag | ataaatgtct | ttcttgcggt | tctactcatg | agatgacacc | tactgaaaac | 67080 |
| ggattcactt | gctcaatttg | cggtgaaact | gatccaaaga | aaatgaatac | aattcgtagg | 67140 |

FIG. 20KK sequence.txt

```
acttgcggct atcttggtaa tccttctgag cgtgggttca atcttggtaa gaacaaagaa  67200
attatgcata gggtaaaaca tgttagagaa accaatgaag caagttgatt ggaaccaact  67260
tagcgaatgg ggattgattt ggaaaatcaa caaagaggtt ctgcacccgc ttggaattgc  67320
tataacccgt gaccccgaaa gtggattatc ggctggggct attcaaactg atgagccctg  67380
gaaatatgat gcagaagtag aagcacgtaa tgaggtaagg ttcaatgaat ttcgacagaa  67440
tctaccettc tgactttgtg aatggccctg gatgcagggt cgttcttttt gtcacagggt  67500
gtttgcataa atgtgaaggg tgttataata aatctacttg gaatgctcgt aacggacagc  67560
tattcactat gaatactgtt aaagaaattg catctcactt aagcaaatcg tatatccaag  67620
gccttacctt aaccggtggt gacccacttt atccacagaa ccgagaagag atttcaaatt  67680
tagtttcttg ggttaaagca agatttccgg agaaagatat ctggatgtgg acaggatata  67740
agtttgaaga tatcaaagat ttagatttgc tacaacacat cgatgttata attgatggga  67800
aatatgagaa atcactgcca actactaaaa actggcgcgg ttctgacaac caaagactct  67860
gggtaagaaa tggttctacc tggacacatg attgaggaaa tttatatgct gacttacaaa  67920
attatgttta ctctgaacca catggctact gaactgtttg gaccggaatt tctggctatg  67980
acagcgttca tcttaactat ttaaggaaaa ttatgaaatt tattaatgct attcgtaaat  68040
ttatttctaa cgttatcgct ttggttgcat taacggcagg tgctttcgta gcaattccgt  68100
ttattgttct tattatcatc gcagattgga ttaatcctac caagaaagat gaaaagttat  68160
ctaatgaaga atttcagaaa cgagttaaca ctctgactgc taaactccaa caggtcatga  68220
aatgatagaa atctatggca tccctgaaga agtttggaga tgccctggat gtaaagcagt  68280
tcgtgacttg ctcgataagc tgcaacttcc gtatgagttc tataacgtaa tcaatgaggt  68340
agacggtcaa ccggtttatg accgtccgtt gattgagtca cttgctaaac gcatcgggtg  68400
ctatccatcg cttgctattc ggtatcctgt cattttatg gataacgtta agcagtatga  68460
cattccaaca ttcaaaacca atcttattgc tgctgggcat gacccagata tcatagaaga  68520
ttaaccggtt cctttctaag gtcatcttga ccaccttctg tatatttcta taccetteat  68580
ttagaggttc ctgtgggacc tctctttat tttaaatcca tttcacaaag ttgtttacaa  68640
gctagctgat gagtgatact atagctctat caacggataa cagcataccg tttaactcga  68700
gaggaaaata tgaactggtt aaattggcaa gaagctctag aagctatgag taaaggctgt  68760
aaagtaaagc atgtgcattt tactgatgac gaatacttct tgatgaagaa caaagtcatc  68820
tgtgacgaaa atggatatga tatgactcgc tggtacaagg gtgagtcttg gcaaaacgaa  68880
cattggtaca tcgcatgaaa acttttgctg taggtgatat cgtccgtacc agaatttggg  68940
atgggcttca atttgaagta gttgtctacg tcggttcaga tggagttcta cttcaccgaa  69000
ttaacaatct gattaagtgg caccttgaac gcttcgtgaa atatcatgaa ttcaatagct  69060
```

FIG. 20LL sequence.txt

```
accactgtac tgtagctccg gttgctagta aagaatacta cgatatgctc gaagagttaa      69120
aatctctcaa agattgattt gctacaggag atttgattta aaatctcctc tgtcaagaca      69180
atcactactg aggaaaataa catgtcccaa gcaattaaaa acgcactgaa cgctttcgca      69240
tactataaag tttctgcaat gctggaagaa ggacgttgtg taactccgtc tttgcttgat      69300
cagtgggaag ttgagcttca cggtacgatg aaagaagaag gacaaaaaat tggtaaagca      69360
cgcatccgtg aattagtggt tgcttatctt ctgtctgaat ttggtattaa agcctttggt      69420
gtagaaccca tcgtagttgg tgttggtgaa atttctgaat ccgctattcg caaaatgaaa      69480
aaccaacgca agaaaggttt tcgtgatgtg aaagcggtta aggcggcaaa atgaaactaa      69540
atcaaaacgg atgtccttct cgcgtacgat tttgcattct agaattacga tctaacattg      69600
tcgttattga cgaatacacc acgattgtag gtgtacaaca atatcttgat agacgttttg      69660
atacacgaac ccatatgaaa tatggatttc caggcaaatg taaattttat ccaatgagtg      69720
ctgatcatca atctgtagta aatgatgaat acaagtgggc agaaggtctt actttaaaag      69780
aacttgagga atatcttgat gcgtaaagtt attctataca cagaaatttt taccagccgt      69840
tgggtgtttg acagtgtcag aatttcaaac gcttcaaaag aagatgttcg taacgctcag      69900
cgattagcat acgatgaagc tggaaaatca ccagcatttg taaaaattga gtatatcatt      69960
actgattctg ctttaattca taatgtatca gaatcagtat taaagaagtt ctgcgttgat      70020
cgcatcaata aaggaacttc aatggaatat tttctattag cgagagaact gaaatggtag      70080
aagaacaaat tgcagaaatc ggtttactcg gatggttcgt gtctaaaact aaagacggca      70140
gaaacttgat tgaaactcca gaaggagaat tcattattga agaagatttt gacgcgtttt      70200
ggatttatga acgctctgga gagaatgaat acacatccgt ggatgctttc tctaaatttg      70260
aagatgctat tgactcggtg aaagcatggc taaagtaaac caaattatga ttgtagtaga      70320
aggcattggc ggatttacta tagattctta tatgggtgtt tggtttgaca atgaagaggg      70380
catgtattgg gaaacgcatg cctctatgtt aaatgaaact cattatgaaa gtttatactc      70440
ttcattcatg gaaatgatgc atgaagtaga tgaatctgat tggtttgaac ttagtttggt      70500
tgagttcaaa cgtatcatgg aacagctgtt ccaatgctat cgtattatga agggtgaact      70560
atgaaaattc aattgactct tacacatgaa aatattaaag gtgtgttctg tcttgaaaat      70620
agccaaataa cttttgcaca agatggaacg tactggtatg ctgaatcaga tgatatcgct      70680
ggttatggaa tggaacgtgt atttgaagat tttgaagccg tcattgatgt tccattagat      70740
ttcacgtata acgattttta tcgtatcatg atgaaattaa ttgcatgcgc tgaattgatt      70800
aagtaatgct ttaatcctct cgcttcccaa atttgttata atagatatta ttaattgaag      70860
cgaagaggca atatgagtaa ttatgtaaat aacaaggagt tgtataaatc aatctgttca      70920
```

FIG. 20MM sequence.txt

| | | | | | | |
|---|---|---|---|---|---|---|
| tggaaagaga | agtgtcggga | gtctgaagct | gctggcggtc | ctcgagtagt | aaaacagaac | 70980 |
| gatacgatcg | gccttgctat | tatgctgatc | gcagaaggtc | tgagtaagcg | tttcaacttt | 71040 |
| tcaggataca | cccaatcctg | gaagcaagaa | atgatttcag | acgggattga | agccgcaatt | 71100 |
| aaaggcttaa | tcaacttcga | tgaaactaag | tatgataacc | cgcatgcgta | tataacccaa | 71160 |
| gcttgtttca | atgcattcgt | tcagcgtatc | aaaaaagaac | gcaaagaaat | ggcaaagaaa | 71220 |
| tacagctatt | ttgtccacaa | cgtgtatgat | tcacgggacg | atgatatggt | tgcgttagca | 71280 |
| gatgaaacct | ttattcagga | catctacgat | aaaatgacgc | agtatgaatc | caccgcttat | 71340 |
| aaggcgccag | ggtctgctaa | aaagagcgaa | cctacaagtg | atggacctaa | tctggaattt | 71400 |
| ttatatgagg | ctgaagatta | acctcgacgg | gtttttagaa | gatgtgcaag | acctagacgc | 71460 |
| tatcccttat | ttgctaaaga | tgtatttaag | ggaggtgctt | gatcttgata | ttcacattga | 71520 |
| cccgaaaaat | ccacatgacg | ctgatttcag | atcagattct | gctataattg | aacatagtta | 71580 |
| taattggact | gatactgaat | tcacatttga | aataaattac | catccaaagg | aataacatga | 71640 |
| acaatattac | ccaggaagag | cgcgacgaac | tgcagcagaa | actaatggaa | gcggcagaag | 71700 |
| aacaagctat | tgctcgagcc | aacaaaattg | ttcgtaaaaa | ccgtcgtgaa | attgagcgat | 71760 |
| taaaagctca | tgctggagac | gcggtattag | acaacaattt | ccctgcttac | aagtatgcta | 71820 |
| ttgaaaaact | gcgtactatt | ttaaaacaac | cttttaccga | tgagattatt | ctcacctgtt | 71880 |
| ggaatacctc | tcgtaaatct | gtttgggaca | ttctaaatgc | tggtacaagt | aaaatttaaa | 71940 |
| cgtgttcgta | aagacgcagg | atttactttg | aacactgcta | ctggaacaat | ggcagtaaaa | 72000 |
| gtagcagata | atcaatatcg | cgtgttaggc | tctaccgaag | gatgtaagct | aatagataag | 72060 |
| aactctcttg | tctgggttga | caccttccaa | gttaaacggt | ggtatgaatg | gtaaatgaag | 72120 |
| agaattggga | tgtatgacga | atttgatggg | ttctaatcct | gggcatgatt | ggcctgaagg | 72180 |
| aaattacgcg | tgtcggtgta | gtaattgttc | agaacgttat | acaggaccaa | agcgtagtta | 72240 |
| cttctgctat | aaatgcgata | ccgccaggag | agaagcaccc | gctcccgatt | atgaagcaat | 72300 |
| tcgtaatgct | aagatagata | tgctcaagcg | ctttgaagaa | gctaagcgta | tatgcgaagc | 72360 |
| agcgggttat | gttgtgtata | agaaaattta | aagggcttcg | gccccttttgc | tttattacgg | 72420 |
| gaatggtaaa | atatccaaaa | ttaacaacaa | aggtcaatat | atgaagatta | atattttaat | 72480 |
| ggctcgcgga | cttgagggat | gcggcgtaac | caagttcagt | ctcgagcatc | gtgagtggtt | 72540 |
| agtaaaacat | ggccatgaag | taaatatcat | ttacgctaaa | gataaagcgt | ttactcgtaa | 72600 |
| tagagcacat | agctataaag | atgtaactat | tcctgtgtct | ctggcagatg | actacgataa | 72660 |
| gactttatct | ctgcttaatg | catgtgacat | tcttatcatt | aactcagtac | ctgctgtcaa | 72720 |
| cgctccagaa | gcagcgattg | ataactataa | gaagctcata | gagaacatta | aacctgaagt | 72780 |
| tcgggtagtc | gtatatcaac | atgaccatag | agcattgtca | cttcgtagaa | atgctggtct | 72840 |

FIG. 20NN sequence.txt

```
tgaagaaacc gttaagcgtg ctgatgtact gtttagtcat agctcaaacg gcgattttaa    72900
taccgtgcta atggaagaat attttccaag cggcgggttg agtttctttg atgattctga    72960
ctcagctcct ccggtttata acttcaacc tgctatgaac atcaaagcaa ttcgtgataa     73020
gtattggaaa gacttctctg ccattgattt tgatatccat cgttggattg gtcgtactac    73080
tacgtggaaa ggctatttct tgatgtttga ctttcatgaa agtcatctgc gtcccgcagg    73140
caaaacgact atcttggaag ggttagaacg cagtcctgcg tttattaaca tcaaagaacg    73200
ctatgaaatt gactattgcc gtcattatca tcaggtaaaa actgggccag gtctgaatcc    73260
tcaagttctt gaccgatatg ttaactctga aatgcttgag cgtatgtctc aatctggatt    73320
tggctatcag ctgtcacgtc ttccggataa attccttgag cgttcgttgg aatatactca    73380
tttggaatta ggtgcatgtg gtactattcc tgtgttccat aaagccaccg gtgatgcttt    73440
gaaattccga gttgatggaa agccattgac ttctcatgat tctggcattc tgtggttgaa    73500
tgatgaaaat aaaaatgaag tctttgaacg aatgaaacat ctgtcatctg accagaagct    73560
ctatgataaa gagcgaaata aagcatttga attcctggta gaacaccaag attctgagca    73620
ttgctttaaa gaacaatttg agttaatgac aaaataagta atgggccttc gggccctttt    73680
tgctattcat ggaataatat aaaattaaac tctactagag aggttatatg aaaattattc    73740
actcaggcga ttggcattta ggtgtccgcg cagatgaccc gtgggtacag gatgtacaac    73800
gacacggaat taagcagcat attgattatg ccaaaaagca tggaattaaa actatcattc    73860
aatacggtga tattttgat gttcgtaaag ctatcactca taagacaatg gaatttgctc     73920
gtgaaattgc agagtctctt gagaaagaag gaattaactt aattacgatc gtcggaaatc    73980
atgacatgca ctacaagaat acgttgacgc taatgcatc aaccgaagtt cttggtaagt     74040
ataagcatat tactgttatt gaaaagcccg tgactatgga ttttgatggg actttgattg    74100
acttgtgtcc atggatgtgt gaagagaaca catcagaaat catgaagcat atcaaagaat    74160
cgtctgctga atactgcatt ggtcattggg agcttaatgg cttttatttt tataaaggaa    74220
tgaaatctca tgggctggaa ccagatttcc tcaaaaagta caaacaagta tggtctgggc    74280
acttccacac catatcaagc gcagcaaacg ttaagtacat cggaacgcct tggacgctta    74340
cagcgggtga cgagaacgac ccacgcggct tctgggttca agacactgaa ttatcaacct    74400
ttgatttcgt ccctaatgaa atcacttggc acagaaaact gatttatcct gtcacagggc    74460
aagttgattt tgaagagttc agaaatcttg cagtgcgaat tattatcact gcggtcgatg    74520
aagaccttcc taagtttgaa tcagaacttg aaaaggtagt acatgaatta agaactgttc    74580
ctaaagttga caactcggtt gagtctgaag atggcgaaga agtagaagtt aaaagcttat    74640
tggatttaat ggaagaatat atccaagcac ttgaagacct gtccgcagat gatatcaaag    74700
```

FIG. 2000

```
                                sequence.txt
ccttaaaggt tatgtctaaa cagttataca ttgaggcaca aaatcagtga agactttaa      74760
actaaatcgt gtcaagtata agaatataat gtcagttggc caagcggcca ttgacattca     74820
acttgataaa tgtcaaaaga ccttaatcac aggtaagaat ggtggtggca aaagtactat     74880
gcttgaagct attacttttg ccttatttgg taaaccattc cgtgatatta agaaaggtca     74940
attaattaac tcattcaata agaaggactc tgtagtagaa ctgtggatgg agtatgacgg     75000
tcatagtttc tacattaaac gtggacaaaa accgaatgtc tttgagattt tacgagatgg     75060
caataagctt gatgaagccg caagttcaaa ggattttcaa tcctactttg aaagcctcat     75120
cggcatgtca tacacatcgt ttaagcagat tgtcgtatta ggaacggcag gatatactcc     75180
gttcatgggg ttatcaactg ctaatagacg aaagctcgtt gaagatttgc ttgaagtgtc     75240
tcttttagct gatatggaca aactgaacaa gacacagata agagaaatca atcagcaaat     75300
ccaggttaat gatgttcagc gtgaagcatt gactaatgaa attaaaactc accatgagta     75360
tgcagaaaag cagaagaaac tttctggtga taacgttgct cgcctgcagg cgatgtatga     75420
tgaacaggtc aatgaagccc gtgggtataa agcagaatta gaaactcttc agagagaact     75480
gcttgagtta gtaattggag acgacccagc agagtcaatc caagaagttc aaggtaaaac     75540
atttaaaatt cggtctaaaa ttgaatcata ttcaaaggtt cttgggctgt atgataaagg     75600
tggtcattgc ccaacgtgct tgcaggattt gcattctaat gacactctaa tcactaagat     75660
taatcatcat gttgaagaat gtaataccat tcttggtgag ttaaagacgc gccagagtga     75720
actggatgaa ctagctcgcg agtataacac ggtccgggct cgcgctagag atatcaaaac     75780
ccaaatgggt agtttaaagc aaatgactat cactgctgtg gaaaaggcac gtcgtattaa     75840
agcagctatt gataaagcat ctcaggagtt tattgataac tcagacaaga ttaaactgct     75900
acaagaagaa ttagataaaa ttatcctcgt caaaactaat ttggttatgg aaaaatatcg     75960
tcgtggtatt ttaactgaaa tgctgaaaga ctccggtatt aaaggagcta tcatcaagaa     76020
gtacatcccg atgttcaata agcaaattaa cagctaccta aaaattatgg aagctgatta     76080
ttcgttcaca ctgaacgaag agttctctga aacgattaaa tcacgtggac gagaagagtt     76140
tagttatgcc tcgtttagtc agggtgaaaa agccagaatt gatatagcat tactattcac     76200
gtggcgtgat attgctgaaa aagtttctgg tgttaaaata aactgtctgt tccttgatga     76260
agtttatgat tcggctaccg acgcagaagg tgttaaggca ataactgcta ttcttaataa     76320
gatggtagat gccaatgtgt ttattatttc tcaccgtgac cacgacccgc aggcatatgg     76380
ccaacaccttc aaatgaaga aggtcggacg attcacggtg atggaatgaa tgagtttact     76440
acgggccaac atctgttggc ctttcctgaa ttaaagcgtt atgtgttagt taatttattt     76500
tctgatgaac gtcatcttgt aactgaagaa atgttacgag atgcttttac gggaaatgaa     76560
tataatagag tcatgtccaa caggaatccc ggttggatgg ttgaagatta ctacgattaa     76620
```

FIG. 20PP sequence.txt

```
ggtaaatata atgattaatt ttgttgatgt gaaagatatc caggttaaaa acgtacgtgc    76680
agattccaac ccgaataacc aaaatcgtat tcgtaaatct tgggttctgg ctctaactga    76740
agaaactaaa caggctatca aagataagat taaagattct gaagctcgct ttgctttcta    76800
taaatctatc gatgatgaag tcgcagaaaa atggattgaa ctgatgcgta agcattacaa    76860
tgaatcaatc aaggctggtg ctaaaattgt tactgatcgt cacggtggcg aacgtctaga    76920
aaatgattac tgtgtagatg ctgatgagca actcgttgcg gcaggtcaga ttgttgcaga    76980
agaattaact gctacattcg cagcttgata taattatcct gaacttaatt aaaaggtatt    77040
gaaatgaaat tctctaaaga aactctgaac attctgaaaa atttctccac catcaactct    77100
ggtatcatgc tgaaacctgg caatttatc atgactcgtg ctgttaatgg tacgacttat    77160
gctgaagcaa caatttctga taccatcgat actgatgtag caatttatga cctgaacagt    77220
ttcctgagca ttctgtcttt ggttggtgat gatgcagata ttatcatgca ggaagatggt    77280
aatctggcaa ttaaagatgc tcgctcaact atcttctggc cagcagctga cccgagcaca    77340
atcgtgttcc cgactaaacc aatcccattc ccggtggcaa acgtaattat cgattttaaa    77400
ggtgaagacc tgcaacagct gatgcgagta tctcgtggca tgcagattga cacaattgct    77460
atcaccaatg ttgatggtaa aattgttctg cgtggttata caaaagtaga agatgctgca    77520
ctgacccgtc cgaagtattc tctgacactc ggtgattatg aaggtgaggg taacttcaac    77580
tttatcatca acatgagcaa tatgaagatg actatcggcg attataaact gatgctgtgg    77640
gcaaaaatga atggctccaa gaaacagact gccgcaaaat ttgaaggtgc atcagcctct    77700
tatgtagtag caatggaagc agacagtacc tttgattttg agtaataact tcggggcttc    77760
ggccccatct ttaatctgaa tgaggaaata taaatgaaat tgacagtaaa cgaagcagac    77820
ttcatgtggg aacagaaata tcgtccaggt actatttctg agtgtgtact tcctgctgaa    77880
gataaagaaa ttttttcagc tttagtagct aaaggaaaaa ttcctcattt aattctccat    77940
agcacttctc ctggtactgg taagactaca gtagctaaag cattatgtaa tgacattaat    78000
gctgaaatga tgttcgtgaa tggttctgac tgtaagattg atttcgttcg tggaccgtta    78060
actgcatttg caagttctgc ttctattgca ggcaagcaga aaattatcgt tattgatgaa    78120
tttgaccgtg caggtcttgc agaatctcaa cgacatctgc gttcattcat ggaagcgtat    78180
agcacaaact gtactattat cattactgca aacaatcttg atggtatcat taaacctctt    78240
cagtctcgtt gccgtgtaat taattttggt aaaccatctc catctgatgt taagccaatg    78300
caaatcgaga tgctcaagcg ttgtctcgca atttgtgaaa acgaaggcgt ggtagttgaa    78360
gataagaaag ttgtagctgc tttggtcaaa aagaattttc cagaattccg taagaccatt    78420
aacatgcttg accattattc ttctaagggt gtgattgatg caggtatctt gtctatcgtt    78480
```

FIG. 20QQ sequence.txt
```
ctgaatgacc gtggttcaat tgaagatgtc atcgaagcta ttaaaactaa gaacatcaaa     78540
gaactccgtg ctcttgcccc gaaatatgca gcagactata cttggttcgt agataaactt     78600
tcttcggaac tgtatacaat ggttactggc ccaagcatta tccgaatgta tgaaatcatt     78660
ggtgaaaata accagtatca tggcatagca gcttcgattg aattacactt ggtttatatg     78720
cttattcaac ttgttgtaga gatgcagtgg aaatgatgag tttatttgaa gatgatgatc     78780
agtataacga gcaccaaata gcgtggttag gtaaagactg gacgaaagtc caggaattat     78840
ctgattcata taaagaaaaa gcagaaaatc aattcttcac aattattggg tctattaacg     78900
aaaagcaaga gcatttgaat atctcgacga tggattattc aaaattcatg gttgaaaacg     78960
ctctttctca acaccctgac tgtatgcctt cggtttatgt tatgaacctt gttggtcaag     79020
ggttatctga ccaagcacac tataactata tgatggcctc tgttcctaga ggtcgtcggt     79080
atggtaaatg ggctaagtta acagaaaaca tccaggatgc attgattctt caagttataa     79140
tgacatatta caaggtcaat gcgattgacg ctaggatgta tagagagacc ctggaagcta     79200
aaaacaagct taaacctgct ctcaagaaaa tgaaaggtct tgtgactgat gaattggtca     79260
agacaatcac gaaaaacgtg aaagaacaga aaaatcttaa gaaaacagca ttggaatggt     79320
aaagatgatt gaaattacac tgaaacagcc tgaagacttc ctgaaagtta agaaaactct     79380
gacccgtatg ggaattgcta ataacaaaga taaggtacta tatcaaagct gccacattct     79440
tcagaaacaa ggtcgttact atattgttca ttttaaagaa atgttgaagc ttgatggccg     79500
ccctgttact attgatttgg aagatgaaat tcgtcgagac tcaatcgcac aactacttgc     79560
tgactggggt ctactgagta ttaatcgtgg tcaaactctt gctcagatgc agaataactt     79620
ccgggtcatt acgttcaagc agaaacatga atggacctta aaatctaaat atacgattgg     79680
tgcataatga cagaccaaga attttacgac aaacttaaaa atatcaggat tactgctcct     79740
gaatggttca gtcttcctat tgatgaacaa attcagtatc aggtaaaaga aactttagaa     79800
aaatatcctg gccgaaaagt tatgatgtgc ttcacatatg ataagaatcg agttcctcga     79860
attcagaagc aagtaattga agtttaagaa aaggccttcg ggccttttac tttataaaac     79920
tcggagtata attatcccac ctaaagacta ataactcggt ctataaacaa aggaaaccca     79980
tgaaagaatt ttatattagc gttgaatctc taggcaatga cattgtagaa cgttatatcg     80040
attctactgg tgaggaacgc atgcgtcgtg ttccgtattc tcctgtgatg tttagtcatt     80100
gcatggaaga aacaaagtac aaagatatct acggcaagta ttgcaagaaa aatacattcc     80160
caactatgaa agatgcccgc gattggatgc gtcgtatgga agatatggga atggaagcaa     80220
tgggtatgga tgatttcaaa ctcgcgtata tcagtgatac ttacggttca gaaatcgtct     80280
ataataaaaa attcatccga attgcaaact gtgacattga ggttactgca tctcaattcc     80340
cagacccaat gaaagcagaa tatgaaattg acgctatcac tcattatgat tcggttgatg     80400
```

FIG. 20RR sequence.txt

```
acaagttcta cgtatttgat ttactgcatt ctctttatgg ttctgtttcc gagtgggaca     80460
agaaacttgc tgctcgttta gattctgaag gcggtgatga agttccacaa catattcttg     80520
accgcgtagt atatatgccg ttcaattcag aaaaagaaat gatgcttgag tacatcaatc     80580
tttgggaaca gaaatgccca gcaatcttta ctggatggaa cattgaagga tttgatattc     80640
cgtacatcat gaatcgtgtg aaacagattc ttggtgagcg tgcgatgaaa cggttctctc     80700
ctctgaataa agtttcatct aagattatca caaacatgta tggtgataaa gaaatttatt     80760
ctatcatggg tgtgactatt cttgattaca tggatttgta taagaaattt agtttcacga     80820
accaaccgac gtataagttg gatttcattg cttattatga aaccaagaaa ggtaaattag     80880
catatgacgg tccgatcaat aaattgcgtg aaactaacca ccaacggtat atttcgtata     80940
acatcatcga cgttgaatca gtacaagcga ttgatgctgt tcgtggattt attgacctgg     81000
ctatctcgat gtcttattat gcgaagatgc catatcaagg tgtaatgagt ccaattaaaa     81060
catgggacgc aatcatcttt aacagtctga agaacaaga caaggttatt ccgcaaagtc     81120
gttctcatgt taaacagtca tatcctggtg cgtatgttaa ggaaccagtt cctgctgcat     81180
atcgctatat catgtcgttt gacttgacat ctctgtatcc gtcaatcatc cgacaagtta     81240
atatttcacc agaaaccatc gttggacagt ttaaacttca tccgttgggt gagtacatta     81300
acaagactgc tcctcgtccg tctgatgaat attcatgttc accaaatggt tggatgtatc     81360
gtaaagatgt agatggtgtc attccagttg aaatcgcgaa ggtattttat cagcgtaaag     81420
agtggaaaaa taaaatgatg ggtgccaaac gaaatcaaga actgattaaa aaggttctga     81480
atgataagaa gtttggaact atcgataaat tcgcagaagt taatgtctat gaagatttct     81540
ctgatgatat gaaagcagaa ctgctgacat ataccgaaga gtgtcttgac aaactgatgt     81600
ttgaatgtaa acacgctgaa atcttgggta acactaacca gttaaaccgt aagattctga     81660
tcaactcact ttatggtgca ttgggtaaca tttacttccg ttattatgat ttgcgcaacg     81720
catcagcaat cacattgttt ggtcaaatgg caattcaatg gattgaacgt aaagttaatg     81780
aatacctcaa caaggtatgt ggcaccgaag gacattcgtt tgtagtagct ggtgatactg     81840
actcaattta cgtttgtgtt gataaggtta tcgagaaggt aggtcttgag cgtttcaaag     81900
aaactaacga tttggtcgaa ttcctgaacc aattcggcaa gaagaaaatg gaaccatgga     81960
ttgaccaatc atatcgtgag atgtgtgaat acatgaacaa caagaacat ttaatgttca     82020
tggaccgtga agctattct tgtcctccgt tggggtcaaa cggcattggc ggattctgga     82080
aagcgaagaa acgatatgct ctgaacgtgt atgatatgga aggtactcga tatgcagaac     82140
ctcatctgaa aatcatgggt atggaaactc agcaaagttc tacgccaact gctgttcaga     82200
atgcattgga agaatctatt cggcgtatgc tgcaggaagg tgaagaatct ttacagcaat     82260
```

FIG. 20SS sequence.txt

| | | | | | |
|---|---|---|---|---|---|
| attataagca | gtttgagtct | gaatatcgtg | aacttgatta | taaagtaatc | gccgaagtta | 82320 |
| agactgcaaa | caacatcggt | aagtatgatg | acggtgcagg | atatccagat | aaaggtacac | 82380 |
| catatcacgt | taaaggtgct | ttggcatata | accgagcaac | cgcaggattt | gaaggtataa | 82440 |
| caccaatcat | ggaaggtgag | aaagtgatgg | tcatcccgct | gcgtgaaggt | aacccgtacg | 82500 |
| gtgagaaatg | catggcatgg | ccatcgggca | ctgagctgcc | acaagaaatc | cgacaggaag | 82560 |
| ttctagtgtg | gcttgaccac | agtgttctgt | tccaaaaatc | gttcgttaaa | cctctgacgg | 82620 |
| gtatgtctga | agcggcaggg | ttagactatg | aagagaaatc | gtctcttctt | gacatgttcg | 82680 |
| attttaaaa | aagttgttta | ctttaccaca | aggatgtggt | actatagctc | tcgaaataac | 82740 |
| atactgagga | gattacaatg | aaatcgttac | ttgctgttat | tgttgctctc | acgctgactg | 82800 |
| gttgtcaaat | gccacaaggt | gatatcgtcc | cggcttcttc | tgttgggcag | gtgcgagcaa | 82860 |
| ttggcggtac | tgtaggatac | tatcgtgcta | gcaaccaggt | ctctgctgaa | tcgctcgcgg | 82920 |
| ttgagcgtcg | gttggcgaaa | gaaaaagcta | atcctaatcg | tcagctgtct | gcgatggaac | 82980 |
| ttgacatgat | tgagcagaat | aagcatgaac | tggaagaaat | taagcgtctg | cgtaaaactc | 83040 |
| aaaaagaacg | tacgtgcact | gctcaagcgg | cagcagtgaa | tgaccagatt | cgtttaactg | 83100 |
| attttgctaa | cggcggattg | agttataatg | agcataaaca | acgtatggag | cagttaaaat | 83160 |
| ctctccaaaa | tcacatctac | aacaaatgca | tgtctaactg | aggagattaa | catggaagca | 83220 |
| gtatttggtt | taatcattct | tttcttcatc | tatttttgc | cgacctttgt | agcttgcagt | 83280 |
| cgtaagcata | aatcacgggg | tggaatcttt | atcacaaatc | tagtattcgg | ttggtccatt | 83340 |
| atcggttggt | taattgcgct | gatttggtct | gcttctaacg | cacagcagaa | tacaattatt | 83400 |
| atccagcaag | ttaaataaga | ggtctcatga | ttgtaactcc | aatgacagta | caagatatcc | 83460 |
| gtcaagaatt | cgctgatgct | ttgctcaaca | aagaatttgt | gattgataag | acgggtgtga | 83520 |
| agactattga | aatcgtaggt | gcatcattta | ttgcagatga | aaacctaatt | tttggcgcag | 83580 |
| ttaatgatgg | atacattgct | cgtgaacttg | agtggtataa | atctcaaagt | ttattcgtta | 83640 |
| aagatattcc | gggtgaaacc | ccagctattt | ggaaagcaat | tgcatccaaa | cacggcgaga | 83700 |
| ttaattctaa | ctatggctgg | gcagtttggt | caacacaaaa | ctattcacag | tttgctaact | 83760 |
| gtgcgaaaga | acttatcaat | aatcctgatt | ctcgccgcgg | aattatgatt | tatacacgac | 83820 |
| ctcaaatgca | gtatgatttt | gagcgcgatg | gcatgagtga | tttcatgtgt | actaacaatg | 83880 |
| ttcagtatct | gattcgtgat | aatcgtgtgc | atgctgtggt | aaacatgcgt | tcgaatgatg | 83940 |
| tcgtctttgg | atatcgtaat | gactatgcat | ggcagctcta | tgttttggaa | cagttaacca | 84000 |
| aacttctgaa | tgcatcaggt | aaaaattatt | cagttggtga | cattatttgg | aacgtcgggt | 84060 |
| ctttgcacgt | atattctcga | catttctatc | tcgtagataa | ttatgctcac | acgggtgaaa | 84120 |
| ctcacatcgc | aaagaaagac | tataaaggtg | aatggaaatg | attcagtttg | taattccaag | 84180 |

FIG. 20TT sequence.txt

| | | | | | | |
|---|---|---|---|---|---|---|
| ttataagcgc | gccggggcag | ttactgccct | gactatgttt | cctgaaggtt | atgttccaca | 84240 |
| tcttgtagta | cgtgaatcag | aaaaagaagc | atacgaaact | tggcacggtc | atgctgctaa | 84300 |
| aatcgttact | gtccccgatg | atgtcgatgg | aattgcggga | actcgccgtc | tgattactga | 84360 |
| aatgtatgca | gggcaacgaa | tttggatgct | tgatgatgat | acgaccattc | atctgactga | 84420 |
| aattcgtgaa | cgcgacgatc | gccgggttcc | acttggtgtc | ggcgaggcaa | tgagtcaaga | 84480 |
| ggtatttgat | gatatggtca | aatacgtcga | gactgccatg | gattgtggtt | attatcacgg | 84540 |
| tcatgctcgc | ttaccgattt | tcaaaatcac | atcaagctgg | ggtcattatc | gtgagaatag | 84600 |
| ctttgggttc | accaatactt | tctatgattt | gactaaactt | accgcagaag | acattggcta | 84660 |
| cggaattatt | gaccttaacg | aagatgctta | tgcttttcta | aaattaatta | acatgggtca | 84720 |
| tcctcatctg | gctctgttta | agtacctcgt | taaatctggt | aaggtgcagt | cacctggtgg | 84780 |
| ttgttctaca | cagcgtgata | ctgctcgcca | gaatagagcc | cttgaacagc | tgcatgctgc | 84840 |
| tttcccaaat | caagcccgtt | ggaaatctaa | agacggtgaa | agacgtggtt | tattcggtga | 84900 |
| tgacgaacca | ctaaaatcaa | ttcgtatgtg | tattaacact | cgagtgaaat | cccaggcctt | 84960 |
| ccatgaattt | ggtaaggtag | aaccatatct | gtgagggcga | aagccctcca | aggacctctt | 85020 |
| atgaacatct | atgataaatc | tgatgtagct | ggtaacatat | tcaaggctga | agaattcaga | 85080 |
| tgcttcgtat | gtaaatctga | tgagtttgtt | catgaaggaa | ctactggctc | agatggaatg | 85140 |
| cattgctggt | ggcacggcat | gtgtgttgga | tgtaaaatac | actacgaaat | agatatggaa | 85200 |
| acagtggttt | ataacaccaa | gaagaaatgg | aacttctgtt | aatagcttca | agaacaaagt | 85260 |
| aatataatta | ctctatcctt | taacctgtga | gaaaaatata | atggagactt | atggaatata | 85320 |
| atgaatgtct | gacttaaaat | ctcgcctgat | taaagcatcc | acttctaaaa | tgacagcaga | 85380 |
| actgactaaa | tcaaaattct | ttaacgagaa | agatgtagtt | agaaccaaaa | ttccgatgct | 85440 |
| taatatcgca | atcagtggag | cgttggatgg | tggtatgcag | tccgggttga | ctatcttcgc | 85500 |
| aggtccatct | aaacacttca | aatctaacat | gtctctgaca | atggttagtg | cttatcttaa | 85560 |
| taagtatcct | gatgcggtct | gcttgttcta | tgattcagaa | tttggtatca | ctccagctta | 85620 |
| tctgaaatct | atgggtgttg | accctgaccg | tgtaattcat | acaccggttc | agtcggttga | 85680 |
| acaattaaaa | atcgatatgg | ttaaccagct | tgaagctatt | gagcgtggtg | aaaaagtcat | 85740 |
| cgtgtttatc | gactctattg | gtaacatggc | gtctaaaaag | gaaaccgaag | atgctttgaa | 85800 |
| cgagaaatct | gttgcagata | tgactcgtgc | gaaaagtctg | aagtcgctct | tccgtatcgt | 85860 |
| aactccttac | ttctctatta | agaacattcc | ttgtgtagcg | gttaaccaca | caatcgagac | 85920 |
| tatcgagatg | ttcagtaaga | cggtaatgac | aggtggtaca | ggtcctatgt | attctgcgga | 85980 |
| tactgtattc | atcatcggta | aacgtcaaat | taaagatggt | tctgagcttg | agggatatca | 86040 |

FIG. 20UU sequence.txt

```
gtttgtcctg aacgctgaga aatcgcgtac tgtcaaagag aaaagtaagt tcttcatcga    86100
tgttaaattc gatggtggta tcgatccata tagtggtctg cttgatatgg ctctagatat    86160
cgggtttgtg gttaaaccga aaaatggatg gtatgcacga gaattcctgg atgttgaaac    86220
cggtgagatg attcgtgaag aaaaatcctg gcgggcaaaa gatacgagca gtacggaatt    86280
ttggggtcct ctgtttaagc atgagccatt ccgtgacgct atcaaagccc ggtatcagtt    86340
gggtgctatt gattcaaacg ctgcggttga tgaagcggta gcagaaatga ttaactcaaa    86400
agtttcaact aaggttgatg gtgttaaact tcctgagagt ggttcagtat cagctgctga    86460
agttgaagat gaattagaga acttcatgaa tgaagactga gtttgattta gaatctgaac    86520
tcgagaaatt tgaacaagaa tctccctcgg aagagggaga cttcgagcgt caagaacgag    86580
tgttcaagaa aagccatgaa ataatccaag aagctatgaa gactgttatc caagaaattg    86640
tgataaaatt aaatggtcaa tcacacttgg tttatgttca taattaaat atttctcctt    86700
cgggggaagt aactattgag ttcagtacac catctgaagc tcataaggat gaactttatc    86760
ctcatgtgga agcttgtgtt aaacaacaaa tccagagtgc attaaagacc aagaaaaaat    86820
cattatggaa aatcttttaa gaggttaaag tggtagaaac aatcttagct aatctgattt    86880
acaaccaggc tttctttacg aaggtttggc catatatgga caaagagtac ttcgagcaag    86940
gacctgctca gacggtgttt aacataatta agaaacacgt taatgaatac acagcaattc    87000
cttcaaagac tgcgttatgt gtagcactgg ataattcgtc tataactgaa acggaacatg    87060
aaggtgcaaa gaaacttatt gataagttat ctgatgctcc tgaagatttg aattggttag    87120
ttaaggaaac agagaagtac gttcaagaaa aggctatgta caacgcaacg tctcgaatta    87180
ttgaaattca gactaatgcc cagcttgagc caaataaacg cgataagcgt cttcctgata    87240
ttggggctat tcctgatatc atgcgtgaag cgttatcagt atcgtttgat agctatattg    87300
gccatgattg gatggaagat tatgaagctc gttggttatc ataccagaat aaagctcgta    87360
aagttccgtt taaacttagc attctgaaca aaattactaa aggtggtgcc gagactggta    87420
cactgaacgt attgatggct ggcgtcaacg ttggtaaatc attaggatta tgttcattgg    87480
ctgcagacta tcttcagatg gggcataacg tcctttatat ttccatggaa atggccgaag    87540
aagtttgcgc taaacgtatt gatgctaact tgcttgatgt atcacttgat gatattgacg    87600
atggatgtgt atcatacgct gaatataaag gcaagatgga aaaatggcgt agttctagta    87660
ctcttggtcg tttaatcatt aaacagtatc cgactggtgg cgctaacgct aatacattcc    87720
gagctcttct gaatgagttg aaactcaaga agaactttaa accgactgtt atcatcattg    87780
actatcttgg tatttgtgct tcttgccgta ttcgtcaata tactgaaaac agttacacgt    87840
tagttaaagc tattgcagaa gaacttcgtg cattggctgt agaatctgaa actgttcttt    87900
ggaccgcagc tcaggtaggt cgttcagcgt gggatgcttc tgatatggac atgagtgata    87960
```

FIG. 20VV sequence.txt

```
ttgcagaatc tgcgggtcta cctgctacgg cagactttat gctggctgtg attgaaaccc    88020
ctgaacttgc tcagatgaag cagcaattaa ttaagcagat taaatcacgt tacggtgata    88080
agaacatcaa caataagttc tctatgggtg tacataaggc taatcagcgt tgggtagaaa    88140
ttgagcagca aaacgaccca actaagccta atccaagcaa taccgtccga gaaggtgccg    88200
gtgcacagaa ccgtgtagcc gaatctaatc gtcaagaacg agtatcacgt tctaagcttg    88260
atgctctagc agaagagttg aaattctagg gtaaatttta tgattttgt gtttagcgta    88320
attcgcgacc aatcaggtcg ctcctttgtg gtgacggcgt ctgatagcgt ccatcgtgga    88380
gtcatagctt acaacaaagc agatttatct tcatatgact atggtgaagt taaggcatat    88440
aatgacgaag gtatctgggt taactctgcg atataccttc caaccaagaa tttgacatcc    88500
gacgaagtcc tcgaaaaatt attcaaaaga tagtttactt ttaagtttgg ccatgttatt    88560
atggccttac tgaaacaaac tgaggaaaac aaaatgaaaa agattgtact tgctttaatc    88620
ttcgcagtat caagttgctc tgctgttccc gctctggcga actatgacaa agacctctgc    88680
gaatggtcaa tgactgcaga tgaaaaagat gttgctgagc agattcgtgc tgatgtaggt    88740
catatcattg ataacactga cccaagcaag atgaaagaag ttcaggcaga aatctccaat    88800
gatggcgcag caattaaact gaactatgct ctgtactgcg atgctaattt tgataacttc    88860
acaattgcaa gctggattct cggatgatta catacgtatt agtaatggct ataatgactg    88920
gtgccggcgg tgtttctact gaaaagttat cattcacagg aatgaacgag tcttcgctgg    88980
ctcagaaatg tgaagatgcg ggaaaacaat ttactggcat caaagccgat tccgggttcg    89040
gttcaccatc agtctacact acgtacaagt gtattcgtat tgatggtgga aataataaat    89100
agtttggagg ctctatgaaa acatttaaag agtttgttaa acttaatgag gaaatggttg    89160
ctggcgatgc cggcggtaat cctcagaaca ttgcatcagg cactacttcg ggcgcagtag    89220
taaataaagg cccagaaact ctcccaaaga aaaagcgaga taaatcaaaa cctgaaacgt    89280
gatacaatgg ccttattagt ttaaggccag aggaatataa tatgtcatgg gttgataacg    89340
aattcgctat ccgcgcaata tctcacctac ctaagtttag acacgttact acatcttcaa    89400
catttaagtt aaactgccgt tgcccaattt gtggtgactc acagaaagat atcaataaag    89460
cccgattctg gattttgat gcgggtcaag gattacgctg ccattgcttc aactgtgagt    89520
ataacaagtg gctatcacaa tatcttaaag ataatgaacc cgatctctat cgagagtatc    89580
ttcttgagaa aagaaaggag caggtctttg ataagccaaa gaccgtagaa ccgtctgaga    89640
aaattaatgc aaaactcccc gtaatagaaa aacttaattt ctgtgagcga ttagatagac    89700
ttcctaagga acatccgata gttaaatacg tgactgccag atgtattcca agcacttctt    89760
ggaaaaggtt atggtttact aaccaatggc cttctcttgt taactccgtt aatccaggaa    89820
```

FIG. 20WW sequence.txt

```
cctataagaa tgagacgaac gaaccacgtt tggttattcc tatcttcaac aagaaaggag    89880
agattgagtc gtttcaagga cgagcactac gaaaaaatgc tccacaaaaa tacatcacaa    89940
tcaaagccca tgaacacgcg accaaaattt atggtctcga cactattgat gagtcaaaac    90000
tcgtattcgt catggaagga ccaatagatt cgttgttcat tgataacgct attgcaatca    90060
ctggcgggtc tttagattta gctcaagttc catgccatga taaccgagcg tggattatgg    90120
accatgaacc tcgtcatccc gatacaatta agcgtatgaa acgtttagta gatgctggtg    90180
aaaaggtagt tttctgggat aagtcgcctt ggaaaagcaa agatataaat gatatgatta    90240
tgaaagaggg ggcaactgct tctgaaataa cggattatat taatcaaaat atatcgcaag    90300
gtttaatggc taaattacgt cttgacaaat atgcgaagat ataggggcca aagccccctta    90360
aattaaagca atcctccagt cataataaac gacacaactt tttctaacgg cattggagga    90420
agaactagcc cgtgtgtgct agctaatgga actaccacat aattccatgc agctaaagca    90480
gcagtggcga ttccgacgta aagatatctt ccaaatcctc ctttgtcttt acattctcgt    90540
ttcacttcag acatgaatcc tcctgctatt tatgttaagt gatataatat ttatctaatt    90600
taattgaaag gaaaaataat atgccacatt tcaacgaatg tagtcaactg atcgctggtg    90660
cagataaagc tgaagctcga tacgcaggta tcgtacgcaa agttggtggt gaccctctgc    90720
aagtaatgct tgatatgcaa aaatctcttc aggttcgtct tgcaaatgac aagcctggta    90780
ctaacatgca tcctgatgaa ttggcccaag ccggtgatat cgtgcagtgg ctgcgtaacc    90840
aaaaagatta cattgatgac gaattccgcg aattgctgac gtctcttggc ggtatgagta    90900
atggtgaaaa ggcagctagt gctgtgtgga accatggaaa atctgaccac gtcaaaatgc    90960
aggaaactta tatcaaagac ctgtctgata aagaccagct tgaaatcaaa tttgaaatga    91020
ttgatatcct gcactttgtt ctgaatatgt ttatggcgct tggtctggat tctgaagaaa    91080
tctttaagct gtattatctg aaaaacgccg agaactttgc tcgccaagac agtggttact    91140
gatggccaaa agaatatcta agcgtcgttt aaaaattatc agaaaacaaa agaaagggc    91200
cttagtattg gcccttcgag aagaaatcac tcgagaaatt gataaagaaa tattaaaggc    91260
gcttacagca gctatataaa tactcctgta aactaaatag gagattaaaa tggcttacgt    91320
aaacatcaaa acttttgacc atacaactgc tgatggtgaa gttaaaggta cagaagtatc    91380
tgtagctttt aaggtgtatt ctgattcaca tcgcattgct aacgcacagt atcagatttt    91440
cccatctgaa aaagctgctt attcaacagt agttgatgat gctgcaactt gggcaaccac    91500
caacgctaaa atgtttgaag ctgttccatc tgatgcagaa gtataaaaat taaggactcc    91560
tccgggagtc cttttatgct atactgggaa tagtatatta ttcctactaa ctgaggagaa    91620
gaaaatgata tgttatacta agccctggta tcaatcgtca ttaaagaagt ctcattttga    91680
ttgttggtac agaggtgtaa gagctgcagc gttattactc aaagctgcgc cggctttaat    91740
```

FIG. 20XX sequence.txt

| | | | | | | |
|---|---|---|---|---|---|---|
| taaagcaaat | gataagtggt | ttgaagacaa | caacatgact | gaaggagctc | tttgtggcaa | 91800 |
| acgcaaaaat | ctataacgca | aaaatctata | aagtaagctt | acaacgcgca | gttcaatcaa | 91860 |
| gaagtgatgc | aaatggagtt | ttgcgtctag | accaagatag | aatttttact | gttgctctat | 91920 |
| acagtacgtt | cgacaaagat | ttcaaagacc | tagttaataa | attcgaagcg | tttggttggt | 91980 |
| gtccttctga | agattatggc | attattaaga | ctgcccatgt | ctttgacgta | gatacagttc | 92040 |
| caggaagtcc | tgttgctata | ctacgtgctc | tccacttgaa | aggatacact | aatgtatgtc | 92100 |
| atgaaactag | cttatatgaa | tacgaaaatg | acataatttc | aagaggcaaa | aagattatca | 92160 |
| ttgatagcac | agattctcta | atagaattta | ctaagttagt | ttggttgtat | atgggcgcag | 92220 |
| attttatcaa | actgactcca | agcccgctgt | tgcaaaaagc | ggctgatgga | tataacagca | 92280 |
| gtagttgtct | gtatcgcaat | aatgagtggt | tcatgtgatg | gatttgtttg | aaatgatgga | 92340 |
| agagcctcag | gaagaggttc | aagttcatcc | agtgatttct | aaggacatca | aagacgaata | 92400 |
| ccgtataatt | atacagaagt | atggtattaa | agccccagaa | gctcttctag | atgaactagc | 92460 |
| ttcaatctgg | tctgacccgc | cgccctggtc | tccgtgggca | aataatttc | acaaagtagt | 92520 |
| ttactcttcc | aaaagccatg | ataagatacc | tctcgtaacc | aaaaaatgga | gaatatcatg | 92580 |
| gctatttcat | taaacccatc | tatttcagta | aaattatcaa | aggttattcc | tatcgaaaaa | 92640 |
| cccattcgtt | ccattgatgt | tcttaacttc | gcgcgagaaa | gcaaaggatt | acctttatat | 92700 |
| gatttaagcg | tgtgggaagc | attagccaat | cgttttgact | gcaaagaaca | gtcaattcta | 92760 |
| tggcaatgca | tgaacaataa | gattggcgaa | gaatttcata | agaaacttga | ctctatcgtt | 92820 |
| agacgtcatc | aaattgataa | tagtgacatt | ctctatagag | gtctatcatg | ccgcgagtct | 92880 |
| aaagcctttt | atgacgccct | tattaaagga | gagaaatttg | gctttggaaa | ggttgcgtca | 92940 |
| ttcacaacag | atgaaacgat | cgccagagag | tttgcaggca | aatggcatta | ctcgaccttt | 93000 |
| gtagtcattg | aagtcaataa | ttgccatcaa | tcatttgatt | atcataccaa | catgaaatcg | 93060 |
| ctttttaatta | ctgcaccaga | ttctgaattc | atgcgtccaa | atgatgtgat | tgataacatt | 93120 |
| gctcagcgca | gaagcgctga | catcgagatg | attgataaag | aacaagaaag | gatgctaccg | 93180 |
| atgggaacta | agttcaaagt | ggtgggtcat | aacaaagttg | aaaaatctgg | tttacttatg | 93240 |
| gactacttta | gtgttactat | agcttagtca | actagtgatt | atctagaact | agggacctag | 93300 |
| acccattata | ccgtccgtaa | gacgaaagca | tttttgagga | aaacatgatg | aaatttactg | 93360 |
| ctgaaaccgc | taagatttat | actcgcctga | ttacaacttt | aggttctgcc | cagcgtcgga | 93420 |
| acaaggagtt | caatcttacc | cctgagtatc | tgtttaacat | catgcaacag | actcattgcg | 93480 |
| catactcggg | tgaaaagttt | ggaaccgtca | aaggaaacca | tcctgacagc | atgacgcttg | 93540 |
| aacgctggaa | taatgacttg | ggatatgtaa | tggggaatgt | tattcctgtc | aagcaaaagt | 93600 |

FIG. 20YY sequence.txt

| | | | | | |
|---|---|---|---|---|---|
| ataatacttt | gcgtggaaat | aatacgattg | aaggccttga | gcgaaaagcg | aatgaaatcg | 93660 |
| cagcacgcat | agttcgttct | tcagattctg | ttaagccaac | aagtgataaa | gaagcttctc | 93720 |
| gtttggaaaa | gattcgtgag | tatgaaaaaa | ctataacatc | aattaaaact | aacttacaca | 93780 |
| atcgtgaaaa | tcatctttct | caatttgtgc | aaaaagaaaa | gaatggaact | gcaacctcgg | 93840 |
| ctgatttaga | acttattaat | gcattgagaa | ctcgtatcag | cggtggtaag | tctgaattag | 93900 |
| ctaaagttga | gcgtaagtta | tctgctatt | tagcgtcagt | tccgaatcgt | ccgtcagatg | 93960 |
| ctgaaatccg | tgtacaatca | atacggttaa | ttgttagctc | acttcgtcgg | ttagaagaat | 94020 |
| gctcaatgtt | agataagtta | aaattgaaaa | aaggtcttcc | attgactgct | tccttcttcc | 94080 |
| aactttgag | aggtaaaatg | taatgcaaca | ctatggatat | gtagtagcgt | ataaggataa | 94140 |
| agacggattt | gaccatccag | tcacaactga | tatgtatgat | ggagaacgat | gtgtagtctt | 94200 |
| cactaatgaa | gaatcagcca | ataaagcacg | gattcgtaca | atgtcggttt | taacagacaa | 94260 |
| attggcaaag | gggaattta | ctgggaaaag | caaaaccaaa | gggatgcttt | ggtggaaaac | 94320 |
| aactgagcta | gtgtatgaac | cacttagcga | tgttgagcgt | gaaaaactca | aagcaaaaat | 94380 |
| taaaaatcta | catgtagtga | gggtaaaagt | ggcatgatta | cgtttgacca | attaaaagaa | 94440 |
| agtcaaaaag | cgatttttaa | taaagtcatt | gaaatggtca | acaaggagc | taaaggtcaa | 94500 |
| catattacga | ttaatggacc | cgccggtaca | ggtaaaacaa | ctttaaccaa | atttatcatt | 94560 |
| gacgctttga | tttctcaggg | tatctctgga | attgcattgg | cagcacctac | gcatggggcc | 94620 |
| aaaaaggttt | tatctaagct | cagcggaatg | caagccagta | ctattcatag | tcttctgaaa | 94680 |
| attaacccga | cgacatatga | agaaaacgtt | ctgtttgagc | aaaagaaagt | tccggatatg | 94740 |
| gcatctattc | gagttcttat | ctgtgatgaa | gcttcaatgt | atgaccgtaa | gctgtttaag | 94800 |
| attttgatgg | caactattcc | tgcctggtgt | attgtcattg | ccattggtga | taaggctcaa | 94860 |
| atacgtccgg | tagaacctgg | aagtaatgaa | cctgcactga | gtccattctt | cactcataaa | 94920 |
| gatttcttac | aacttcatt | gaccgaggtg | atgcggagta | atgctccaat | cattgaagtt | 94980 |
| gctactgaaa | tcagaaacgg | tgggtggatt | cgtgactgtg | tagttgatgg | tcatggcgtc | 95040 |
| cgtggtttta | ctaaaggaac | cgcccttaaa | gatttatgc | taaattattt | taatttagtt | 95100 |
| aaaacaccag | aagatttatt | tgaaaacaga | atgcttgcat | tcactaataa | atctgtggat | 95160 |
| aaattgaacg | aaataatcag | acgcagaatc | tatgaaactg | aacgaccatt | cgtagtaggt | 95220 |
| gagattgttg | ttatgcaaga | acctcttacc | aaggaactta | aatttgaagg | gaagaaattc | 95280 |
| agcgaaattc | ttttcaataa | tggtcagttt | gttcgcatat | tagatgcaat | tgaaaccacg | 95340 |
| tcattttag | gtgccagagg | tgttccaggt | gaatatctgg | ttcgtcattg | ggtattagat | 95400 |
| attgaaacct | atggcgacga | tgaagagtac | gctagagaga | aaatctgtgt | catctcatcc | 95460 |
| gaagaagaaa | tgaataagtt | tcaattcttc | ttggcaaaaa | cagcggatac | atataagaac | 95520 |

FIG. 20ZZ sequence.txt

| | | | | | | |
|---|---|---|---|---|---|---|
| tggaataaag | gcggtaaagc | accttggtct | gaattctggg | atgctaagcg | caagtttcat | 95580 |
| aaagtgaaag | cattaccagc | ttcgactttc | cataaggccc | agggcatctc | aattgacaga | 95640 |
| agcttcattt | atactccatg | cattcacatg | gcagatgctt | ctctcgcgca | acagttatta | 95700 |
| tatgttggta | ctactcgtgg | tcgctatgat | gtattctatg | tgtgaggtaa | tatgtttgaa | 95760 |
| ttgaaattag | aagaccttca | aacaatgatt | gttggcttac | aagaatctaa | gtttgaagca | 95820 |
| ccagataatg | ttaagcgtgc | tattaacatt | aaaattgata | tagttctgaa | tgagcttcgt | 95880 |
| gatatagcag | ataatgctaa | tgctattact | tggttcacag | gatatgaccc | aaaggtgtat | 95940 |
| ctgagcgaat | atattggttg | ccagttacgc | gaaattaaat | ttatgctaga | ggctcaaaat | 96000 |
| ggctaaagac | tttattattg | attttgaaac | attcggaaat | gtgtcaagct | cttctgtgat | 96060 |
| tgaccttgct | ctaatcacat | ttgattctga | ccccgaagtt | ttggaaagct | tcgatgaatt | 96120 |
| ggttaaacgt | ggtcatcgta | ttaagtttga | ccttaaatcc | cagaaaggtc | atcggttgtt | 96180 |
| tggtaagtct | actcttgagt | ggtggaagaa | acaatcagct | gaggcccgtg | ctaacctggc | 96240 |
| ctcaacgcca | gacgatttat | cagtaattgc | tggaattaaa | gaagctcagc | aatatctgat | 96300 |
| tgataatgga | attcacccat | gggattcctt | tggctggtgt | cgtggacaga | gctttgactt | 96360 |
| tccaattttt | gttgattgtc | ttcgcgatgt | tcaacgagcc | caaggaattt | ccgaagaaga | 96420 |
| aattgataca | tttaaagaag | aaccatgtaa | gttctggaat | cagcgtgata | ttcgtaccgc | 96480 |
| gattgaatca | ctgcttctta | cccgcgggct | gacaactacc | cctcttccaa | agggtactct | 96540 |
| caacgggttt | attgcgcatg | atagtatcca | tgactgtgct | aaagatattc | taatgcttaa | 96600 |
| atatgctcaa | cgctatgctc | taggcctaag | cgaagcacca | agtccagaag | ataccgatcc | 96660 |
| actgagttta | cctaaggggc | gtggctaatg | gaagagtttg | agttcgatga | aaactttgaa | 96720 |
| gagtggttca | accgggaaat | cctcccgaaa | atctctccaa | cgatggttct | ggtggccaag | 96780 |
| gctttgatgg | ctaaaggctg | ggacgcaggg | tatatgttcg | gcgtcgatgt | tgggtgtgaa | 96840 |
| atttctcacc | gatagctatt | tactttatga | aagagccgtt | atataatggc | tctacattaa | 96900 |
| caaactgaga | gaaacatgat | gaaaaatttg | gttgtaggcg | aaaacgttaa | agtaattggt | 96960 |
| ggtaagcata | tcggtaaaga | aggcgtaatt | gttggaatct | ttaaccgttc | taacaaaatg | 97020 |
| tcttcatatt | tgcttcaatt | ggaaaatgaa | gacaaagccg | tgtattcgct | gcaaaaattc | 97080 |
| gtagttgctc | tagaatcgcg | cgatttgctt | gattctatgt | taacgaaag | ctatctgcgc | 97140 |
| aagtgggtac | atgtgaattc | acttgacaat | gttattaccc | aatcggtgag | ttctactaat | 97200 |
| tcagccacta | atctgtcgct | gcataaaaat | gttcttgtca | ctgatgagtg | ggaagaagac | 97260 |
| ggtaaaaccc | tagtaaacgt | agtgtttcaa | ggcaactatg | cagttctgcc | taaagccgat | 97320 |
| gtagagccga | cagaatcgca | acgtcaaggt | ttagtataaa | aagttgttta | ctttgccaca | 97380 |

FIG. 20AAA sequence.txt

| | | | | | |
|---|---|---|---|---|---|
| aggatgtggt | actattatct | tatcaactac | tgaggagaat | aacatgaaaa | ctgaaaacac | 97440 |
| cgtaaaaatt | actgccgaag | cttttgaaga | cattctgttc | aacccggact | taatcgtcgt | 97500 |
| tcagaaagag | aaaaccttcg | gtaaagaaga | gcattggacc | tggttgtatg | tattcgcgaa | 97560 |
| ccatggtgat | atcgtcccag | ttcgtacctt | tgctcgtgta | attacagttg | atggcccaga | 97620 |
| atacatggag | attgtgtaat | gaattttaaa | gaaggcgtac | agtacaaatt | cgtcaatgat | 97680 |
| gaagcggaag | aagaattttc | ttcacgttat | gaggttaatg | aagactttgt | gtatgaactc | 97740 |
| tatgaaaatg | gcgggagttt | tactgttact | aaagttgacc | gccaaaataa | tagagtatca | 97800 |
| ggaattatgt | gggctaatgg | cacagaatgt | gatgaagtcg | gcggtgaaga | ccttgtaatt | 97860 |
| tttgatagcg | aattcaaata | ctttactgaa | gttggaactt | ccgcgaatgt | aattccaacc | 97920 |
| gatttggtta | tgaatctttc | tattcataac | cgtggtcaag | caatcgctgc | tattgcagca | 97980 |
| ctgcagagtg | catatcaatg | ttaaatttag | ctcctatttt | tgaagcatca | aaactgtctt | 98040 |
| atcctattcc | taaccgtagc | attgggaatg | tcatgctgca | actttcttca | gaaactggag | 98100 |
| aaatgtgtga | ttggattaat | cgtccatggc | ggcagaaaga | agagtttgaa | ggtgagtgcg | 98160 |
| cagatgttat | taactgtgta | gtagatgcac | tttggctgca | tttcagaaat | cgtcataaaa | 98220 |
| atgataccca | tgtatcagat | gatgaaatct | ccatgatggt | tactcgtgca | ctaaatgagc | 98280 |
| aaatcatggt | caaaacacaa | aaatggaagg | atgctgttaa | tgccaatgta | tgattacaag | 98340 |
| tgtgaagtct | gtggaaaaaa | gatagaaatt | atgcgtaaaa | tttcccatcg | tgactatact | 98400 |
| gttaactgct | ttaaccctaa | gtgtgaaggt | caaatgaagc | gggtggtttc | tgctccggca | 98460 |
| gttcactacg | atggattaaa | gagtggtgat | tattgatggg | aactaaagca | cgcattacca | 98520 |
| tgaaacccgg | agaaatccgg | gttattaaag | taggtaatat | aacttatagg | gttaaattga | 98580 |
| aatgaaaaag | attttaatta | cagcgcttgc | cttcatgatg | attggatgca | ctgacgctga | 98640 |
| taacgcaact | cgagtattag | aaaatgcagg | attcactgaa | gttgatatca | ctggatacaa | 98700 |
| attttctctca | tgttcagaag | atgattttca | gcataccggg | ttcaaagcgg | tcggtcctac | 98760 |
| cggaaagacg | gttaaaggta | cagtgtgttc | tgggattttc | ttgaagaata | gtactattcg | 98820 |
| ttttgaataa | aaaggacctt | cgggtccttt | agttgtttac | acgaatagtc | ttctgcggta | 98880 |
| ttatagactt | ataaactact | ggagaataaa | acatgaaata | catcatctta | actttaatcg | 98940 |
| cattagttat | ctcaattgga | gttctggttt | ccttagcaga | ttctacggaa | tcttctaatg | 99000 |
| aagttcagaa | aagctcaatt | ggtattggtg | tgaatggaca | agttggtgtt | aagatttcag | 99060 |
| ataatctttg | tgttaatcct | tctactggtg | ctgctgaagt | atgcttttaa | aatgtattga | 99120 |
| tataatgcct | ccactaactg | aggaaatgta | atgattaaga | acgaaattaa | aattctgagt | 99180 |
| gaccgagaac | atatcattaa | gcgcagcgga | atgtacatcg | gtagttctgc | gtgtgaggca | 99240 |
| catgaccgtt | ttcttttttgg | taaattccaa | tcagtaaagt | atgttcctgg | tattattaag | 99300 |

FIG. 20BBB sequence.txt

| | | | | | | |
|---|---|---|---|---|---|---|
| cttattgatg | aaatcattga | taactctgtt | gatgaagcaa | ttcgtacaaa | ttttaaacat | 99360 |
| gccaataaaa | tttccgttga | tatcaaggga | aataagatta | tcgtaactga | taatggtcgt | 99420 |
| ggtcttccac | aggctccggt | agtaactcct | gaaggagaaa | ctattccagg | cccagtcgcc | 99480 |
| gcatggactc | gtcctcgtgc | gggtggtaac | tttggcgatg | atgctgagcg | taaaactggt | 99540 |
| ggtatgaacg | gtgtcggttc | tgcattaact | aacatctttt | cagtatcttt | cactggtgca | 99600 |
| acatgtgatg | gtaaaaatga | aatcattgtc | cgttgttcta | atggctcaga | aaatatctcc | 99660 |
| tgggaagaac | atccagcaaa | agacaaagaa | ttcatcaaag | ataagactgg | tactgtagta | 99720 |
| tcattcattc | cagatttcag | tcactttgaa | agcacaggat | tgactgatgt | tgaccaatca | 99780 |
| atcattcacg | atcgtctgat | gacattagca | gtagtttatc | ctgatattga | attcaaattc | 99840 |
| atgggtaaac | gtgttcaagg | taagtttaaa | gcttacgccc | agatgtatga | tgaaaatgcg | 99900 |
| gtagtgcagg | attctgatac | ttgtgctatt | gctattggtc | gctcagatga | tgggttccgc | 99960 |
| cagctttcat | atgttaataa | cattcacacc | aaaaatggtg | gtactcacgt | tgacctagtt | 100020 |
| cttgatgaac | tgagcaatga | acttattcca | gcattaaaac | gcaagtacaa | actagaagtt | 100080 |
| aataaagcac | gaattaaaga | gtgtctgact | gtcattatgt | ttattcgtga | catgtctaac | 100140 |
| atgcgatttg | attctcagac | taaagagcgt | ttgacttctc | cttggggcga | aattcgtagt | 100200 |
| catattgata | ttgattacaa | gaaacttgct | aacgctatta | tgaaatctga | agatattcat | 100260 |
| atgccgatta | ttgaggcgat | gttagctcgt | aaacttgctg | cagagaaagc | tgcagaaact | 100320 |
| aaagccgcca | agaaagcgca | gaaagctaaa | gtagctaagc | acatcaaagc | caacaaatat | 100380 |
| ggtaaagatg | ctgacaccac | tttattcttg | accgaaggtg | attctgcgat | tggttatcta | 100440 |
| ctcacaactc | gcgaccgtga | acttcatggt | ggatatcctc | tacgtggtaa | gttcatgaat | 100500 |
| acatggggaa | tgtctgctgc | agatgctatg | aagaacaagg | aagtatttga | catttgtgca | 100560 |
| atcaccggtt | tgacgattgg | tgagcctgct | gaaaatacta | actaccgaaa | tattgctatc | 100620 |
| atgaccgatg | cggatgttga | tggtgttggt | tcaatttttcc | caagtctttt | agcgttttc | 100680 |
| agtaattggc | ctgaactgtt | tgaacaaggt | agaatccgct | ttgtgaaaac | tccggttatt | 100740 |
| attctcacca | aaggtaaaga | acaacgttgg | ttctattctc | ttggcgaata | tgaagaccat | 100800 |
| aaagatgatt | tcaaaggttg | gaaacttcgt | tatattaaag | gtcttggttc | tcttgaagaa | 100860 |
| gatgaatatg | aacgtgttat | tcaagacccg | gtttatgatg | tagtatctct | tcctgaaaac | 100920 |
| tggaaagaac | tgtttgaatt | aattatgggt | aatgatgctg | ctccacgtaa | gacctggatg | 100980 |
| agtgaataaa | tagtacgggt | aatattgccc | tgctatagaa | ggaattacta | tgcaacgtta | 101040 |
| ttggattact | ttggtctcag | gcgattacgg | atacatgttt | gccgaaaaga | aacctctccc | 101100 |
| tggtacttgg | gttactatct | gggtggaaaa | ctcggatggt | tctaaacatg | aggtgtatgg | 101160 |

FIG. 20CCC

```
                              sequence.txt
ccgcgttagc agagtgcatt aatcccgagg ggcttcggcc cctcttttct gaggaaatta    101220
ttatgaagtc aactatcatt tcaatactcc gcactgaggc actaaaatac tcagtcgacc    101280
cctccaatga ataccaagaa ctttttaatca aacggttatt aaattctata gctgaccgtt    101340
tggaaagtaa ccagagtgtc cctattaatc acagccttt tgctatgaaa gtgatacgct     101400
ttttacgtcc tgatattaaa attgctgaca tggtcaaagt gattaaatcg tcaggagcag    101460
taaaatgcta aagaaaagtt atgttccaaa taaagaatta tttgatgatg ctatatatcg    101520
agagtatcgt atcatccaac gtttctttga tatccaagca gcagaggaat tcaaagaccg    101580
ctttaaacaa atcagtgata aaatttttac aactaacacc gctactgctg aagagctcct    101640
tgaagtagca gaaatcatta aacgacacaa ttgataggaa taaaatgaaa attaaatgtg    101700
atgatgaagt aattattggt tcttctgacg ctgaggattc aacgtttacc attaaagctt    101760
caggtaaagc ttttgacatc ttgtcaaaca aactctataa gtataaagtt cgtgcggttg    101820
ttcgtgaact ttctactaac tgtgatgatg ctcataaact gaacggtaat gaaaatcgtc    101880
cattttacat caaagcacca actcgtcttg acccgcgctt tgtaattcgt gattatggtc    101940
caggtcttaa tcataatgac atgatgacga tgtacaaaac gttctttgaa tctacaaaga    102000
ataatagtaa tgatttcatc ggtgctcttg gtcttggttc taaatcgcct ttaagctata    102060
caagtacatt taacgtagta tcatatcata atggtaaagc caccggttat actgtcatga    102120
aaaaccgcgg tgaacctact attcgtccga tgtttgtcga tgatatgaaa gaagacgaag    102180
aaactggtct tgaaattaca gttccggtta agtagaaga tattgatacc tggcactatg    102240
aaatcgcata tattttgcgt acatttggtg ctgtacctcc aaaggtagat tctcttcgcc    102300
gtgaaattga atatttccca gtagataaaa ctgattggtt tagcgttaat agctcttacg    102360
aaagttatgg cctgtatgca gtttatggaa aaatcgtata tcctatcagc ggtgtagatg    102420
ttaaggcaga ttggctgctt aatcgctatg gtaaggttta tgttcatttc ccactgggtg    102480
aattggatat cactccatct cgtgaagagc tttctcttga cgaagaaaca attgctaata    102540
tccagaagcg tgtgaatgct cttgaagaag aggtaattac cgcagatatt aaagcgtttg    102600
aagcgtatga atctgaccgt gaattcctgc gtgagttcaa taagctgagt tctaaggaac    102660
gctctattct tcagagccgc ggtattacca ttgggaaccg cgatattaaa caagtagttg    102720
cgaagtataa tcttgataaa attcgttcat actatgtaga taacgaagta tcagtttatg    102780
tttcatgcga tgaacctgct cgtcgtaaag tgtcaagcag ttcttggcat cgtcataacc    102840
aagtaaacat ttctgatatt tgcggggttg atagaactaa agcgtttgtt cttattgacg    102900
ataaagcggg taagcgtatt gctacggttc gtgctctgtg taaatctggg ttagttccaa    102960
tctgggcaca cattactgta atcaaagaca atgaagatga attacatgtc attgatgagc    103020
tgaagaaaat catggatact gatgaagttg tagtattccg tgtgtctgaa cttgaagccc    103080
```

FIG. 20DDD sequence.txt

| | | | | | |
|---|---|---|---|---|---|
| agagaaaagc | tcttcctgat | tacgacactg | gtccaaaaga | gaaacgtcct | aaatcaccaa | 103140 |
| atgtttctct | gcattggatt | gataaagacg | ggtactggga | agaagaccgt | cagactttat | 103200 |
| tatcatctga | aattactgag | cttgaaggtt | atgctatcgg | tcgcaatcgt | gatgaaatcc | 103260 |
| acactttccc | agataatgtt | tggtggtgga | atatgagcat | cacagatatg | cgttctttgg | 103320 |
| cagaagcatg | tggaattaag | aaattctatg | caattcgtcc | gagtgctatg | aaagccgcgg | 103380 |
| ccaaagctga | tggattgctt | tcatttgacc | ggtttattat | tgaccaatac | atcaagtgta | 103440 |
| ttgataaggt | agactacgac | cagtacatgc | catcaaatgc | tactggaaac | cgtatctgtg | 103500 |
| gaaatattgc | gcattacgat | aaattgaatt | tcttgtcgag | taagtttact | gcgtctggaa | 103560 |
| tgaaaaatcc | gttcctgaca | aaactaaaca | aaatcgctaa | agtttgtcgt | acaagtaaaa | 103620 |
| tcaaagatga | aaatgatgaa | aacaatgatt | tagctttatg | taataaaatt | tataataaac | 103680 |
| tgtctagtga | tgctgagaca | atcttctata | aaagattga | acagtttaaa | gatgattatc | 103740 |
| ctgtcatcgc | aagtgtcttg | gatacttggc | ggactgacag | caaactcgtc | gatgatatcg | 103800 |
| taaaaatcat | ggagctcctt | gatggagctt | ctactcaaaa | ttctgaaaat | aaaggtgaat | 103860 |
| aaatggctgt | tacctgtctg | tctgaaatcc | aaaaagatgc | aatcgttaaa | aacttcaaaa | 103920 |
| acggtctgta | cactaagaaa | gagctcgccg | agaattatgg | tgtttcccgt | gacactattc | 103980 |
| ggcgtgtttt | taaagagcgt | gaagctcgag | ctgccgcggc | agctgttcct | gctaaagtag | 104040 |
| aagctccagt | tgagcgtgaa | tttaaatggg | cagcaagttc | caaattcatt | tcaattactg | 104100 |
| aaggccgtac | tacttataac | gctgatagcc | aacatcccgg | gtttaaatct | gcactgcaga | 104160 |
| aacttgtaga | tggtgatatc | gctggtgcta | ttgaccacat | taacctggaa | caaggcatca | 104220 |
| agaaattcgt | tcagggtaac | gtccgaattg | aagatggtac | tttgttctat | aaagatatcg | 104280 |
| agctgaaatc | tggtctgact | gagcgtatcg | ttcgagctat | ggaagatggc | gaagacttta | 104340 |
| aacgttatct | gcctttcctg | gaaaacctga | tgctgaaccc | gtctcgtcgt | gcagtttatc | 104400 |
| gtctgtttga | tttcctgaac | gcaaacgata | tcgacatcac | tgatgatggc | cacttcattg | 104460 |
| gttggaaagt | agttcgttcc | aattacttcg | attgtgcttc | aaacacattt | gataactctc | 104520 |
| cgggtaaaac | tgttacgatg | ccgcgtaacc | aggtagatga | agatgatcag | cgtacttgtt | 104580 |
| ccacaggtct | gcatgtctgc | tctaaatctt | acatcggtca | cttcggtagt | ggttccgatc | 104640 |
| gtatcgtttc | agttaaagtt | catccgcgtg | atgtagtatc | tatcccggtt | gattacaacg | 104700 |
| atgctaaaat | gcgtacatgt | ggttatgtag | tacttgaaga | tgtaaccgat | cgttggggtt | 104760 |
| cagaacttcg | ctaattataa | ggagccttcg | ggctcctctt | ttattatggg | tgaaacatga | 104820 |
| ttaatccatt | taacgtatct | cattctaaag | ttgttaatct | tcgtggtact | catcatgctg | 104880 |
| ctacggtatt | ttgccatcat | gtagttaaac | atgaaggtga | tgttcactat | gcttggttgc | 104940 |

FIG. 20EEE sequence.txt

```
actgtgatga actcgtagaa cttggtgatg attttgttgt ggaaccagac acatgtaacc   105000
acgacgatcg tgtttatttt ggtgaattac atatcagagg aatttatggc attgatgaac   105060
aaagccctgc agagattgaa ccaactccgg acatttaccc tagatttgaa taagctaagg   105120
ggtgaagcaa aagtaaaaat cattgatact gccagatata gcttagatat cgatccatct   105180
caagatagaa ttgacgttct taaacgatgc agaattgcta taccggcaga gtatgtggta   105240
gcggattttc ttgatggata cgtgaacgat caagttgttg accataataa caacgaccca   105300
tatgaatggg cctgggacgt attagctcat ccacactacc aaggtgttag ggttgaagtt   105360
aaaacacact ttgttcatga ccgagcaaat cataagccat ggattaatgt tacaactggt   105420
aaagacggtc cattcccaga tggaagtgga ataaatctag ggcccatgtt taaacataaa   105480
gtcgcagact gtataattat attcgttgca gaagaagtgt cccagaatgt catacggtac   105540
acaccaatgt ttgccggcgg tatcgaacag ctcatggaag tagtaaaacc ttcacgtgtt   105600
ggagctggcg ggtatatcat gcacaaattt taaaaagttg tttacttccg ggattggcca   105660
tgatactatg gccctacaaa ctgaacggga gtaaaacatg agttacttag agctaaaatc   105720
acttcgagcc aaacgcggaa atgcttctat taaagctgag cttttgaaag agtatagaat   105780
tctcgaatct atgaattggc attatgctat cattgcttgt gataatggcg attcaactta   105840
cggtggattg tatcccaatg gagccgctgc tgcccgtgat gagcataaag ataaagttaa   105900
agccttagaa gaaaaaattc gtaacttgtg catttaacgg tttactttcc tgttcttcgg   105960
tgatactata atcttgttag ctaaactgga gaacaaaaat gaaaaagtta cttacgattt   106020
tgaagaacac ctttgtagta ttctgcctta tcgttacttt cattggtgtt ttcgcatggg   106080
atttagttaa cgtttggatt aatgctttca tctgaggaaa atataatgat tcgtagtagt   106140
tttgatcgtc gctttaactt aatgagaact gttgttctgt cctttatcgt tgcggtagcg   106200
cttggaattg ttgctatatt cggggtcgga atttattttg ctattcaagc ggtagatatt   106260
attcagaccg atggccttaa atctttagta gaaaccgtat gggaaggtca aaaatgaaac   106320
gacacatcgt gtatcgtctg ttggcttcgg gtcttcttgc attttgggtt ggtatcgtga   106380
cagtggtagt agtatttggg taataagagg ggcttcggcc ccttatcgga gaataaactt   106440
taatcaactg aggaaattaa catgcgtaat attatgactt ttgctgatct cgataacgct   106500
ggtgcagaac tgatcggttc tattcgtaac ggtgattggg cagcaggtgc tccatctcgt   106560
gaaattactg agcgtgaagg atttttatttc ctgatgttca atgatggcaa agcaggttat   106620
atcggtgcat ctgctcgttt ctttgtagct aaacaacgtt caaaggcagg atttgagagt   106680
gttctttctc atatccgttc tggacgttct cagttgggtc gtaccttcg ttcaaactgt   106740
gtaacatacg gtgtgttctg gattcctgcc aataaaatga aaccgctcac caccggttat   106800
ggcaaaggtc aacttgcact ggcgtttact cgtcagcatt caagcgccgc gcagacctac   106860
```

FIG. 20FFF sequence.txt

| | | | | | | |
|---|---|---|---|---|---|---|
| tctgaactga | atcgtattct | gaatgataac | ttcatcttta | ctttgcagaa | atactaatga | 106920 |
| gaaccttctt | cgtgatgggc | tatgtgtttc | tgatggccct | aatgatttgc | tcaggaacat | 106980 |
| tcatgtggta | tggccttgtg | cctaccacta | aagtaatcgg | aagcattgcg | ttcactgcag | 107040 |
| catttattat | gtttgagcgc | atttgtaaaa | ttgtaggagt | ttacaaatga | ttaaaggaat | 107100 |
| tgctggcgga | atttgggctg | ctctatgcgt | atcgacattg | actaccggtg | aaacttctgt | 107160 |
| tatttcgcag | gcgttagcgc | aaggaacttt | atcaattatt | cttattatag | cagccttttc | 107220 |
| caatgattaa | gaaaattttg | attggagcgg | ctttagtagc | cgctttgctt | ttaattttgt | 107280 |
| actatggaat | gatttacggg | atgatttata | ttgtgctttt | catttccgat | gttatagtac | 107340 |
| aaatcggctc | actaatttgg | taggtacaat | ggatattttt | gacactctat | taaaacaagc | 107400 |
| aggttctatc | gatgatttgg | ctaaggcatc | aaatcttcgt | catcgcgatt | tgaaatctat | 107460 |
| cattgataat | gaagcaaaag | agtatgcgat | ttacactgta | gaaaaccgtg | ctattccgaa | 107520 |
| cttgattgat | gggtttaaac | ctgtacagcg | ttttgttatt | gctcgggctc | ttgatttagc | 107580 |
| tcgtggtaat | aaagaaaaat | tccataagct | tgcgtctgtc | gccggtggtg | tagctgattt | 107640 |
| aggatatcat | catggcgaaa | cctctgctca | agatgctggt | gcattgatgg | caaacacatg | 107700 |
| gaataacaac | tatcctctgt | tagatggaca | aggtaacttc | ggttcgcgtc | tggttcaatc | 107760 |
| tgctgcggca | agtcgttata | ttttctgccg | gatttctgac | aacttccgta | aaatctacaa | 107820 |
| agacacagaa | atcgctccgg | tgcataaaga | caaagaacat | gttccacctg | cgtattatct | 107880 |
| tccggtaatt | ccgactgttc | ttctgaatgg | cgttcgcggt | attgcaacag | gttattcaac | 107940 |
| ttctattctt | ccgcatagtt | ttgaatctgt | tttggaatgc | actaaagcag | cacttcgtgg | 108000 |
| cgaaatgatg | gaacctgaag | tacagtttcc | taaatttaac | ggaaaaatcg | ttcaaacaga | 108060 |
| agacggttct | gttgagctgc | acggcgtgta | taagaaaact | tcacggaact | caatctatat | 108120 |
| cagtgaaatt | ccatacaagt | ttgaacgagc | ttcttacgtt | gaaaaagtac | ttgacccgtt | 108180 |
| ggaagatgca | ggatatatca | catatgatga | tgactgttct | aagactggct | ttggctttaa | 108240 |
| ggttaaattc | cgtaaagact | atgctttaag | cgaagaccct | gagcagcgtc | atgctaaaat | 108300 |
| catgaaggat | tttaaactca | ttgagaaaat | gagtcaatac | attgtggtca | tcgatgagaa | 108360 |
| tggtaagctg | aacgacaagt | tcaaaacttc | cggtgagctg | attcgtcatt | ttgtagaagt | 108420 |
| ccgtaagaca | ttcactgcca | aacgaatcga | gcataaaatc | gctgaaacta | gcaggcgtt | 108480 |
| taatcttgct | caggcaaaag | ctcaatttat | caaagaggtt | atcgcaggta | acatcgttat | 108540 |
| ccaaggtaaa | actcgcaagc | aactgactaa | agaaattgaa | caaaatgaac | tattcaaaga | 108600 |
| ccattctgaa | aaactcgttt | caatgaacat | ctatcacatc | actgatgatg | aagcgaagaa | 108660 |
| acttgctcag | gaagcaaaac | gcctagcaca | agaggttaag | tactgggaaa | agacaactcc | 108720 |

FIG. 20GGG sequence.txt

```
tgaagccgag tatctgaaag acctggaaga actatgatag aattttattt aattataggt    108780
tctgtaattg ccgtattagg tttagtttta ttgctcctca gttaatctag ggaacctgga    108840
ggtcatctcc aggtccttcc atataaatct atatccctcc aaaatccttc cttagaatgc    108900
cccaaattat tttcacaaag ttgtttacat gcttactcgg ttgtggtatt atagcaatat    108960
caaaacaaca cggagtaaaa caaaatgatt acatcattaa aatctgatat caaaaacatt    109020
ctttatattt ccactcaagc cgatggcact cgactgagcc actatgtcaa aggtaacatt    109080
gtggtgctcg atgagttcga agttaatcgc gagtatccta tgcgtcaggt aattcaagca    109140
agtaactatg aagacggtga agagtatcaa gtcgttcttt gtgtatatga tgatttctgg    109200
gtgcttaaac ttgagaatgg cgataagttc ttgatcttta acgtataaca tttttactgc    109260
tctttgaaga aaattttca gagagcagaa taaaatggtt tacaactgct ttaaaccatg    109320
gtattatagt ctcataccaa acaaactgaa taaaacatca tggagaatca caatgtctaa    109380
agtaacttac atcatcaaag cttccgaaga tgctctgaac gaaaaaactg ctgctatcct    109440
ggttcaggta gctaaaaagg atttcatcac ttcttctgaa ctgcgtgaaa tccttgaaga    109500
aaccatgaac gcaagttctg ttaactcaaa catcggcgtt ctgattaaga aggtctcat    109560
cgagaaatct ggtgacggtt taatcatcac tggtgaagca caggacatca tctctaaagc    109620
ggcagttatc tatgcagaag agaacaagcc tgaacttctt aagaaacgca atactcgtaa    109680
agctcgtcct ctgactgaag atatgaatga gcacaaagac ctgatgatga aacttctcgg    109740
tgagatggaa gatatcttgc ctttgaaaga actgactgtt taccgcagta actatatcgc    109800
agttctggaa aaacgtacct tcggtattcg tagtcttgaa gttaacaaca aggtactttt    109860
ccgcatcttc ggttacaaga tttctgaaga gcatcagaaa cacttcactg acctcggaat    109920
gtcttgccgt gtagctgcaa caggcaatac ttacttagat atcgcccgta ctgctgaaaa    109980
cattgaaacc atcatccgct ctattaagga actgtaatgg aactttggga aattatatat    110040
gaagatgatg tgaatatcag aggcagcatc ttcattaagg ccctggacaa atatcacgcg    110100
attgaattgt ttgaacagtt acagcaacaa acttatatca atgaatcgcg ttatttaatt    110160
aaactcgcaa tgttttggt ggaataatga acaagtttaa agtattgaat gagcttcagc    110220
gttgtgttga aaaggttaac ttgaatgcta atatcccaac tgattgttgg gatgtatggt    110280
tccgtggaca ctttatcgga tacattgata agaaattcac aaaatgctat gctatctaca    110340
atgcagatgg taaacatatc atggatgtag ataattacca aaaggccctt gctaaatttg    110400
ttccattagc ggaagctgtt aactcaatgg aatggttaga gaaaatacag ggtgaacctg    110460
ttattcgcca gattggtatt cgtgaaaaga aagtttgtg gcagaaaatt aaaggattct    110520
ttaaatgagc aagttttccg aacaaatgaa taaatttgtt gatgcttctc gtcacggtgc    110580
tctaattaat gaaccagaag aagttagtat tcctgaaatt tgctttaaag tagctgattg    110640
```

FIG. 20HHH sequence.txt

```
gtgggatgga cgattacttc aacgccgtat cgtttgtgca gcaaatcgtt ttgaattgaa     110700
atctggtgga acaattgtgg ttccaggcac tcgccattat tctgttgata tggcgaacgt     110760
tctagatatg ttccgtgaca aactggtttc tgaccatgtc catggagaca atcaaggatt     110820
tgtcgaccag tggggtgagt acttcacacg tgaagaagca ttaatcatcg ctacacatgc     110880
aggtcaagtt aatacagttc gtcctaaatc aggacccgcc aatgaattat tctcagagga     110940
tttatactaa tgattagtac attaaagaat aacattacgc ttttaaaaat tcaacgtaaa     111000
tcgcttcagc gctcattaga aatgatggac gataattggg gtacatatac caatgaagcc     111060
gggtttaaaa tggcagatag caaattcatg aaaactctca tggataagga atacatctgc     111120
ccgtttagcc atccatttaa tggcggtgct aagccatttc ttgctgaaat gtacaaaata     111180
atgacagaag aaatgattaa agatattgac tattcatca aggaacttga atgcaaggaa      111240
gataaagtgt gagagcaata agcgccaagg cagattactt caatagctta aatcgttcag     111300
aaaaggctca aattaaacgg tttatcttgg aattgggata tgtgcatgcc ggagatttaa     111360
aagcacatat ccaagaatgt ggtattgcta agcgttttga tattacacgc aactgcttaa     111420
atgaggtaat tgcacatgta caacccagta gcgaagaatg actttaacaa aggaggcgcg     111480
cataaagata aaaagcgtgc tgctaaagaa tcaaaacgta agcaaaaaca taaggtaaa      111540
gacaatgcgc attctgaata attctaaatg tactacttta accattattt gtgatgacct     111600
agaagctctc cataaaaaat taggggacca ttctggatta gtagcagata tccattctga     111660
actaatggaa gacctccaga atgctggata tggggactgg atggtacatg attggaataa     111720
tggtaccttt actgtagcta ttattgctaa cgttgaacct gaagaagttc ttgaacaatt     111780
tcagaaatgc gttgatgctt atgatattgg agattatcta tgaatactga aactttacgc     111840
agagaagatg aagccaaggc atatcataaa cgtgttgaat tactttcagc aattaaagta     111900
gaatacactt tacaagttag gcttaaagtt cttaactctt gggctaatga cttagaagta     111960
aaacatttag aacaagcagt aatgtttacg tttactcagg aagcttctaa accgtttagt     112020
ctatcagcag atttccacac gtatggaatt attactatta agcaaagga tagaggtgac     112080
attataagtg gagttgagta tattgaaagc attttaggta atcgcggaga ggttgtttta     112140
gcatgagtca taacttagaa tctgtcattg aatcacaaag atatctcgaa gcgttaatga     112200
ataaaatcgc gcttggaagt ctaatcgact tgtcctttca ggaggcaatg gacgtatgtc     112260
actggatgaa tcgtagggtt cgtccaattg gaaaggaatg gtatttaacg gctaaagtaa     112320
aagatggtcg ctacgggctc tggatgtcct ctggtgctga gtatatcact accaaggaag     112380
atttgaattc tcgttgggaa ttggcataaa ctggtttaca acgtggtatc aagatgatac     112440
tataatcaca taatccatta tgttgtagga aaaataatga ctaagtttga aattgtccaa     112500
```

FIG. 20III sequence.txt

```
gaaattgtta ccgttgcttc tattctgact aagttcaatg ctgaacatat catggagaag   112560
cgagatgaat ttattgcgtt cttgaacgaa attggaatca agaacgagca ggggcgtcag   112620
ttaaatcaga gcaacttccg taaaatggtt tctgagttaa ctgacgaaga gaagagaatt   112680
ctcgttgaag aatacaacga gggatttgag tctatctatc gaacaatggc tatgcatagt   112740
aataagtaat cacttagctc ttcctagagc tctaaccgcc tgaccacata tcgatgttag   112800
tctttcgtta gataatgcag gtttggaatt gtaccagtac atttcaacag ttccagcata   112860
aacattgtct aaattgaaat acggacagct aaacatgtac gatatttcag gtggttttct   112920
ttttgtcggt aagaaaacaa attccttatc cgtccaaaaa tatctacccg ataaatgcgt   112980
gctatattca gcagacgttt tgtcgattgg atatcctccc aggtttttag aatctaccgt   113040
gctaggtaaa gtcccctcat aagcaattaa gtctacgaag tagttcaagt ttttaggtct   113100
gaacgtaaag accgcagaaa aatctgcacc acttgagata tgtactatct ggagttgttc   113160
gagtgctgta ttatcaaatc gggtatccct atccttttga accagtttat catacttgtc   113220
atatgtacta tcgacgtaag cagtaataag actatctgac ttataaccag caaacgccaa   113280
caatgctaaa agtatgacaa caaaaacacg ggaaaagaga actcttcccg tggctccatc   113340
tttgaataat agctcgagca acccaagaaa catatcaaaa aatggtattg attgtttgct   113400
tgccatattg ctctccttac agagctattt attgctatct tctagttata agaccttgcc   113460
agtattggtc agttctgtca ctaaaccagt ttttaagctt attagcttcg tcatttgaag   113520
ctatttgata gtttcttaca tctccatcca ttttacctgg agtaaaatca aggtagtgc    113580
catctgacat cattacccga agatttattg cgtcgccatt tcttattccc aaggttgtac   113640
cttgagggtc accgttccaa tagttaaccc caccttgtcc agatacagac acaaataaag   113700
taacctcttt accttcgaag ttaccttgta ctgtattttt ggttgtcggt ttagggctcc   113760
agttccagcc accaacttgc catgaacctc tatagtaaat attgttccag ttacgatatt   113820
gcactgttaa actaaagtta aaaacacttc gtcctatcat attagacatc cagaaaggtg   113880
ttcctagtct taatttggct ccggcttggg ccatccacgg ctcgccggtt tcagccttcg   113940
cggaacttcc aacccatggt cctgttactg ccatgatatc tccttaaaga tggggccgaa   114000
gccccatgca ttatttagat ttaagttctt caatttccgc tttaaggcct ttaacctcag   114060
cagaaagctc tttaacagat tcaacaagaa gtgcaattac tgagttgtaa ttcagacgca   114120
ataatccgcc gtccgcttca atatcttgag taactgcttc cggaagaact tcttgaactt   114180
cttgagcaat caacccagca gaacgagtag taccgccaga agtattatga agctcataag   114240
tattaccgct taaggtctct acttttttcca aagcgttttc aataacttta atatcagatt   114300
tagctctacg gtcagaacga atctcaacgt tatcaaatga accattgcga gtacagatga   114360
agtcaccgcc agctctgaaa tagaaactgt catctcgacc gaatccatta acattaatga   114420
```

FIG. 20JJJ sequence.txt

| | | | | | |
|---|---|---|---|---|---|
| tagcttggtg | gaagttacca | acatattctt | ggaaatacag | agaggcataa | gcaccattac | 114480 |
| taaatctgct | tactaaccca | gcggtattgt | tatatgtgcc | attgggttgt | cctgcaggat | 114540 |
| aattagtagt | gctgctaatt | ccgttatagt | tagaaatggc | tcctgggaat | tgacatgaac | 114600 |
| cacttgccca | gaaattccat | actggtccag | aagcaccgcc | ggctcttata | ctaacattac | 114660 |
| caggctcatc | agcccaaaga | agaccttttt | ctgtaccatc | tgctttacgg | aagaacacat | 114720 |
| ggctattacc | ggtgttctga | acgttaacag | aagtggatac | actgaactct | tgattaaacc | 114780 |
| tagccttttcc | atcaacagtt | aaaaccccat | taacggcagc | atctccggta | gtccatagag | 114840 |
| aagtagtttt | cagttgatta | cctgtaacta | ttaatgtacc | agttacagta | ccacctgcta | 114900 |
| atggaagata | agtatcgcca | gcattactaa | tagcagaagc | aaccttatca | tcaacatatt | 114960 |
| tcttgttggt | taggtgcgag | ttatcagtag | gagcttgacc | tgcaataaca | aacttaccag | 115020 |
| aagcgacgtt | gatgtttcca | tcagcattaa | tcacaccgct | gaagcgggaa | ttgcctttaa | 115080 |
| ctatcaagtc | tgagttcaag | ttagtattac | ttgttactgt | aagctgcctg | ttaatttggg | 115140 |
| catttccgta | aacagtttgg | tttccgctag | catcaacttt | gaatatatcg | ctaaacgtgt | 115200 |
| cagcaggatt | aatttggttg | ttggtatttg | cagataccat | aacggtaaat | gagttagatt | 115260 |
| taccgatggc | cattttttcct | ggcataccgt | ttttcttgac | taaaccaata | tcagagtttt | 115320 |
| tgccaagaac | gatcattctg | ttatcttcag | aaacgttcaa | gttgcctgtg | attttcgagt | 115380 |
| tctgggcctc | gaactcacca | ccgacagtca | ttttacctttt | ttggtcaata | actgtagctt | 115440 |
| ggttggaatc | atcgccgtta | ggtcttaaat | gaagagcttg | acctgttttt | gcgtagataa | 115500 |
| caaaagcacc | agagtcgttt | gaacgaatac | ccgggccata | ggaccactca | agcagaggct | 115560 |
| cagaaccgtt | agcttttaact | ctaatctcag | acccagaaga | atcaccgaat | ggtctaaaag | 115620 |
| caatatattt | cgctgatgct | gcggctgtag | cagaagctga | catgatcaat | gcaccagtac | 115680 |
| taccaccttg | ggcttcacga | actactgcgc | cattttttaaa | tgtgatagtt | ggatcacttg | 115740 |
| ttccgacgcc | attaacaact | aaccagccga | acttcacact | ctgtccttca | ccaacaccga | 115800 |
| ggttattacg | agcagcagcc | acagaagttg | ctccggtacc | gcccaagttg | attggttgaa | 115860 |
| cccctgcaac | aacctctttc | catgcagacc | atgtgccgtt | ttggcagtat | ctaacatatg | 115920 |
| tgccttcaac | attaccgttc | tttgtagtaa | aggtctgctt | acacgtccaa | tcactgtcag | 115980 |
| aaattttacg | caaagacaga | acttcaagaa | caaagttacc | atcagatgta | ggtttattag | 116040 |
| atatattaga | accaccacca | gatgatacac | atttatacag | ctgacgagta | cctaaatcac | 116100 |
| tgcctttaat | aaccatgttg | ttaaggtcat | tagtcttatc | agtaatatta | attgcatctt | 116160 |
| cagtaccgcg | atatgtctga | ttaaaaacca | aatcccttc | tacatcaagg | ccatcaggct | 116220 |
| taactcggat | gtacttgctg | ggagctggag | tagcaactgc | atcttgataa | ccaaactgca | 116280 |

FIG. 20KKK sequence.txt

```
cgtatccttc aggagtaatt ttaagcattg ctacggcagc gccagagcca actttacgtg    116340
caagggtcaa tctgctatac ttatctgagt tctctgaacc taaatcaacc attgatccat    116400
tagggttttc gacttttaag ttagcgttaa tagtcaagtt accggtcatg gtatcaccag    116460
tcttgcttac ttgcttacta tcaccagtgg tgatatcatt tttaatagaa gtcaaatagt    116520
tgttaaggtt accgccaaac attgaaccag aggtaatatt cccgtctttg gttagcattg    116580
ctgctccacc aactttaact gctacaggaa catcaaggcg gccatcagaa cggaagctaa    116640
aatcaccggc agaaacatca ccagtagttt ttgcacgaat attaatctga cccaagtccg    116700
cggtattcgg agttgcccaa attacaccac gctcattacc tcctgttcta aaccatacat    116760
gagcgtttcc gcttcctgcg ttaacatata ctgatgcagt accagtgccg gaagcatgta    116820
aattaggaac agttaaatca ccagtcatgg tatcgccggc tttcttaact tgagtatcgt    116880
ttgtcagatt accaagtccg acatcagcct tagatggttt gtttgctgtg ccgtagagaa    116940
cattagaatt tactcttcca cttgctaaac cgctatcgtt tatagcaaat actctgacgt    117000
tgccagttgc ataatctata ttaagcgcag acattgtatc gccagttcta gaaaagaatc    117060
ctgcgccatg ggagtaataa ggagccccgg tataaccact cgctacgttg gctctaaatg    117120
ttgtaccacc aagagcctta aggcgagtca ttaaatcaac atcagaagta atatctacta    117180
gtgattttcc gttaccgcca ataccaaagg caccaacttc catcacattt ccgctggatt    117240
caccaacatc acgaacagcc gcagttctaa gacctaggtt attttctagca tctcctacgt    117300
tagtagcacc tgtaccacca cggttaaccg gaagagtacc ggtagtatcg ctgaaatctg    117360
gttttgagat actatcaaaa acctgtttca ttgaaacaag aatgcttcca gatggtgtag    117420
tagcaccagt atcttggcca gtttcataga taattacttt accgctatct ggccgttgt     117480
attcagcagt gtttagcact gtaacataaa gtccatttcc gtatcgagga actttagcgt    117540
aaaaatcaaa tgaagcctct gaatctgtag cagcatcatt tttaacaacg taatactctg    117600
gaacgtttcc tttattagga gaaccaatcc tgcgccattc aacccagtta tctaaattgc    117660
tagtgctcca ggatgttaaa ttgcgaccag ataacgtgat aaaatcaaca taatgccttc    117720
cgtgtccaga atcaatgcca ccagtaatca ttaaatctaa ctgcgaagat gcatctcctg    117780
ggtgtttaat tgtagctact ttaacccagc gcggagttcc agcggttgca gcagaaatta    117840
cgtattgcca tgcctgacgg ttgttttcta cattcgtcag aagagtaccg gatttaccag    117900
gacctcttcc gttcatggcg taataaacct gtgaatttct gaatgtcaga ttactgtcat    117960
tggttaattg aagaacacct acgcctcgtt ggttttaat gtaagcgtcg ttagagccta    118020
cacccatttc aaggacaagt gtgcttccat tgttaatttt aacagtttta ttagtggata    118080
atcttaaatc accaggaaga gtggtattac ccgagccgtc aagcaagacc agttttcggg    118140
cttcaacgtt gccgcttccg cgttgtacga attgaatagt ttcagcgcca tcgtcaatag    118200
```

FIG. 20LLL sequence.txt

| | | | | | |
|---|---|---|---|---|---|
| taccgatttc | aagaataccg | ctattgcttg | taccacctgc | accgatgtac | cagccatcgt | 118260 |
| tagtagcgca | tttgccgacg | atatgacgca | ctattgctcc | gcttaaatca | gtggcttcaa | 118320 |
| aattgatagc | tttattcgga | gaaatagtaa | cgttgtcttt | taatgtagta | attccatcaa | 118380 |
| cattaagatt | acctgcagta | tctaagaaag | gaacaccttt | acctgcaagc | tgaacaacgt | 118440 |
| tatcggcttc | atctttagtg | taaatggcaa | gagtacgccc | gtgtgtattc | aacacgattt | 118500 |
| cgccacgggc | tacgatatct | gcacctggtg | ctttattctc | tgtgctagtt | cttttaaatt | 118560 |
| gtatttgttt | taagttttga | tcggccatgg | ctacctctta | gtatgtgcca | aaatctattg | 118620 |
| ttaccccgcg | tgaaataacc | tgatctaatc | taggagcata | ttcaccggat | gttgctttat | 118680 |
| ttactataac | tacgccagcg | ttagctctaa | gtacaccggt | catggtgtcg | ccagcttcct | 118740 |
| tgactgctgc | gttagctacg | ttgctaacag | tatttattag | ctcatcgaca | tagtctttgc | 118800 |
| gtgttaagtg | tgaatttgct | gttggagctg | cagccgcaac | agaaacttga | ttgttagaag | 118860 |
| tgattccacc | tttagtagta | atattaccag | atcgtaaatc | gaatgcgata | gttattccgt | 118920 |
| ttgaaccaga | attagattca | aatcccaagc | cccaccaagt | ttttattttg | gcattgacac | 118980 |
| catttaaagt | ggctccatca | actccgccat | ttacgagttc | catgccccg | gagccagtag | 119040 |
| tttgaactct | taaacctgtt | tcaaacgtta | ctgttctaga | gtaacttccg | ccattagctt | 119100 |
| ttgacacaaa | gtcgttatct | gcggcttgtg | gtttatctat | ctcagtataa | acctttttac | 119160 |
| ctctataagt | tagggagttt | cctgccggca | caagaggaaa | agtacccgcg | tgccaaatag | 119220 |
| gatttccgcc | aactgttgaa | cctgctttta | aatcggccat | agtttatcct | cttatatatt | 119280 |
| ttctatttat | acgaaaaaag | gaagcccgaa | ggcttcctta | gtctgatgtt | tctctgaacg | 119340 |
| attgaactgg | aataacaccg | ctcggatcga | cttttgaatt | tggaagttcc | ataatcatag | 119400 |
| tagttcctcc | ttcaacgcct | ttattcattc | ttataccatt | cacaccaaac | tcctgaataa | 119460 |
| cactattcaa | ttgttcgcca | tgagaagttt | gaacaaatac | gaggttttg | attttagagt | 119520 |
| caccaactac | agacgttttt | ggatatcgcg | ataccacgat | agtaaatcca | tcagcgtctg | 119580 |
| taggaacagc | ggtaaatctt | tcaaatctta | accatctatc | agctccattt | tttggaactt | 119640 |
| ctaatgatac | gtttgaagat | aataaagatg | tacccttgaa | ccaccgcaag | ctagctctag | 119700 |
| tagtagaacc | agcatcaaga | aggcttttag | atgcatacat | atcacatact | aaaaataccg | 119760 |
| aatccccagg | agatagtcca | taatcagcta | ttttgcttat | agattcattt | tgtactggat | 119820 |
| atcgtttata | ttcatatcca | gtagaatccg | agtattcatt | ggtatcttca | atagaacgat | 119880 |
| aaggacaccc | agtatatcct | acatctccta | cattgtcata | taccgtatct | actttagccc | 119940 |
| ttgaatcttc | tttaaccttt | ccgtcattcc | cataaaatga | ctcaattaat | atacgtcctt | 120000 |
| ttgctgctcc | gagcactcct | acataagcag | agtttggaaa | tgatttggaa | aaatcagaac | 120060 |

FIG. 20MMM

```
                                           sequence.txt
ctggccaaga tgcagaccac ttatttttaa accatctgtc tattaacggg ctggattgaa    120120
atcgttcatg cgtcattata atatacaatc ctgaagttaa tccatttgca tattctacaa    120180
acgctttgtt attagcgttg ttgtcatcag tggtaacgtc aaacgtttta agttaataa     120240
atctgtcacc attaacttga acaacattaa tcccctccg taaggaggag gtcatatcaa     120300
aggcaccgtt aatattcaat tctggcttat tcggaacagc attagaatgt gtagcataag    120360
cttttagcca atacttcaca gagtttgcct cagagaggat tcgtgtttcc acgaaatcct    120420
caccaaaggc tgccattaaa attggatcag ccattaatca cctacccatt caaatttgag    120480
agtttggttt ggacggtctg gccagatttt aactggacca agcttaatcc attccaaaac    120540
ttcaagggtt ttaacctgag ttgatactga gcttggagct ccgatatcag ctgcagttgg    120600
aggagtagca gacgtgaaca ctcgcatcca atcatcaaac ttattaaggt ttggattata    120660
aatcctcatc cacacagtat gcgcgaaacg cttatcagca gtttcggttg ttggaggata    120720
aggtgtccaa agctgataag tgttgtttgt agttacacca acctgagtta aaacaccgcc    120780
agcagcagtt ttttcttcat atccggtcac tactaaagtg cttgggttag cagggtcaat    120840
cggtgttctg attggaacca tataaccacg aagacctttc aatttagtag cgtctttaat    120900
ttcagcagtc caagaacctt gtcgcaatac agtatcatta gtcggcacat accacgattc    120960
agaacctgta atgacgatag ccgaactatt tatgttaaga ttgccggtca tggtatcacc    121020
agctttcttg acataacgac catcagctaa tcttgcgtag ttttggtag ttaaaatcgg     121080
atacgagtta gtattatctc gagcaaaaat ttgcgtatca gcgtcacgag tatcaataaa    121140
cgcagagtga gacctagcac caataatagc attttgggtt tcaatagtta atagaaccgt    121200
atcttttacc ataacagttc cgccaactat tgtatttcca gaagacctca gagttttagt    121260
tgatacttca ttaggaacat ccagcgtgcc gttccacca aatgtgtagg tctggcttgc     121320
agcagtagtt cctgttccgt ttttgacacg aacttttaaa tttccagctg aagctgtttg    121380
ggtttctgca taaattatac cgcgttcagt tccatctcta ttttgaaaac gaacatgcgc    121440
atttccagtg tcagcagttg gagaaatttt tacttcgcca ccattagcgt ataaaatatt    121500
ctggacagaa atgttgttat taaacacagt atcctggcta aatgtccaag ctccagaaat    121560
tgtctgcgct atatcgcgac gagcatattt gtctggggtt tgaccaccta gcattccggt    121620
gtcatacgct ttaccaagac gaggcaagta atgtttcaac gtgaggttca attcatacgg    121680
agacactgcg acgcccttag aggcataccc gttatccgga agagttgagc cattggtatc    121740
attacctttc cacgttccat cgcctgtaga tagcctgacg gtccctctaa cgctgtctgt    121800
agcttgccat gactctgtta cctgaatagt ttgtttcaag taagcaggag gaacaattct    121860
atcacttaat gtgcctgcat caacttgcgc ctgtgtagca tactgagcaa gaccgatagc    121920
tccttcggtt gctgttttcg cgtgcaacgt ggcagcagta actattttct tggcgtcggt    121980
```

FIG. 20NNN sequence.txt

| | | | | | |
|---|---|---|---|---|---|
| gccggttctg | acctcagcag | cagttgcaag | agtagttgta | cctctttgag | aagtacttgc | 122040
| ttcctgtatg | ttgatggtat | aatggtccca | gaggttccca | gtaatagtta | agccagaact | 122100
| agtattaact | tggatacgac | tagtattagc | aaatttatcg | aacagtaatt | tagggtttac | 122160
| cattactgta | cttgaagtac | cagcttcaaa | ttcaccctgg | gcaccaggtg | tcgcgaagcg | 122220
| agcaatacca | gtacgatcgt | tagttgctgt | acggtcattt | aatgttttag | gtgtaactgc | 122280
| tttattagtc | acgccaccag | cattaacttc | tgtctgtgta | gctatttgga | ttaaaccaat | 122340
| tgctccatca | gtagcaactt | ttttatgcaa | agattctggt | gtaacaaccg | taggaatatt | 122400
| tgaagaagca | ggagttccgt | ttctaacttc | gctatcactt | gctaaccaaa | ctattcctga | 122460
| ctgatttaca | gtagctttat | actcacgaag | agttttgga | gtaactgcat | ttttgtaatc | 122520
| agaatgatcg | aatataccgg | tgccagcaga | agaacgatca | gcagttgtgt | taggagcacc | 122580
| accagttttt | actaactgaa | taacacctaa | ccgtgaatcc | gacgtagtac | gataaagcaa | 122640
| cttcttagga | gtaacaattg | taaaatcgtc | tgttcctgca | tccatttag | cattagacgc | 122700
| aatttcagct | aaacctctac | gagtttcagt | agcagatctt | tcgttaagct | ttttaggagt | 122760
| aacgattacg | ttatccaagt | aagaagcagt | tgttgcctga | ttaacttcgc | cggaagttgc | 122820
| aattcttgct | ataccagtct | gagtttcagt | agaacgacgt | ccatttaaag | tttctggagt | 122880
| aattgctaat | tcttttctg | gatttgactc | cgcgttggct | tgagcttgcg | tagcaagagc | 122940
| aataacacct | aatcgtgctc | tggtagtatt | gtctttagca | tcaacacgtt | ctacagtagg | 123000
| gtcagattca | gttacaatcc | aatagctttt | tccggatgct | ttatcttcaa | tatatgcaag | 123060
| ctcaagaaca | ggaacatatg | acgtagttcc | attaaaggta | atcgagcttg | attgaaccca | 123120
| tgctgcatca | ggtggatact | ctgagcgttt | tggaaactgc | agtaaattca | aattactagc | 123180
| gatggtatca | ccatcagaag | ctttaattac | tactgtctgt | cctttacgca | tataattcat | 123240
| tgcgattttg | acagtatccc | caacagctac | gtcagtaggt | aaagtaatgt | taattgtttt | 123300
| aactgtacta | ttatctgcgc | caaatacaga | aatatgctca | ttaggcatta | agtaacgtc | 123360
| agaagtaatt | attcttacac | gtgtacgtaa | atcattttca | aagatgcgcc | atattttgtc | 123420
| aatagcgtca | tacaccaaaa | atccactacc | tgaagtacgt | acttgaattt | ccgtttgtcc | 123480
| aggagtccca | attgagatag | ttgggtcaaa | cgtacgcaca | gtcatatggt | taatcggcga | 123540
| tgtaccatca | aggtcagtaa | aattaatgat | atcgtttgaa | ttagcgaaca | acggcagagt | 123600
| aataaaaatc | tctgagttgg | aagtataacg | acgaactacg | ttatcacctg | actgtacctg | 123660
| ggttggaaca | atcccgttcg | gaactaccat | tttagcagta | tcgccaaaat | cggttaaact | 123720
| agcacgccat | gcaccattac | taaacgtaag | cataatttgt | gaatacggac | gagtaagtct | 123780
| tacctcacgc | agacgcgatt | caccaaatac | gatagacgca | ccagtatctt | gtgctttaat | 123840

FIG. 20OOO sequence.txt

```
taagattccg ttatagccag gacgacctcc aatatcacga actacaatgg tatcgccttc   123900
gtctggtgct aacggaagaa gtagtgtagc attaccggca gcgttcgagt caacgttgat   123960
gaactgacca gattgaattt caaactctcc tttacggacg gtataaatcc agttcgggtc   124020
aacacgtaaa gaagtccaat tggcctgatt aaattctccg gctggttttg gaatatcttt   124080
gtttgcaatc caaatgcgtc gtccataagt cacagcaaaa tcggtgagat acccacgcgt   124140
cgggtcatat ttttggatag tattttcttg aataacgtac tcgacagaga cgccgtcggt   124200
tttaacgttg cggtcagcga gtgccacatt tataacttta tttccgccgg catccaaacc   124260
gttagttgca cggaaatgtt gtttcagtaa atcgctcata gagtctccta tggggttatg   124320
cttcattata gaagtattta taatggctgt actaactaat gaacgaggt caaatgtct    124380
gatttaaatt gcttattcgc cgaagaagac caagtaaaag aaggtgtcat tctgattgac   124440
ttgtcgcaaa tcgcaatggc gacaattctt catacgtata aagaaggaga taaactaacc   124500
actcctatgg ttcgtcatct tattctttct actttaaaat ttaatgcttt taagtggaag   124560
aaagatgggt acactaaaat tgtcatttgt gttgataacg cagttaatgg atattggcgc   124620
cgagatgtag cgtactacta taaaagaac cgtgctaaag cccgcgaaga atcaaattgg    124680
gattgggaag gttactttga aggtcttcgt actgtaattg atgaattaa gcagtatatg    124740
ccttattacg tcattgatat tgataaagca gaagctgatg atagtattgc tgtactgacc   124800
aaaaagttca gtctcgaagg ccatccagtc atgattgttt cttcggatgg tgactttact   124860
caattgcata agtatcctaa tgttaagcaa tggtcaccaa tgcagaagaa attagtgaaa   124920
tctaaaaccg gctctcctgc tttagattgc atggttaaaa ttattaaggg tgataagaaa   124980
gataacgtag cttctattaa agttcgttca gattttggt acaccatgt tgatggcgag     125040
cgtactcctt caacgaaaat gacgtttgtt gaagagtgtc ttgatgctgg cgaaaacatc   125100
aaagatttgc ttaccgaaga acagtataag cgtttcttag aaaaccgagt gttaatcgat   125160
tttgattata tccgtgaaga cattgttgct aacatttag attgttataa taattatcaa    125220
ctaccgggtc gtggtaaaat ttatagctac tttgttaaat ccggtctgtc taaattaatg   125280
aaagaaataa acaacttta aggtgaatat aatggctaag aaagaaaaag agcaagtagt    125340
atttgatgaa gcagtacacg gacaggctct gcgagatatg attaaggaag cctcaggtaa   125400
taagctaaaa gcagaaagct atcttgagct taacaaagac attaaagacc gcgccaagaa   125460
agaacttggc gtagaaggca attatttaa tcagctgctt gccctgttcc ataaaggtac    125520
acgcgatcgt tttgaaactg aaaaagatga agtggtagaa gcttatgact ctattttcgc   125580
ttaaagatga gggggacaca tcccctccg aatccattaa ccagctgcta gataagcaag    125640
ctaatggatt tgctatcgaa tctatggtaa cagaacttgg aatggggtat ctcgaggcaa   125700
cgacacaatg gctagaagaa aattctattc ctgagggaaa cttcagtaga tatattccac   125760
```

FIG. 20PPP sequence.txt

| | | | | | |
|---|---|---|---|---|---|
| ctgcaatcat | agaaaaaatt | atgtcagaag | cattagaaga | aaatatgctt | cgaccatcat | 125820 |
| ttagtcaaac | acataaaacg | aatagtctgg | atttttttatt | atgattcgtc | tacgcatgcc | 125880 |
| ccaaaacaat | aatagatacg | ttaacggtaa | gagcgtttat | cttttatatt | taatgctcaa | 125940 |
| acaacacttt | gccggtcgtt | atgatgttgt | taagtataat | tgggtcatgc | gtgtctctga | 126000 |
| taaagcttat | caaaagcgca | gagacaaata | cttctttgag | aaacttgccg | agaagtatac | 126060 |
| gctaaaggaa | ttgactctga | tattcatgag | caatcttgta | gctaatcaag | atgcttggat | 126120 |
| tggtgatatc | agtgacgctg | atgcgttgat | attctatcgt | gaatacatcg | gtaagttgaa | 126180 |
| gcaaatcaaa | actacattct | ctgaagatgt | aaagaatatt | tactactttg | ctaagaaagt | 126240 |
| taatgtagat | aagcttcatg | atatttttga | atataatgag | aaagtcggaa | catcttatgt | 126300 |
| gttcaaactt | cttcagtcaa | acgttatatc | tttcgagaca | ttcatcatgc | ttgactcgtt | 126360 |
| tttagatata | ataaatacac | atgatactgc | aacggataac | ttagtttgga | gtaattactc | 126420 |
| cactaaatta | aaagcttata | aaaaactttt | aaacgttgac | ggtgctgaag | ctaagaaact | 126480 |
| ctttattagc | ataatcaaat | cttgtaaaga | aattagtata | taattaatct | atcgtccagt | 126540 |
| tgcaaggacc | catgttgcaa | caacaactgt | taaattaaaa | aggtaatcat | atgttcaagc | 126600 |
| gtaaaaatcc | tgctcaactt | caacaacaac | tggctggtct | gaaaggtggt | tcttctttct | 126660 |
| ctaatgaaga | taaaaacgaa | tggaaactga | agaccgataa | tgctggtaat | ggtcaagcag | 126720 |
| taattcgctt | cctgcctggt | aaagatgaaa | actctctacc | gtttgtaaaa | ctgatcaatc | 126780 |
| acggtttcaa | acatgctggt | aaatggtaca | tcgaaaattg | tacttctacc | cacggtgatt | 126840 |
| ttgattcttg | cccggtttgt | gctcatctga | gcaaaaacga | ttcttataac | agcaacccag | 126900 |
| ctgaatataa | actgctgaaa | cgtaaaactt | ctttctggtc | taacatcctg | gttattaaag | 126960 |
| acccggctaa | cccagaaaac | gaaggtaaag | tatttaaatt | ccgtttcggt | cagaaaatta | 127020 |
| tggacaaaat | caacgcgatg | gttgaagtcg | atgttgatat | gggtgaaact | ccggttgatg | 127080 |
| taacttgtgt | gtatgaaggt | gcaaacttcg | tcatgaaagt | taagaaagtc | ggtggtttcc | 127140 |
| agaactatga | tgaatgtaaa | ttccttggtc | agtccgagat | tgcaaacatc | aatgatgaag | 127200 |
| aaactcagaa | attcctgacc | gaaaatatgg | ctgacctcag | cgaaattgtg | gctccatctc | 127260 |
| agtttaaatc | gtttgaagtt | aacgaagcta | aatttaaaca | gattatgggt | acagcagctc | 127320 |
| ttggtggtgc | cgcggcaaaa | gcagcagctc | aagccgataa | aattggtgat | gacctggatt | 127380 |
| cctttgacaa | agacctgtct | gattttgaat | ccaaaccgac | ctcttctcgt | tccgcagacg | 127440 |
| atatcatggg | cgatgctggt | gacagtgttg | gcgatgacga | tctgaatgat | attttgaacg | 127500 |
| acctctaata | taaagggacc | ttcgggtccc | tttttctttta | tccctccaaa | aatatttttca | 127560 |
| caaaattgtt | tacaagccag | ttgatgagtg | atactatatc | tacatcgaaa | caaaacgagt | 127620 |

FIG. 20QQQ sequence.txt

```
agaggaaaac atcatgggta aattaaacat tgatatcgtg gcagaacctt acatcaataa   127680
atcaggattt tgtactgatt taattttga agatggttca cgttttatg acactgacca     127740
tggtattgat tttgatttag ttatcaaaga aggccctggt ggtggttggc caaatattga   127800
cctccgcggt tctaaagaag cagttcgtgc ttggttagaa gcaaacgagt gggaagatat   127860
tgatttgatg atggaagact ggaaagagta attacctttg gggacttcgg tccccacttt   127920
gaggaaatga taatggcaca ggttactgta gaaatatatg attatgaaca cttcattgaa   127980
accattgaaa aatacggttt gattgaagtt agtaacaagt ctgccccatg gggaggaaac   128040
gaaatcactg tagaaggtga tactcctacc ctatggttat ggcttgaaca agaatatttt   128100
cctggcatgg atgatgaatg ccgtgaagat acattaacga cttttagcgg gtaaattatg   128160
aaactgaaca cagaatatcg cattatccca agtcttgctg ccgagtggga cctttcatct   128220
agcggaaatc gccggatgcg cttgatgatt gaagaacatg gtggttcgtt ctttcctact   128280
aaaatgctcg acgaagataa tagtttcatc acagaagtaa aatttaaaga tggaacaact   128340
gctgacgctg aaggatttgg agatgcatac tttgaaatat ctgattatga attcaaatac   128400
ttcgaaccag tatatgaaat tggtagtgca atccaacctg gtcctactcg cttggacttg   128460
atcgttaccc cagaaaatgc agaagaaatg attgacttga tcaaaaaagt tttcaaaaag   128520
tagtttacac ggagctatgc ttgtgatagt atagctccat aatctactgg agaataaaaa   128580
tgaaacttca acgtcaaagc attaaacttg gttctgaata tcgtggtaaa tggaatttct   128640
gcatttgcga taaaacccca gaagaattag agcgtgttga agaagtactg tgccaaatgg   128700
aagctccatt cactatgggt ggtgaaactg tctattggaa tgattactgt gataactgcc   128760
catgctatga agatgggtat ggctcaggct tctggattcc agttgaagat gttgaagaat   128820
tcaaaaaagc atttaaactt gctaaggcca agaaatgatt gaggctgaat tagtagtttt   128880
gttaatttct gttactgtcg cttttattag cggcgttata ttaggattat ttttatatgt   128940
ctaaatttag tgtaacggga tatcctcgcg ttaatattcg ctgccagttt gatgaaattc   129000
ctggagtaac tcatattgag ctcgtatttg accctcattc gcgatgcaat caggtttcag   129060
gtaaaattga ttcagcgtat ggcgaatttt taattaatga ccaagttgtg gtttcagcta   129120
tttctggtga acaagcaggt tcgttgtata ttctgaaaag ggaagtattt gaggaaattt   129180
cagaagccat aaaagaaggg tttaaaactc ttcagagcat gattaaagct agtgagtaca   129240
agtcatgtgg attttaactg actgggattg taagtactgt ggcggtagct tatggcaatt   129300
aggtggccgg tgttttaagt gtggaatgag gcaaggttaa tggaaaattt cgcagtagat   129360
gattacgatg atttgatttg gtgggacggc cgtgaatggg taactatctg cgcaatgtcc   129420
aatatcgata gcgctatcaa acgtctccaa gagcttcaac agaagtggga agacggtaat   129480
gttgaacggg ttgaattta ttgaggttta aatgattcaa atagtttatg cctttgctcc     129540
```

FIG. 20RRR sequence.txt

| | | | | | |
|---|---|---|---|---|---|
| tacaaaaact | gtagacggca | aaaatgaaaa | tgctttcggt | ttaggcgatg | gtcttccatg | 129600 |
| gaaacatatt | tcccaggaca | tgaaaaactt | tgctaatcgt | actcgagata | ctatcttgat | 129660 |
| ttgcggagca | aagacttta | tgagttttcc | tgaacctctt | cctgggcgta | agacaatcgt | 129720 |
| tgtccaagac | atgagtcgtg | cgttggcaac | tgctaaaaat | ggcttctttg | cagatgctta | 129780 |
| tgtaagtgaa | ttagaattta | tcggtttctt | gggtggtgac | attatggccg | ctcatacttc | 129840 |
| ttacaacagt | actatcactt | ttaatagaga | ccttaattat | tctatcatag | gtggtgccgg | 129900 |
| aatcatccag | aaggcatatc | catacgcgga | tagggttatc | caaacaatca | ttagaaaaag | 129960 |
| tcatagagtg | aattctgatg | tcactctacc | tgctgaattt | gtaacagctc | ctacttggcc | 130020 |
| agaatcagga | ttcattacta | aagaaaatca | ctggtatcat | attgatgaag | tgactaacat | 130080 |
| ttcagaggtg | gtctatgagc | gcaaactatg | atatcactca | gctatcagaa | gacaaagtcc | 130140 |
| aaaagaggtg | gaaaagattt | ccatttaagc | atggtattca | tcttctagtt | ttcagttata | 130200 |
| atggtcttag | cacttataac | ggttcaacta | cagtatataa | ccgaaatgga | aatatatccta | 130260 |
| ttgaaattga | acgtgattat | aagaagatgt | tcatcggaat | gtcacacggt | aatgtgacgg | 130320 |
| ttaatgatga | tgtagtgtct | attattgggc | gatttgaaaa | gcgtggtgat | cagcttttct | 130380 |
| ttacacctct | tcaggaaaaa | tttaatgcgt | gaataccaag | aattaattaa | agacatttt | 130440 |
| gaaaacggct | atgagacgga | tgaccgtact | ggtaccggta | ctattgcaaa | gtttggtact | 130500 |
| caacaccggt | ttgatttaca | agaaggattt | ccggcagtaa | ctaccaagcg | tcttgcgtgg | 130560 |
| aaagcgtgca | ttgcggagct | gatttggttc | atgtgtgggt | ctactaatgt | gcatgaatta | 130620 |
| cgtcttattc | agcatgactc | attactagaa | ggtaaaactg | tctgggacga | caactatgaa | 130680 |
| aaccaggcaa | aagacatggg | gtattccggt | ggtgagctag | gtcctgtgta | tggtaagcaa | 130740 |
| tggcgtgatt | tcatgggtgt | tgaccaactg | aaattgatca | ttgatcgtat | caagcaactt | 130800 |
| ccatatgacc | gtcgtcagat | tgtgactgct | tggaacccgg | ttgatttgga | taagatggca | 130860 |
| ttgccaccat | gtcatttgct | gtatcaattt | aacgttcgtc | aggggcatct | tgacctccaa | 130920 |
| tggtatcagc | gttctgtaga | tgtattcctt | ggcctcccct | tcaatattgc | gtcatatgca | 130980 |
| gcattggttc | atatcattgc | taaaatgaca | aatcttaaac | ctgggcattt | ggtattcact | 131040 |
| ggtggtaaca | ctcatattta | cctgaaccat | attgagcaat | gtaaagaaat | cttgcgtcga | 131100 |
| gagccaaaag | agttgtgtga | acttgaaatt | gcattcccag | atacgtatga | aacttggcag | 131160 |
| actagttctc | agattcgttg | gttagaacaa | tttgcacgtc | ctcatcattt | tgaactagtt | 131220 |
| gggtataaat | cccatccaac | aattaagggg | aaaatggcta | tatgaatatt | cgatttgttc | 131280 |
| gtaaaggaca | tcagtctaaa | accgtattag | gagaaatgca | ggacgcattc | tctagtgatt | 131340 |
| tgcctgaggt | taatgacacg | atagtttttg | acggaaccga | acaacgtgtt | ttatctgtca | 131400 |

FIG. 20SSS sequence.txt

```
ttaaatcata tgaatggtct attggcaaaa cacaattaat ctgctggttt gaagttgata    131460
taacatgaag atatgtcggg tggttaataa ataccattcc gacttcgatg taaatatcca    131520
acgtggaaca atgtggggaa attacgtcgg taaagattgc gataatcgtc ctgatgctat    131580
tgcggcattt aaggacgatt ttattgctaa gattcggaac ggagaaataa agcgagagca    131640
cttagaaact ttaagaggaa tgagattagg atgcacctgc aaaccgcttc cttgccatgg    131700
tgatataata gctcttgtag tgaataaact ttttaaagat acatttgaat tagaggactt    131760
atgcaagtaa ttaagagctc aggtgttagt caagaatttg acatgcagaa aatcattaaa    131820
gtcctcgaat gggcgtgcga aggaactaaa gtagacccat acgagttgta tgaaattatt    131880
aaatctcatc tgcgtgatgg catgagcact gcagatatcc agaagactat cgttaaggta    131940
gcggcgaata gcatttctat tgatgagcca gattatcaat atgtagcatc caatgcagca    132000
atgtttgaaa tccgtaaacg tgtttatgga cagtttgaac cgcctgcatt tattgaccac    132060
atttcacgtt gtgttaacgc aaataagtac gataagaaaa ttctaagtaa gtggtctgca    132120
gaagaaatta ctttgcttga ttcttatatt aagcatgagc gtgatttcac tatgacttat    132180
gctggaacaa tgcagcttat cgagaagtat ctcgtaaaag accgtcatac tggtgaattg    132240
tatgaaactc cacagtttgc ctttatgctg atcggtatgt gcttgcacca agatgatggc    132300
gaaaatcgtt tagcaaacgt tattcgtttc tatgatgcag tttctactaa aaagatttca    132360
ttgccaacac caattatgtc tggtgttcgt actccgacac gccagttcag ttcatgcgtg    132420
gttattgaag gtggtgacag tcttaattca attaacgaag ctgctgcgtc aattacgaaa    132480
tacatcagta agcgtgcagg tattggtatt aatgcaggca tgattcgcgc agagggttca    132540
aaaattggat ttggtgaagt caaacatact ggagttattc ctttctggaa acacttccag    132600
acagcagtta aatcctgctc ccaaggtgga gtccgtggtg gcgcggcgac actgtactat    132660
ccaatctggc acttggaagt tgaaaacctc tcgtacttca agaacaacaa aggtgtagat    132720
gaaaaccgta ttcgtcattt agattatggt gttcagatta ataacctaat gattgaacgc    132780
ttgattaaga atgattacat cactctgttt agtcccgatg tatgtcttgg cgcgctgtac    132840
acagaatact tccgtgatgc acaagcgttc cgtactttat acgaagagct ggaaaagaac    132900
ccagatataa gaaagaaacg tattaaagcc cgtgaactgt ttgagttgtt ccttactgag    132960
cgtgctggta ctgctcgaat ttacccgtac atggtagata acgttggtga atatggtcct    133020
tttattcgtg atgtggctac ggttaagcaa tcaaacctct gcctcgaaat tgcgttacca    133080
acttcggatg ttggccaaga agatggcgaa atcgcgctgt gtacactcgc agcattcgtg    133140
ctcgacaact tcaactggca agaccaagaa gaagttaacg aaatcgcaga agtaatggta    133200
agagctttgg ataacctttt ggattaccaa gattatccag tagacaaagc gttaaaagca    133260
aaagaccgca gagcattagg tgttggcatt actaactatg cagcttggtt agcaagtaac    133320
```

FIG. 20TTT sequence.txt

| | | | | | | |
|---|---|---|---|---|---|---|
| tttgcttcat | acgcagatgc | taatgatatt | actcacgaaa | tgatggaacg | tattcaatat | 133380 |
| gcactcatca | aagcctcagt | taaacttgct | agcgaaaaag | gtccgtgcgc | gctttacaaa | 133440 |
| gaaacacgat | atggacgtgg | cgaactgcct | attgactggt | acaataaacg | aattgaccaa | 133500 |
| ctcgcagctc | caaactatgt | ctgtgactgg | gaactcctgc | gagaagacct | caagcgatac | 133560 |
| ggtatccgaa | attcaacgtt | atctgcgctt | atgccatgcg | aatcgtctag | tcaggtatca | 133620 |
| aactctacca | acggtattga | accaccacgt | ggaccagtgt | cagttaaaga | atcaaaagaa | 133680 |
| ggaagcttca | accaagtcgt | tccaaatgtt | gaacacaatg | cttcccttta | tgattatgcc | 133740 |
| tggcagctcg | cgaaacaggg | taataagcct | tatctgaacc | aggttctgat | tatgcagaaa | 133800 |
| tttgtagacc | aaagcatctc | tgctaatact | tattcgacc | cggcgaattt | ccctaaaggt | 133860 |
| aaagttgaaa | tgtcggtaat | gatggacgac | ttgctttatt | tctggtactt | tggcggtaag | 133920 |
| actctttact | atcataacac | ccgtgatggt | tccggtaacg | atgatatgat | tcaagactct | 133980 |
| gctgactgcg | cggcctgtaa | attataatga | attatcaaaa | cgtatataat | agtttaatct | 134040 |
| cccgggctag | agcccgggaa | tctttattag | gatataaaga | gactcatcat | ataattccta | 134100 |
| gatgcatagg | aggttctgat | gataagaaaa | acttagttga | attaacaggt | agagaacatt | 134160 |
| ttatagcgca | ctggctttta | tgtaaaatat | atgaagcgcc | gggattaaag | aaagcctttg | 134220 |
| gtttaatgtg | tttgaccggt | aaaaatcgct | catataaagt | ttcctctcaa | ttgtatgaat | 134280 |
| taggcaaacg | gcgtttatct | gaagctgcta | caggacgtaa | agcttctata | gaaaccagag | 134340 |
| aaaagataag | caaatctctt | aaaggaaggg | aatttaccga | agagcattta | gccaacatga | 134400 |
| gaaagcctaa | aactgaagaa | accaaaaaga | atatagctgc | tgctaaagtg | ggcgtgctta | 134460 |
| atcctatgta | tggtaaaatt | tctccaacaa | gagatgttcc | ccatactaaa | gaaacccgtg | 134520 |
| atgtgatttc | tttgagaact | aagcaaggta | cagagtatcc | accttgtcca | cattgcggca | 134580 |
| agaaagttaa | taaaggtaat | gctcttcgtt | ggcattatga | taaatgtaaa | tttaaggacc | 134640 |
| ctaaatgagt | acagttttta | ataaagaacc | cgtagacatt | atgaacgaac | cgatgttctt | 134700 |
| aggctctggt | ctaggaatcg | ctcgttatga | tgtccaacgg | cacaaagtat | ttgaagaact | 134760 |
| tattgagaag | tctttatcat | ttttctggcg | tcctgaagaa | gttaacgtta | tgatggaccg | 134820 |
| tggtcagttt | gaaaaactcc | cagaacacca | gcgtaatatc | ttcactgata | acttgaagta | 134880 |
| ccaatctctt | cttgattcaa | ttcaaggacg | agctccagca | gcagttttat | ctgcacttat | 134940 |
| ttctgaccca | agcctagata | cttggaacca | gacttggacg | ttcagtgaaa | ctattcacag | 135000 |
| ccgttcgtac | acgcatatca | tgcgtaacct | ttatgtagac | ccagctaaaa | tctttgatga | 135060 |
| aatcgttctt | gacgaagcaa | tcatgaaacg | cgctgagtca | attggtgttt | actatgatga | 135120 |
| tgttatagcg | aagactcgcg | catgggaaaa | tgccaaaaat | cgctgcttta | atcaagataa | 135180 |

FIG. 20UUU sequence.txt

| | | | | | |
|---|---|---|---|---|---|
| tatcgaaatt | aaagaagcta | aacgtgattt | aatgaaatct | ctttatcttt | gcttacatgt | 135240 |
| tattaacgca | ttagaagcta | ttcgtttcta | tgttagtttt | gcatgtacct | tcaacttcca | 135300 |
| taaaaatatg | gaaatcatgg | aaggtaatgc | taaaatcatg | aagttcattg | ctcgcgatga | 135360 |
| acaacttcat | ctgaagggca | cacagtacat | tctgcgtcaa | cttcaaactg | gaactgatgg | 135420 |
| cgaagaatgg | gttgagattg | ctaaagagtg | tgaacaagaa | gcaattgaaa | tcttcatgga | 135480 |
| agttaaccgc | caagaaaaag | attgggctat | tcatcttttc | cgcaatggtg | gtcttccggg | 135540 |
| tctgaatgtt | aaaattcttc | atgacttcat | tgactatctg | actgtatctc | gtatgcgtag | 135600 |
| ttgtggtctt | ccttgtccga | ttactgatgc | accaactcgt | catcctattc | cttggattcg | 135660 |
| cgaatatctt | aactctgatg | cagtccaatc | tgctcctcag | gaagttgaga | taagttctta | 135720 |
| tctggtagct | cagattgaca | atgatgtcac | tgatgatgtt | ctaattggat | ttaaaaggta | 135780 |
| cttataagga | aaggggcttc | ggcccctctt | tattatgaat | gatattgcta | acgagttttc | 135840 |
| ttttataaaa | tatgttcaac | ttgagttaga | accagatttc | agtattaaac | ctgttttggt | 135900 |
| agcaaacaag | ttgaatgtag | tttatgccat | cgcagttgat | gatgaactag | tttacattgg | 135960 |
| taagactaaa | aatcttcgta | aacgtataaa | ttattataga | actgctatta | atcggaaaga | 136020 |
| ccaaacctct | gattcggcta | aatctgccaa | gattttgaa | gcactaatgg | ctggcaaaaa | 136080 |
| agtagagttc | tatgctcgtc | agtgttttaa | tcttttgatt | aataatgaac | ttggcgagat | 136140 |
| gtcaatatcc | actatggact | tggaagaacc | gatgtttatt | aaaaagttca | atcctccatg | 136200 |
| gaacacacaa | cataaggtaa | agaaatgtta | gagctatata | aaaatttaat | gaatctatgt | 136260 |
| gaaagctcag | aagttgcaaa | attcttttat | aaagatttta | ccggtcctat | ggatggtaag | 136320 |
| ttcagagtgt | tttcatacca | ctatgcaagc | tacagtgagt | ggttaaaacc | tgatgctctt | 136380 |
| gagtgccgcg | gtatcatgtt | tgagatggat | ggcgataccc | caattcgaat | tgcttcgcgt | 136440 |
| ccgatggaaa | aattcttcaa | tttgaatgaa | aacccactaa | cgatgggaat | tgatattagt | 136500 |
| gatgtagaat | acattatgga | taaggctgat | ggttctctag | tatcatctta | tgtcgatgat | 136560 |
| gggtatctat | accttaagtc | aaaaacatct | ctctacagtg | accaggcaag | acaagcttca | 136620 |
| gctttgctta | acagtgaaga | atattcttcg | cttcatcagg | ttattcttga | gctagcgcta | 136680 |
| gatggttata | cggtaaacat | ggaatttgtt | tcacctaata | atcgcgttgt | tttagcatat | 136740 |
| caggagccac | agctgtttgt | gttaaacgtc | cgtaataaca | caactggcga | gtatattaaa | 136800 |
| tatgatgatt | tgtacgctaa | tgctaagatt | cgtccttatt | taattaatgc | ttacggaatt | 136860 |
| tctgatccca | caacttgggt | tgaaggtgtt | cgtgaacttg | aaggcgtaga | agggtacatt | 136920 |
| gcagttctaa | acactgggca | gagatttaag | gttaaaaccg | aatggtattc | tgctcttcat | 136980 |
| cacactaaag | actcaataac | gtcaaatgaa | agactgtttg | cgtctgtcgt | atctgcaaat | 137040 |
| tccgacgatt | tgcgttctct | ttttgctgga | gatgaataca | caattaagaa | aatttctgcg | 137100 |

FIG. 20VVV sequence.txt

| | | | | | |
|---|---|---|---|---|---|
| tttgagcaag | cttatctaga | ttacctcgga | aagtcacttg | agctgtgtca | gtcattctat | 137160 |
| gatgaataca | gaggtcgtgc | tcgtaaagat | tatgctattg | ctgctcagaa | agcaacggtt | 137220 |
| aatcagcgcc | atcttttttgg | tgttatcatg | aacatgtacg | aaggaactgt | agatgtagat | 137280 |
| aaactgctta | aagacctcga | aagggtgttc | ttgaagtact | gggcaggata | tgttccaaaa | 137340 |
| gagtacgaaa | aggaaattga | aatttccgaa | gaataattgt | ttacatcctc | atcagggtgt | 137400 |
| gataccatag | acttacacca | actgatgagg | ataatgaaat | ggatatgcaa | gcaattactt | 137460 |
| tagatatggt | tgttaacaaa | tacggtactc | attctgacgg | gattttttgtg | tggaatggta | 137520 |
| ccaagaaagt | gggattcgtc | actgatctac | gtacccatat | ggctcgcaag | gaagctgctc | 137580 |
| gtaagaagca | aaaagagtac | actaatcgtg | tgaacgagca | gcgtgccgaa | gcccttcctg | 137640 |
| aagccgtaga | tgaaatgatt | gatttcctag | ataatcatct | cgcgaagtat | ggtgcagagg | 137700 |
| tgttcaagaa | catcacccag | ccaaacgttc | atgctaacgg | gtgcaaatgc | tatgtaatcg | 137760 |
| ttgacccgat | ttatggtaag | catcgtcttg | gtattatgca | tcgtgagctg | aattattctg | 137820 |
| agatggcaga | atatgtagaa | gcgtgcttca | agtgttctcc | ttcggaaagt | tctgatcgtc | 137880 |
| acatcctcat | ttcgggatta | tcccgtgatg | atatcgtaga | ggttatcctt | aaactatgct | 137940 |
| caaaataaac | acaacttggt | tgttgattgg | agtgttagca | ttatccgcag | gaggattgaa | 138000 |
| atatctttcg | tggcgggtag | aaaatcttaa | agctgacctc | aaagtcgtcc | aagatgaatc | 138060 |
| tgatcgacaa | gcaaaagaaa | tagaaaatat | tggtgtttct | ataaaaaatc | tgcagacaac | 138120 |
| atataaaggc | tatcaggaaa | accgagcagc | tcgtgatact | tctaacgcta | agatgaataa | 138180 |
| agattctaag | cgtggaaacg | tagttgcagc | caaacctgga | ttagttgaaa | aacagattaa | 138240 |
| tgcaagcttc | aataagtttg | cagaagatat | ccaggaggct | accagatgaa | acgaagtcta | 138300 |
| ttagccatgt | gtattatcag | cttattagct | ggatgctctt | ctagtgcccc | agatgttccg | 138360 |
| gttttacatc | ctgagtggcc | agatccaatt | caaaaatggg | aaggacattg | ggaagtaaaa | 138420 |
| gtaattgacg | gtaaagcctg | ggttggtatg | ccgtttgaag | agtcgcaaga | atatcgtatc | 138480 |
| tggatgaatg | acattttacg | atatactaaa | gatgctaatg | gaatgatatg | ttattatcgt | 138540 |
| tctgaactta | agaacctcg | ttgcgttaag | taaactaaac | aagaggaaaa | tattatggaa | 138600 |
| ccgtcacatt | tttattctta | ctttgtaaaa | gacgcatcgc | atcttttatc | gattaaaaat | 138660 |
| acacagctca | gaaatatgct | agctgttggg | tcgtgccagt | taactcctct | tgctaagaaa | 138720 |
| gctactgtta | taccggaaaa | tatttctaat | ggatatgttt | atacagtccg | tgttagtgtg | 138780 |
| cctggcgctt | taaaagaaag | attgtttgag | cttaatgacc | aaacacgaat | ttcgtttgat | 138840 |
| gtgtggttta | aactattcat | ggtagaattc | atgtatcctg | atttcttgaa | gtttgttcag | 138900 |
| cgtaaagagg | cattgaagga | agcaatttct | gaattggaag | atgcctcaat | tgaatttggt | 138960 |

FIG. 20WWWW sequence.txt

| | | | | | | |
|---|---|---|---|---|---|---|
| aaggcactcc | aatttgtaga | aagtggcggt | gtagagcaag | atgctgttaa | cgggtttttg | 139020 |
| aagaaatatg | gaaagcgccg | ctcattggcg | catcgtaatc | tttctaaaat | ggtgatgtag | 139080 |
| tgaatcaaga | acagtatgaa | acacttaaag | gattaattgc | tgaaaatgaa | ttggcgtgca | 139140 |
| tcgtgtttgg | acgcgcagct | gaaaattatg | acaaaaatga | tatactgtca | atgaataagc | 139200 |
| cattgcgagc | aattaaagaa | aaatatcgtg | ctaattgggg | tgaaaagtct | aaggctcttc | 139260 |
| atgattttat | tgacactctt | aaggacgtat | aatgaaaaaa | ttggttttga | cacaggggc | 139320 |
| tccaggctct | ggtaaaacaa | cctgggctaa | cgaatacgta | gcagctaatc | caggttggta | 139380 |
| tgttttgtct | cgtgatgatt | tgcgtgaagg | catctttggc | cttgataagc | gtaatgatta | 139440 |
| caaatattct | aagcttcgtg | agaagtccgt | atctgtatgc | cagttttcta | tggcgaagac | 139500 |
| tctactcgag | atggaaacca | ctaaaggtgt | catcattgct | gatactaacc | ttaatccaac | 139560 |
| gactatcaag | aagtggcaag | agttggcata | tgaaattgat | ggtgtcaagt | gggaaattaa | 139620 |
| acgctttgac | gttccttgga | ctgaactagt | taagcgtaac | ctctatcgtg | gcgcgaatgc | 139680 |
| agttcctatt | gaagtgctcc | gtagcttcta | ctctaagatg | catccgtatg | atttgtacat | 139740 |
| tccagatgaa | tcattgccaa | aagcagttat | ctttgaccct | gatggcacgt | agcagataa | 139800 |
| caatcatcgt | tctccttatg | acttggccaa | atgtggtaaa | gaccatccaa | aggaaatggt | 139860 |
| aattgaattt | cttaaaatgc | ttcgtaacaa | aggatataaa | attcttactg | ttttctggtag | 139920 |
| agagtctgga | actaaagaag | accctacagt | ttatcaacgt | attacgaaga | aatggctgtt | 139980 |
| ggaccatgtt | ggcgaaacag | gcgaacactt | ccaacgtaag | caaggcgatt | cacgcaaaga | 140040 |
| cgatgtggta | aaagaagaaa | tcttctggga | ccgaattgct | gatcgttata | atgtaaaact | 140100 |
| tgcagtagat | gacagggcgc | aggtagttga | aatgtggcgt | cgtatcggtg | ttgaatgctg | 140160 |
| gcaagtagcc | cacggtgatt | tttagaggaa | agtataatgt | ttccaaagta | ttctgaagta | 140220 |
| gtaaaagtat | catttacgca | agttgttgct | aatcatttaa | cagatgagtt | tactccggct | 140280 |
| gaagtagcca | aaatgcatgc | agagttttta | tctgccatga | atgcacttat | tccaaatggc | 140340 |
| gaagttgtta | aattttcaat | tgaccgtcta | ggcggttcgt | ctgaaattaa | aatttcttgt | 140400 |
| ggcgaaggtg | aacacgactg | gtttatcgtt | ggaattattg | ctaattttga | aacccaacag | 140460 |
| gttgagactt | atgttgtctg | acgctaaatt | ttcacatgat | gaatttattt | cgaaggttaa | 140520 |
| aatcttcgca | caggaagtag | caaaccgggt | tcctggaagt | aaagtgactc | tccgacgaga | 140580 |
| gtcatccttt | aactatgttg | atgcttatat | cattacagtt | aataatggaa | agagcaatca | 140640 |
| acatactcaa | ttggctttaa | ctggaacagg | ccaagttgaa | atgactaaca | ttttaggaca | 140700 |
| tatctaatga | ctttacgtga | agcggtagaa | gctcttttaa | ttgaacatgc | tcgtggcatt | 140760 |
| aaagcagaaa | tcagcccaaa | tggtattcgg | ctgatcagtg | ctgttattgg | ttctgaccaa | 140820 |
| ggtgtttggt | caattccacg | cgaagaatat | gatgctattt | tgtacagtaa | cgttaatgtc | 140880 |

FIG. 20XXX sequence.txt

| | | | | | | |
|---|---|---|---|---|---|---|
| aaggaaggac | aacctatgta | tggttatgtc | ttctctgact | cgcttgaacg | aggaaaccat | 140940 |
| ccgtttccag | atggcacagg | cattcgtact | tctcgagtag | agagttttgc | ttctcctacc | 141000 |
| gacgagttaa | aattggttaa | aacaaataac | acaacttatc | tggtgattta | aatgaaagcg | 141060 |
| tcgacggtac | tacaaattgc | gtatctcgta | tctcaagagt | caaaatgctg | ctcgtggaaa | 141120 |
| gtcggcgcag | taattgaaaa | gaacggacga | attatttcta | ctggctataa | cggttcacct | 141180 |
| tctggtggtg | tgaactgttg | tgaccatgca | gcagaacaag | gttggattgg | tgaaattcct | 141240 |
| tacaaatcta | cgggattgcg | tcaagacgga | ttccaagtca | aaaaagtcgg | attgctcaaa | 141300 |
| gaacatcgag | cagcccactc | tgcatggtct | aaagtcaatg | aaatccatgc | tgagcttaat | 141360 |
| gctattcttt | ttgctgcccg | gaacggcagt | agtattgatg | gagcaacaat | gtatgtcaca | 141420 |
| ctgtctccat | gtccagattg | tgcaaaagcc | atcgctcagt | ctggtattaa | aaaattagta | 141480 |
| tactgtgaaa | catacgacaa | gaacgaacct | ggctgggacg | atattcttcg | ttctgctgga | 141540 |
| atcgaggtgt | tcaatgttcc | aaaacgtaat | ttggataagt | tgaattggta | taacattaaa | 141600 |
| gaattctgtg | gaattgaata | atgaaactta | gaattgttga | aattaataaa | cttaacctaa | 141660 |
| gtggtgatgt | tgttatatca | tactcagtag | aacgccggta | ttggtttaaa | tggaaaccat | 141720 |
| tagcaacatt | taaatttgaa | gatcaagcag | ttcgattatt | aaaagaatta | tccaagcgca | 141780 |
| aatctgtaat | tatcaaaact | attaaagaga | catcaaaatg | aaactgacta | ctgaacaaaa | 141840 |
| catccatatt | cgtgaaactc | tgaaggctgt | gctgagcatg | ggcgaatccc | agattgtgtt | 141900 |
| tgaaaaagct | gatggcacta | ttcgtactct | cgcgctgtact | cgtgataaag | acattattcc | 141960 |
| atctgatttg | gtagaaagca | ctactaaatc | tgctcgagca | gaaagcacta | cttcacttcc | 142020 |
| agtatatgat | accgagaaag | aaggttggcg | ctcatttgcc | tttgataaac | tgatctcggt | 142080 |
| aaatggtatg | aaagttgagc | atctgctgca | gatgatcggt | aagtaatttg | ctttaaactg | 142140 |
| accatgttaa | tataactaca | tggtcaaaca | ataaggtaa | cacatggaac | ttccaattaa | 142200 |
| agctctaggc | gagtatgtaa | ttctcgtatc | tgaacctgca | cagcaaggtg | atgaaattgt | 142260 |
| ttctccttct | ggtattattc | ttggtaaaga | agaacaagga | caactgccgg | atatgtgtga | 142320 |
| aatctattct | atcggtgatg | atgtaccgaa | aggatttgtc | gaggtcggtg | atttgactcc | 142380 |
| gttgcctgtt | ggtaatatca | gaaacgtacc | tcatccgtta | gtagcagcag | gtgtgaagaa | 142440 |
| acccaaagaa | attcggcaga | agtttgtgac | ttgtcattat | aagtcccttg | catgcgtata | 142500 |
| taaataataa | tatgaattgg | gcgtcggaca | attagttacc | cgagcaattc | tacgtggtgg | 142560 |
| atgcccgagc | taaacctcgg | ttaccgtcca | ccaaatttta | acctcatttg | aggaacgatt | 142620 |
| caatgaacaa | acaacttact | aaagctctgg | aactccaacg | taatgcatgg | aattccggtc | 142680 |
| acgaaaacta | cggtgcttca | atcgatatct | atgcagaagc | actggaagtt | ctgaaagggt | 142740 |

FIG. 20YYY sequence.txt

| | | | | | | |
|---|---|---|---|---|---|---|
| ttaaacacct | gaacccagca | caagctgaat | ttcgtgatac | tttagaagcg | atggacgaac | 142800 |
| tgaagtatgc | taagcatctt | ggttctgctg | ctcgcaaagc | tgttcgccac | tttgtggtaa | 142860 |
| cgctgaagta | atttgtacgc | ccaccatgtg | tacgcatggg | taacgtatga | tgtggacgtt | 142920 |
| gttggttatc | cccacgtaaa | acatccgaaa | ccaacggtga | tttgctacca | aagtgcagct | 142980 |
| agaaataaac | ggcaagtgca | tgctaccccg | aggcgatggc | caatcgggag | tacgcctcaa | 143040 |
| ggcctataca | tccatcggtg | tatatcttat | ccccgataaa | tcggacccgg | aacctttaag | 143100 |
| ctaacggtgt | gcaacagata | agagtttaaa | cgtacccctt | gagggctttc | gggagctaca | 143160 |
| accgaaagaa | ctgtcgaaag | aagttgaacc | tcggaagaac | gtgctcccat | gtatttctcc | 143220 |
| aaaatggaag | atgataaaat | ggctaaacaa | gctaaagcaa | aaactgcagt | aaaagaagtt | 143280 |
| gttggtacct | ctaaacgcgc | tggctacaag | cgtgggtcga | acaagcgtat | caatcagacg | 143340 |
| gttgagaaaa | tcatgcgtcg | agctcgtgcg | gttcttcgcg | atgatgcttc | tcgttttggt | 143400 |
| aagccgaaag | cataagttca | gggactcctt | cgggagtccc | ttttttattt | tccacagaat | 143460 |
| gaaaaaagtt | gtttacttct | aggctcaaca | aggttactat | agacctgtac | cacccaaacg | 143520 |
| gacaacggag | aataaaatga | acttcactaa | cttcaaccgc | aaatacgtac | agaacaatgc | 143580 |
| ctgggacgtc | tctactactt | tgctgtggga | acacaacaac | ggcacagtgg | ctcaaatcga | 143640 |
| tatgtactgg | gaagataact | acgtattttt | cagctttgaa | aatggtccta | ctctggatat | 143700 |
| tcagttcaac | ggttctgaaa | tcaaagttgg | attccatgat | gaagttcgta | acgtgatttt | 143760 |
| atcttcacat | ccgtcttgga | acacaaatcg | tcagctgctt | gttaaaattt | atctgcgcca | 143820 |
| catcctcggt | cgtaaaacaa | ccgaagaaca | acgtgaagca | atctgggata | tcgtttcaaa | 143880 |
| cgaaataaag | ttttaactaa | ctcggggctt | cggcccccact | attgaggaaa | tgataatgga | 143940 |
| aaaaggtaaa | ttctataagc | ttaaaaagac | tccaagcttg | tctccaggcg | ctcttatcaa | 144000 |
| gggtgttttt | gagcaaatcg | gtaataatcc | aattaaaatt | accagaacct | taaatatgc | 144060 |
| ggaaaacact | ggattagttg | aatttgaaat | cattaagccc | gatggggaat | acaaacgcgt | 144120 |
| tagtatagat | gaagttcgct | tttctcgcat | gtggtgtatt | attactaatc | aagagtttca | 144180 |
| gcattatttt | gaagaaacca | cccacaaaga | acctgaaccg | aagaccgatg | acggaagcaa | 144240 |
| tgattggggt | gtttggacct | caaataaagg | aaatgatacc | tacaaggtg | gattaacaaa | 144300 |
| ggaagaagct | gttaatcttg | caaaagtaca | acgcctgaat | gcaactaaag | acacaaaagt | 144360 |
| tgtaatcatg | caaccttttg | ctgtccctgt | ggttcacgtt | aatattcgcc | cgttttaaga | 144420 |
| ggaaattgaa | atgattgtat | cagctttcta | tgattcacga | aagaaaaaag | ttgaaaccat | 144480 |
| tatcagcgat | acccgcgatg | gtacacctgc | taataaaaat | ggtgtgaaag | catacattga | 144540 |
| taagtattgc | cctcctgaat | ttcgtatgat | tgacggtgta | gattctctga | gcattaacat | 144600 |
| tataaatgct | aaaattgaat | ttattaatga | aactgtgcca | attgggtatt | ctgacggtga | 144660 |

FIG. 20ZZZ sequence.txt

| | | | | | | |
|---|---|---|---|---|---|---|
| tggctcaaat | gctaaaatgc | cgaaagaaaa | attcataact | aaattttgag | gaaatcaaca | 144720 |
| tgattgtatc | cgtgcctaaa | tctaaagatg | gtattttttc | ttgcggcttg | aaaaaccacc | 144780 |
| caatggttga | tatcatgtca | gctaacgtta | aacaacacac | cgttgagtat | gaaattgatg | 144840 |
| ctccggattt | ctttgaattg | cctgaatggg | cagtgaggct | tgatgcatga | aatatcatat | 144900 |
| cttcaataca | gtaagattag | caaatggaat | tcctggagtt | gtatgtgata | cggctccagc | 144960 |
| cattaaagcc | tactcggttg | aaccttggta | tgaagttaat | tgggttgatg | gcaatcgttc | 145020 |
| aatccatgca | gaatccgagc | tttatccaat | tactcaatta | agggctgcta | acgacgatgt | 145080 |
| ctattaatcc | tcacttcggt | catatggttg | cccgacgtat | caccagggaa | atgctaaaga | 145140 |
| ctgctgagta | ttataatata | gaattaattg | atatagaacc | ctcggacgct | ccagggttaa | 145200 |
| tctggttcaa | tttcaccggt | gccgcaaata | gcgtcgccaa | atttaaacaa | gcattgagga | 145260 |
| atttccccga | atgtcaaaac | cagtaatcgc | aaccgatgtt | gatggaatca | tcgttaagtg | 145320 |
| gcaaagtggt | ctgccttact | ttgcccaaaa | atataacctt | ccggtagagc | atatccttga | 145380 |
| tatgatgact | actgaaaaat | tcattaaacc | cgctgagctg | tttgattgtg | aagaagacct | 145440 |
| ggctgttaag | cttcttctga | aatataacaa | cagtgatttt | attcgttatc | tggcgccgta | 145500 |
| tgcggatgct | ttagctacag | ttaataagct | caaagaaaaa | tacgattttg | tcgctatcac | 145560 |
| ggctcttggt | aattcagtag | atgctaacct | taatcgtcgt | ttcaatctga | atgctttgtt | 145620 |
| ccctgatgca | tttacagaaa | tcatggtctg | cgattatgat | gaatctaaag | atgctttact | 145680 |
| ggaaaaggct | aaagtaaaat | acggcgatcg | catcgtctgc | tatgtagatg | atttgcctaa | 145740 |
| acatattgct | gcggccagca | aagtatttga | agacactgaa | acccgtgtgt | tctatatgcc | 145800 |
| tcgtggtgag | cgagagggtt | cagtgactgc | tcctggaatt | atggttgaag | attggcatca | 145860 |
| aattgtaact | tgcctggaat | ctttggaatc | tgttaagaaa | ccgcagaagt | ctctttctag | 145920 |
| attgtgggaa | gaagctatca | aagaccaaat | tcgtaaagag | caacatcctt | ttaattggcc | 145980 |
| tccacggcaa | gttccaggag | attggtggaa | acaacctatc | attccgttta | gtcctagtcc | 146040 |
| gcatgttcct | cctggaaacg | actggtggaa | taacggtcgt | attacatgtg | ataaccacca | 146100 |
| aattaattgc | taacacactg | ggtatggtat | aatagccata | ccctaggagg | aaatatgttt | 146160 |
| gtagttcata | ctaaggtagg | taaacgttgg | ttatcatgtg | attatggcca | tgttaatcag | 146220 |
| ttttatcgtt | ggaatccaat | ttggcgtgaa | gcaaaggcgt | gcccgatttg | gaatgaatgc | 146280 |
| atcaataacg | ggtttgttta | tatcgatgga | ttaacttatc | atcgtagcgt | aagcgaactt | 146340 |
| tcaaaagaat | taggtgaata | atgatttttg | atatcatcaa | agcgattgaa | gatgctaagg | 146400 |
| gttctaaagc | caaaacccaa | attctcattg | acaataaaga | taacgttgat | ttaaaacgag | 146460 |
| cttatctgct | ggcgtattcc | gggcgattta | agttctttat | taagaaagtt | ccagaatata | 146520 |

FIG. 20AAAA sequence.txt

```
ctcccgttaa atatccaaat gttccttcaa agacgttttc tgatggtcta gattacctcc      146580
aagacattct ggcagcacga gtacttactg gtaatatggc aatccagggg ctagtagatt      146640
tgctctctaa gatgaacgag ggtgatgcta gtgtactggt ccgtgtactt cttaaggata      146700
tgcgttgcgg cgcttcaggt tctattgcta acaaggtatg gaagaagtta attcctgaga      146760
tgccacagat gttagcatca gcttattctg agaaagcgct atcgtatatt aagttccctg      146820
catttgctca gcttaaagcc gatggagccc ggtgcttcgc tgaaatccgc ggagatgatt      146880
tagatgatgt aactcttctt actcgttccg gtaatgaata cctgggtcta gataaactta      146940
agcgtcaact tatcgagatg accaagaag cccgagaacg ccatcctaat ggtgtgatga      147000
ttgatggcga gttggtatat catgtcgaag tgaaagaaga agaaaacgac ctgtttgata      147060
tgtttaaaga gcctgagctt cctgaactaa gtaaagctaa ggaattccaa cagacggctc      147120
gtacagaatc aaacggcttg gctaataagg ccattaaagg aacaatctct gccgaagaag      147180
cagaaggcat gagattccaa gtttgggatt atgttccgct tgatgtagta tattccgaag      147240
gtaaagttcc tggatttgct tatgatgtac gcttccgtgc actggaaatg atgagcaaag      147300
gctatgacaa gattattcta attgaaaatc atgtcgtaca caacatccat gaagctcgtg      147360
ctatctataa gacatatgta gaccaaggtc tcgaaggtat tatccttaag aatatcggtg      147420
cttattggga agataagcgt tctaagaacc tcgttaaatt taaagaggtt atcactgtag      147480
atttgaaatg tgtcggttcg tacgagcata gaaaacaacc tggtaaaatg ggcggcttga      147540
tgttcgtatc agaatgtggt cgtattcgtg ttaacgctgg gtcaggtctt aaagataagc      147600
ccgaagaact gcacgagctt gaccgtactc atctatggaa aattagagat tctcttccag      147660
gaactatctg ggaacttgaa tgtaatggtt gggtaactgc tgaaggtcgt gatgatggta      147720
cggtaggatt gttcttgcct atcattaaac agcgcagata tgataaagaa gtggctaata      147780
cattcgaagc cgcatttggc gtgaacttta cagaggcaac aggaataaaa tgaaagtatt      147840
atacgaagta attgctaaaa ctgatgatgg gcgaggaggt atttccgtcc ataccgaagt      147900
tcttgatttt gataatatcg atgtattcaa aaacttcaaa gaaaacattg aagagtatga      147960
gtctgtaaat ggattacagg tttggcgtac tgccacaata attaattaaa ggccttcggg      148020
cctttttcg tataaataga ataaacaaac gaggatatgt catggaactt ttaaatgaag      148080
ttttcgatga agagaatagc aaaatctatc ctgtcgagaa cgttaaacca aaactaaagg      148140
tgcctcaggt atttctgatt aaggtgccgg gtaataacaa tctaatgatt cgcttagtac      148200
atgggtcagg tcaaggtgat gcagttaaga atatcaaaat gggtgataaa ttcattcagg      148260
tatatgtttt ctctgtgtca gaaaaaggta atattggagc cctcaagggt gggttaggac      148320
aagacccgat tggtgctatc aatacaatct ttgaaactgt caacaaagta gttaaacaaa      148380
ttaaagccga tgcagtaatg ttccgcttta atccaaagaa aatgcaagga caagataaag      148440
```

FIG. 20BBBB sequence.txt

```
ctattcaacg cattcttgct cggttgatta ctactcgcac cggtggtcgg ttcaatctaa    148500
tgaaagatat ggcttactat aaaggtaagt atgcttattc cattatggtt cacaaaggta    148560
agaagcttga agagattgaa ggaattcctg aaatttcaga tgagttatac acaaaggttg    148620
aatccaaagt aggtgaaatt tatgtgtcta agaaaccgg cgaaagcgtt accaaagccg     148680
aagcattggc taattctatt ggcgaaaaag aagacaagaa atctgaactc gctgtaatga    148740
gtaaaatgaa agtgtctcga aaagatttaa tccgagcaca gtacggcaaa tttgtttcat    148800
atgttgatga agattggcca gaaaataaac gcgaacgttg gtacgaatta actactaaca    148860
ctccagtact aaacgcagaa ggcgatacgg tagacctcca aaaagatatc aaagccggat    148920
tagaaaaatc aattccttt tatgttgatg atatcaagca ctatcgtgtt cgtggcggat     148980
atggaagtaa ttttggcgat gcagttgaga gattatttgt aggccaaatg tcgagaatgc    149040
atgacgactg gaaggttttc attccttcgg gttcagacaa aatgaaaatc gctgaacaac    149100
gaatttcaga cgttgctgac gttattgctc aagctaaaaa tcctgcatct atggaaacaa    149160
tgcgtaaaat cgttgaagta gctactcgtg gatttgatat gcctccagct gacgatttcg    149220
gagctttgcg tcaataccaa aatcttgtca attatatgat atccgcttat gtgtcaattg    149280
ttggcgattc tatatccaaa gcaattgaat ataaccgtga aatgcaatct cgtttaagcg    149340
aagaagaaag agatgcaata catcattact gtggttctgg ttattcattt gttaataact    149400
atcttattgg tatggaaagc ttaggcgatc cgattattga caagaaaatt cgtccgctcg    149460
attctgcctt tgaaaaaggt ttgcgtcttg aaccaggcac tcttttgtat cgtggtcagc    149520
gaggaaaata tgaagacttt aaagataaca ttgagtctaa aatgttttat ttccagaact    149580
atgtttctac ttcgttaagt ccaattatct ttggtgctta ttcaaatgct ggtgattcat    149640
taatgccaga cgcacctagt tctgatttag aaaacaaaga aacaactgct aatgcggtat    149700
cttctgttat tggaacagac aacttggaaa gagttgatag aggcgaggaa gttgcctatg    149760
gcgatgagtt taagtttgga ttcgttattc atggggctga taaagttaag gtagttatcc    149820
caggtgtctt gtcaagcttt agcgatgagg ctgaagttat tcttcctcgc gggttggcaa    149880
tgaaagtcaa caaagtatgg ggaactcctt ttagaaatgg agttggtgta gcaataaca    149940
agacattcat ggtagaaatg acggtagttc cgccagagca aatcgatgaa tccgttcatc    150000
tctatgatgg tgacatcttg atggaacaag gaaaagtgga acctcttgaa gaaagcaagt    150060
tcaaaggctt tttaaatgag atttactttt cgccagaccg ttctacagat aaggttagct    150120
acacacgtac catggagcta ctggctggtg ctatcaacct ggatggtatc ccagaaaaac    150180
ttgcataaag ttgtttactt atcacaagga cgtgatacta tagacttaca caaccaatg    150240
aggaaattga tatgaaacac gtattccgct ttaacggtat tgaatggtct gctgatgtta    150300
```

FIG. 20CCCC sequence.txt

```
aagatgcaga gaagttcaat gaagaagttc ttatcatgct tgaagggttt aacgaaggta    150360
ctccgacggt tcttattcaa gatatcttcc gtaagccaac tgaaccatcg tttgttgaag    150420
cggttctaaa cggtaaagca gaaggtatta ttccggtcaa agtagtttgg actactaaag    150480
aaatgaaact tcttcgtact gagccagggt ttattggctg cattgcataa aacaaagggg    150540
ccataaggcc cctaaattat tctgcttgtt gaagtagtga tattagaaat tccaccacct    150600
gccccgccta acgagacaa tcttgaagca gacgtactca agccctgatt tggattaatc     150660
gtctcaattt tctgaatagt tttatcttct aaccaatcca ttgcggcttg ttttccgact    150720
gaacctgttt gcatgctgcg ataagcaaac gtgacatcaa acacagctat tgtgttttct    150780
ccatcgtaag taaattcggg agctccacat gctacaggca tagcccctga gaacaggcat    150840
acagtatgtg gtaatccatt tctagcatga aggttaactt ggatatcaca ttctacgtct    150900
tgtggcaatc ctcgcagacc agtcaccggg tcttcaactg catttaccca atcttgcatt    150960
gctctatagt tgcttgcttc tgggtccatc ctaaatgaaa gaaccaacgg ctccatatct    151020
cttccagtga tttttatgtt aggagcgtta tggaacttat ccatttcata tgacagtcta    151080
ttctctggta ttttagcaga atacaccatc aagcctgctg tcggaaatgc catgttaaag    151140
aaatcaagca gataagtacc tactgtgaat tcacctaaca acgactgtac aacacgctgt    151200
gtcattgcgc caatcataaa tgtattcaca cctgatttgc gaacaacctg tcgagttcct    151260
tgtgtcacta tggttgttat accctgattg aattcacctg gtgtcaatcc aagccaattt    151320
ccatctaaac ccatattatt atacagctct ccgccaaagt cgtttagaag agcctgggtt    151380
ttactagagg gtacagtagc gaatacaaca gagaacatat tagttctctg gaaatcgatg    151440
tcagcagctt gactcttaaa ttcttcgaga gtaaacatta ttcaatacct ccgatataaa    151500
cgttccctct attaagagta agtatttcac gcatagtaat ttcaagcgta aacgtgcttg    151560
gaaggttagg agcgattgct aacccattaa aatgaccgtt cggtgtttta tcaaagcgga    151620
tgctctgaat ttggcacgga ccaaatatat cctctctacc atccattgat gtagaatatc    151680
caaaattacg aacagtccaa atcgttgggt tagaaactac aataacattg cttaaaaacg    151740
atgttatttg ctcaaacaca gtgttttcta ctttagctcc atccggtgct gccgatttaa    151800
gtgttccttt ataccattca tcaatagcag ctttaacttc ttttgcatat gatgaattcc    151860
ccgtcacacc gtaagaatag tagttaaaaa tttcatagat gcgaataatt tgtataaggt    151920
catctgcaga cctaggagtt aaatcccaag taaacacttt cgttctatta tcaggtccgg    151980
catacatact acgggcagtg ttataaattt gctcaccgtt atcggccatt aatccctgcg    152040
ttaaagattc tatcgaccca aacaccgcag tagaagccac gttgcttaat acaccagtag    152100
cagtaccgct gccgcgagta acaagagaat cgccaacatc attaaattta tggctaaccg    152160
aatcaacgtc tgacttagac cgtggtaata gaatattagc taccggcgca gtacttgtag    152220
```

FIG. 20DDDD sequence.txt

```
tagaacttga tgaattagcc agtgctgaca ttggtgaatc gaatacagac gataacatta    152280
catctcgtct aaatgaacgc aaatcaggag tagttcttcc tttaaaatca tatgctgtga    152340
ataataatcc gttacgatac aagtcatgta ctctcatatc ttgtgcggaa tcgtttccgg    152400
ctgagcgttc ggccggaaac tgcgccacct tagtggtagg cgcattcgtc agtttagatt    152460
taccttggga aattcgagtt cctgattttt tgatgttttc aaggccatcg gccagttctt    152520
caaaaatcat tgttttcct taagaggttt tcatagcgcc ttgcattcca ggagcagctg    152580
ttgaagtctg tggaggcgtt ctataaacgt atgtgctatt cttatttaca gcggtattaa    152640
cctgaatagg ttgcgactgt gtattagatt cacgtgtacg agctgcttca cgactatctg    152700
cggcggcttt aatagaagca gactgcttaa cctcaggctg ttctgttgca ggtatagctt    152760
cggcagttgg agcaggttct gatattttag aatcaagaag cttttgcaat tggtctaatt    152820
caacctttaa atcttttgca acttctggag ataatttctc caattcttta tatctggtgg    152880
ttgtgctttg tactgcatcc ttagcagagt ctaatcgagt ggaatcagat gcatcagttt    152940
tttcaacata tgcttttgta cgcttgagtt ctgcctcagc attattacga gctgtgatga    153000
ttttgaggcg ttcgtcttct ggcaagtctg catacgctga ctgctttttc tctccgctca    153060
gcaatttatt atattcatcg tcatcaatct gaccggtgaa tttttggaat ttagcagaaa    153120
gctttctttt ccattcaggt tgttcgtcat attctctttc ttgacggtca acatattttg    153180
ctctcatttt agcatcttct tcatctagtt ctgccccagt aacagtttga aatctgtcta    153240
aagcagcgcc ttcaatgtta tctgccgaat cgttaaatcc taatgcgcgt aacattccag    153300
cgagaagctt actcattccg agcataatag tttctccgag cttgtcaatt acatcaacca    153360
agccagaacc aatggcttta gctaatccgc cccaatcccc tttgacgaat gattttacta    153420
tttcattcga catctcgctt attgctgtta atagcggacc ccattctttg gcttgcttgt    153480
taaattcaac aaagttcttt tcgaacagtt tagtccaata attaaaatga actttaatta    153540
aatctataag cattatcacg cccaaaacca tggcggcagt tttcgccatt tgagccaaag    153600
cgctaacagt atagctaaat agcatgctgc taattttatc tgttaatgaa atagttttc    153660
caaaccaga tttaacactt ttaattaatt ctccaaattt taggccaaga aactttttat    153720
tcttatcctc agtttctttg ttaggttctt ttctttcctc ttgctcttct gtgttaggaa    153780
agaaatccgc gtcaggacgt ctatcatcct gtggaggaat aagcctttcg agtaattcct    153840
ctagcggctg ctgaaccgga gcatcaggta cttgttccgt tattgtttct aacgatgttc    153900
cagtaccagt cttttggaca tcttgctgaa catcatgctt tttagataac aagtcggcaa    153960
gtttcgtgag cttatcatta attaacgatg ctgtatcatt tagtttagag acagcatctg    154020
ttgtgcgttc tgaagcttca gcagttaatt caacaccagc tgaaacatct tctactgatt    154080
```

FIG. 20EEEE sequence.txt

```
tgataatttc atttgattta gtttctatta catccgaaat caaatcagta gacgcttgtt    154140
ggtcgtctaa gcgacgacca atatcttcta gcgtattaat ctgagcatca gcttgagact    154200
cagcctttt ctgtggagcc gagtcagcaa taactcttct acgcattgaa ttcatttctg     154260
atttcttagt cattcaaata tttccattac gttaagcatg cctttgattg gtccttcagg    154320
tccatcaatg gctatagtgt ttactaagtc atcagcccac tttgttacaa aagctggaag    154380
cttcataaag tttatatcca ttggttttcc atctactgat tcaagaaatt cgcttaaaat    154440
tgaatctact gaacctagtt tggaataacg aggaggagct ctgaatttga attctttacc    154500
atctaaccgc tgagttaatc gttggcaaat gtaaacttta ttcaaatcgt aggtaaaatc    154560
atctttaaca accgtttctt ttattcggtt gttaaatgct aataaatgta gtacaacgat    154620
atcggattcg gctgccgtta atcctgggca aattgaatct aaaagaagat tcatgttttc    154680
gtctggtccc ttaacatctt tcatcagatt atggtgcttt aatccaagtt ttggaattga    154740
tatcgtcttt tcgtttatta ctattttctt aataggaaga atcacgttta agttcatttt    154800
tcaccttaat caaatctaca ggttcaaggg cagagccatt tgtgaacata tataagttag    154860
ttatagatgt gttatttgat atttcatgga taacttcatc tacataaaag tcagttctga    154920
actggtcctt taaatcaaca aaattgattt tcattccagg agttagttca aaattaccgt    154980
aacatttagt ttgagcatac ccgtcatatt gagccatcgt agaaatgcgt agtgcttctt    155040
catagccatt tctaaaaatc atgtcagaat atccgcctga cctattaatg aatacgctgt    155100
tttggccttc tccattaata attcgggtaa catctttgtc cacaaacgag tgtgcataaa    155160
atgttgcgtt tttcatggga tttctattat atctgtttga tttaacaagc cattcaaaat    155220
cccatgccaa tggatatttt aatcctgctg caaactgacc tattgtttga ggagctccaa    155280
acatgaatac atttgggttc tgggatatca ttgattcata atccatcatg ttaatcccag    155340
tgatatcttc ccatgcaaaa ataaattggt cgttatcagt agaaatgcct acgtttctaa    155400
cgtatcgcaa gtaatctttg agagtactag tccatggaac tcgtgggacg taggcgttaa    155460
ttccgttgat aggaggagca atcaatggtt ggtcaacata catcgcgcct atcatttctt    155520
ttatagtttc atatgcagaa ctaaaaaacg ctctactgaa cttgagattc attatgtcat    155580
gcagcgttcc aagctgaagg gtgataatgc tatcaccttt atcatcaaca ccgactgtaa    155640
agtgtttaat tccgtaaatt cgagtttgcg ttcttgatgt gttactgttt gcaacagata    155700
tttgaactag ttcatcaccg ttcatacgcg tgtgcatatt tttcgaatca taaaactgaa    155760
gtagaccctc attagtcccg cgtaatgaat ctctcattgt taatgtaata aatgtagctg    155820
ctaattcaac gaatctatta gctagccacg catcatatcc agaatataat tttatgctta    155880
tattaggata tcctaatctt tgtgctgtca tgatttaagg tccttttcaa taagcgataa    155940
ggttatgcca cgttctatag gcagcatttt cattatagaa ttcaaatcgt atttaccctg    156000
```

FIG. 20FFFF sequence.txt

| | | | | | |
|---|---|---|---|---|---|
| agaaaccaat | ctatggttaa | tctgataaaa | tgtgaaaatc | tcgtcaggat | gtagcaatag | 156060 |
| cttaaaaata | tcgacaatgt | tatcatattt | taatattgtc | gtggtatcac | agcatgatgt | 156120 |
| ttttaattca | aaattaaagg | gcttcatctg | tgataaaatc | ttttccaagg | tttcaacatc | 156180 |
| tatagcatcg | ataacggtca | atttattgct | atcgctcaat | tcattccatg | cgtattcccc | 156240 |
| agatgaatcc | ttcacagata | taatgttatc | taaaatcatt | ttacctgtat | cgtcaattat | 156300 |
| ttctatgggt | tttttgaact | tgagcgttaa | tccagcaacc | tctactttg | gatttaccaa | 156360 |
| tggaggttgg | ttaagattaa | aaagatactg | cttatatttt | ccgcattttg | ggcacttcat | 156420 |
| tctgacaggt | attttggttt | taccaatact | tgaaagaaat | accttaagaa | atatataagg | 156480 |
| acgatactcg | gcaggatggt | catgaaaata | atcatccatt | aattctgcta | taagttgttt | 156540 |
| ttgttcttct | tcagacttgg | tgttcatgtc | gtttctaacc | aataaaaggt | ctctataatc | 156600 |
| ttctactgta | aatggcttaa | aacgttggac | accatctggt | aattcgcatc | taactatatt | 156660 |
| ggccataagg | taatcctctt | tatactattt | ataaataatt | gaataagagg | agtggatatg | 156720 |
| aacatcacat | acaaatttga | aacaagaata | aatggcaaga | atatccagtg | ccgagctttt | 156780 |
| acactagaag | aatacgctaa | tttaattgca | gcgaagaaaa | acggcacaat | cgatgaatgc | 156840 |
| attaaagcat | tgctcagaga | atgcactaat | gccactgaat | taaacaaaca | ggaatcggaa | 156900 |
| ttacttatag | ttatactctg | ggcccatagt | attggcgagg | ttaatcacga | ggtgacctgg | 156960 |
| aattgcacct | gcgggcgtaa | aattcctgtg | ccattaaatt | atacacacgc | gcaaatcgat | 157020 |
| cctccagaag | acctctggta | tgacttaaag | ggatttaaaa | taaagttcaa | gtatccgagt | 157080 |
| cttttttgacg | attcagacat | tccaatgatg | atatcaaaat | gcatagatta | tatcgtggtt | 157140 |
| ggaaatgagc | agatttactt | taatgattta | aacgatgcag | aaatcgatga | tttatattct | 157200 |
| gctattacaa | ccgaagatgt | agttaacatc | aaaaatatgc | tattgaagcc | gcaggttcaa | 157260 |
| ttagcagttc | ccattacttg | tgaatgcgga | atttctcaca | ttcatgtaat | taaggggctt | 157320 |
| aaagaattct | ttaagattat | gtcatgagca | atatcgataa | attatattct | gaccttgacc | 157380 |
| cagagatgcg | acttgcttgg | gatactgatg | tgtcaaaaac | ggtaggagca | cgatcggtta | 157440 |
| aaaatagcct | tcttggaata | ataaccacca | gaaaggggtc | tcggccattt | gacccagcgt | 157500 |
| ttggctgtga | tatcacaaac | gaattatttg | aaaacatgac | tccattaact | ggtgatacga | 157560 |
| taaagcgtaa | tatagtctct | gccgtgcgta | attatgagcc | taggattaat | cgtctatcgg | 157620 |
| ttgatgtgct | tccgttatat | gacgataatg | ctataattgt | tacggtgcag | ttttctatag | 157680 |
| tagacgaccc | tgatacgcta | gagcgtatac | gcatacagat | gcgtagtaat | gctaactcta | 157740 |
| gcagtagagt | ataatgggac | tagtccttcc | aaagaaacag | tagagtggag | atagaatgag | 157800 |
| attagaagaa | ttacaggatg | aattggataa | tgatttgatt | atcgaccaga | ctaaactaca | 157860 |

FIG. 20GGGG sequence.txt

```
gtatgaagcg gctaataacc ctgttctgta tggtaaatgg gtgcgtaagc actcgacttg    157920
tcgaaaagaa atgttaagat tagatgccct caaaaagcaa aatcttaaag cacgattgga    157980
ttattacact ggccgtggag aggttggtgg tgaagtatgc atggatgtat atgaaaaatc    158040
agaaatgaaa actgttttaa gcgctgataa agaaatcttg ggtgtagata ctaaattgca    158100
atattgggga attcttttgg agttctgtag cgatgcaatg gatgctatca agtcacgagg    158160
ttttagcatt aagcacatta ttgaccttcg tcagtttgaa gctggcgcgt aataaataaa    158220
cttgtaaact aaggagacaa tcatgtcgaa tacggtatgt gtcgtctgta aaggaccaat    158280
cgatgaagca ttggttgtcc aaacagacaa aggcccggtt catcccggag cttgctataa    158340
ttatgcgatt gaattgcctg tcactgaaga cacagaagag caattacaag aaacgcagct    158400
tttaatttag tctagtgttg atgtagccaa ttggctttgc cccttccttt cggttggggc    158460
tttttttatat cagaagtctt cgtcttcgtc atcttcagaa tcagcttcaa gagcctgtct    158520
acgccccgcc aaagcatccc gcacaatgat gtcatcagaa tcagcaagag tagtttcttt    158580
agagcgctta tcgtaatact tctcgagttc tttcagacca tctaaggttt ggcaagcatt    158640
aattttactc atgaagttat cgatagtagc ctcacgaatt gtggcttcgt aaatatcttc    158700
aaatttaatc atagatttac cgttttcatt acgtagttaa attttcatc agcatatcgt    158760
tgaatacgct ctaatgcatg ttttaagcaa tagtttaaat gtgtgtattt cttttttagca    158820
ttggctgact tcggctttac gcccaggtca tcaatgatat cccacactgt agccaaagat    158880
ttatctttat gcttacgaag aacacgacca atagtttgga gtacgataat cttcgattta    158940
actggatggg ctaaaattac atgatgcagg ttttttaacag aaatacctgt agaaaataca    159000
ccgtagcttg cgacgataat aattcccttt ccgttttctg ccatagcctt taaagcatta    159060
cgtgtttcgg tattaacttc gcctgacaca taatatacat gctcatgacc cgcagcttta    159120
atcatctcga acagctcttt accatgagct acatgtttaa acatcacaaa ggcattttcg    159180
tcacgcgctg caagtttagt agcaagatta gcaatccaac gatttctttt cttaacattg    159240
gtgatgaatt taatttcttc ttgatacgtt ttgccttttta aagcgtttgc ggctgcatct    159300
gggtatctta agaagattgt attaatttta agctcagtta cttgtccatc ttccattaac    159360
ttagaagttg atactggacg gaagatttca ccaaacatac caacatattg catgatatta    159420
gctttgccgt cttaagaga accagacagt ccgtacttaa acatgcaatt tgtaagacct    159480
gcaatgattg ttgaaattga cttcctgtt gcaagatgac attcatcatt catcatcatg    159540
ccgaattgag aaaaccattc tttaggctgc ttaacagcgg tctgccaggt agatacataa    159600
actaatgcat tcgaatcacg agcagtacca cctcgaatac ccagcatagc attgcgagga    159660
aataaacgat aatcacaaaa atcatcaatc atctggtcaa ctaacgctgt ggtaggaacg    159720
atgataagaa ccttgccttc gtaattttct acataatatc gagcaagtaa tgcctggata    159780
```

FIG. 20HHHH sequence.txt

```
agagacttac cagcagatgt tggaagatta agaattctac gccgattaac tagaccttca   159840
tatacagcat cttttctgata ccagtgaggt tcaatcttag ttaatcctga ataaatttct  159900
ttagttgata accaattatc aaaatcctcc cgcgaaagag tttcttgctc gaatatagct   159960
ggatcgaaat aaaccttata tccgaattgg tcagcgaatt ttctgatttg ccaacaaga    160020
ccaaacggta agagacgatt ataatctagc agacgaattc gtccatccca atgtccatag   160080
cgatatttcg ggttgaatct gtatccatcg gcttcgaagc taaaatagtc tctgagttca   160140
tagaaaatcg agtcatcaca ctcaatatga acatgactaa aatctttaaa tttgacttgg   160200
atgtcgtgca ctgtactatc ctcagttata aatacaatca tatttataca ttacatgagg   160260
cacacccaat gctagataaa gactatatta aagaaattca ggcactcgat aaaaaagaag   160320
ctaaagataa gctcgacgag tatgcccaaa ctttcggtat taaactgaaa aagacccgtt   160380
catttgacaa tatggttgct gacttagaaa aagaactggc taaattggcc aatgagccta   160440
tgccagaaga taatgatggg ctgtcaattg ctgatttaat tcaagcagat gatgaaattg   160500
agggtaaagc agtatttaaa gatgaagcgt ctgatgaggc aaaactactg tttgacgctc   160560
cagttaatgt tggtattaaa attcatgata ttgacccagg tttttataaa gaaaccccta   160620
aggtaaatga cccagggttt gaagtaaaaa caccttctat caatgataaa ggatttttatg  160680
ctgaagctcc tattggagac agcgttattc atatagatga tgaaggacaa gttaccaata   160740
ttccggttag tatcacggac cctgaagaat tctccaaagc aatggacaaa gtagttaaaa   160800
ttattaaaac agacgaaatc attgagcttc ctgaaaactt tagtccaaat atgcaattgc   160860
taggtaagaa cccaggatat attactcttc catggtggat ttaccaatgg attaaagata   160920
acccagattg gaaatctcgg ccaacgtcgt tgaacaccc atcagcacac cagacactgt    160980
ttagtttaat ctattacatc aaaagaaacg ggtctgttat gattcgtgaa acacgtaatt   161040
cttcatttgt aactttaaaa taaggaacac ctatggctta tagcgtatct attgctcctt   161100
tggctgcttc ggcagtcatt ggagcaacaa ccaattttac tgcaacaact tctggagccg   161160
cagctgaagg cacagaaacg tttgtatgga cagtaaatgg cgtaaaacaa tcttctgtca   161220
ctgcagctat gaattatgtc actgcaggac ctgccggtag taagactgtt aaagtagttg   161280
ctactgttac cccagcagag ggtgaggtag aaaccgctga agcagaaact actttgacag   161340
ttaagaacaa aactatgcct gcgattactt taactttgag cccgacttct gtttctaaag   161400
aaattggaca atcacaagta gtcacggctg atgttactgg cgcaccgtca ggagcaagca   161460
ttgcttatgt ttggaaacgt ggctcttctg ttatttccgg tcaaactggt aaaacaatta   161520
ccttaactga atcaacggaa accagctaca cactgaattg tgaagtgacg gtttctgctc   161580
cagactataa taatggaact gcaactaaag gtattgctgt tgcttttact aaaaagacca   161640
```

FIG. 201III sequence.txt

```
tgagtggtgt ttcagttact ttgagcccaa cttctgtttc taaagaaatt ggccagtctc    161700
aggtagttac ggctaacgtt gttggtgctc cagaaggggc aagtattgct tatgtctgga    161760
agcgtggtac tgtcgttatt gaaggtcaga ctgctaaaac gattaccata actgagtcag    161820
cagaggctaa ttatactctg aattgtgaag caacagtttc tgcaccagat tacaatccag    161880
tgactgtaag caaaggtgct agcgtaacca tcactaaaaa gacaatgagt ggtgtttcag    161940
ttactttgac tcctgaatct attacagtcg agcaggggtc tgatgcatct tttaaagccg    162000
acgttatcgg ttctccagaa ggtgcatccg gaacttattc atggaccaaa gacggttccc    162060
ctgttgaagg ttcaactagt actttagtga ttgacacgtc tgatataggg tctcaagtga    162120
ttggggtttc tgttgaggtt ccgcagaag attataactc agtcacagta actacaactg    162180
gtaatgtaac tattaccaaa agggtagctc ctactcctaa cggagagctt ccgtatattc    162240
atcctctgcc gttccgtgaa acagcttata tctggtgcgg ttggtgggta atggatgaaa    162300
tccagcgaat gactgttgag ggcaaagatt ggaaactcga cgaccctgac agcgattatt    162360
acctacaccg atatactctg gctaaaatgc tagacgatta tccagaagtc gatgtacaag    162420
aatctagaaa tggatacatt gttcatcgta ctgcgctgga agcaggtatt atctatcctt    162480
aatattcggg agccttcggg ctccctttt gctattcata gactggttta atatgtcttc    162540
atcacataga tgaggttatt atgaaagcaa tacaagctca cttgatgcat gaaagtggta    162600
aagatttcca agaaattgcg agagcattag atatcactcc agcggaagct gctaaattgt    162660
gggtctcagt tgagaaagca cacgaacggt ttaagcaaaa agaaaaagtc gtatatcgga    162720
aacgcttaac aaacgttggt ataaaatctc gtcataagaa acttgttaaa cacatgagga    162780
ctttatgatg tctaaagtag acccaattgt agtagaacga tttgaagaaa tgcttttctaa   162840
gaaatttacg ccagctgcta atggggtaaa tgtctggttg tttgcatcta aatttgttag    162900
taaaatgatg gctgttcaga gttcttacta ctataaaagt ggtgcacgta aataacgga    162960
tttgattaat gaacggtatg gaaaaattga ttggatgctg atggataaag atattccatt    163020
agtacttgag gttggaagca aagtcaatt tgaaatcatg ctaactaaaa gcggatatat    163080
catgtatcgc ttcgtgccga gcggttatta attgctttaa aaatcgatgt ggtataatgg    163140
gctcagggga atcctctga taccattatc cttatcccaa gatagatgga ctcctggttt    163200
tatattattt attgagagaa aaattatgaa ccttgcagat agaatggcta atacagctat    163260
taatgttgct acagaagaat tgagtgcagc aaaagaagaa gtattaaccc agattgagaa    163320
aaccgcttta gcgggtaagc gtgagctaat tatgtatcct agcagtttag ttaagaaaca    163380
tatcacaaac gttcttaatt atttgcatga tgaaggattt gttacaaatt ataccagtgc    163440
ccagcgtaat ggtgatactg actttatgaa aatcacattc taaggaaatt ataatgtttg    163500
caaaatattc tagtctcgag aaccattaca acaataagtt catcgagaag attcgtggtg    163560
```

FIG. 20JJJJ sequence.txt

```
ctggttttga tatgcatact gttgagtggg tggctcgtga gaaaattcat ggcactaact    163620
tcagtgtgat tattacccct accgaaattg ttccggctaa gcgtactggt cctattttag    163680
aaggtgaaag cttctttggt catgagatta tcatgaagaa gtacaaggat tctttcgtta    163740
agatgcagaa catgctgaac accatggatt tagtatctgt tcaaatcttc ggtgaatttg    163800
ctggcggtgg tattcagaaa ggcgtagatt atggtgataa agatttctac gtgtttgata    163860
tcctgtcgga ttccggtaac gaaaaagttt attgggacga ttatgtagta gaatcgtttg    163920
ctactggtct tggtcttaaa ttagctccac tgcttggtcg tggttcattc gctgagctat    163980
ctcagtatgt aaatgacttt aaatctattg tcaattacta taatgaactt gttgacacga    164040
ctgaccttga acatgcaaat aaacatgtgt tcggtccaca ggcttcttct gaaaccggtg    164100
tagctgaagg ctatgttctt aaaccggtta atcctaaatt ctttaataac ggtacccgtg    164160
tagctattaa gtgtaagaat tctaagttca gcgagaaagc taaatctgat aagcctatta    164220
aagctaaggt tgaactcact gatactgata agcgtgttct ggaaatcttt tccgagtatg    164280
taacctggaa ccgtgtaagt aacgttctgt ctcatattgg tactgtaact gccaaagatt    164340
ttggtcgagt tatgggactg actatgaaag atatcattaa cgaagcagct cgtgaaggtc    164400
atgacatgct attcgctgat aatccttctg ctgttaagaa agaactgact actttaattc    164460
aaaacactat tcgtagcaaa tggcatgagg ttttagaata atgaggctgg cgctgattgg    164520
ttcaagagaa gcgccacgca gagttctgag tctaatgact ataatcggtc aacgcctctc    164580
ggaagagggg cattttcat attcaggtgg agctccgggt tcagatgaag cgtggttggc     164640
gaaatacgat aggtcaaatt cttgtaggat tattccttat tctggctttt gtggccatgt    164700
tcctgataca ggtgttgttg tatggtctga attatcaaac gaagccaaaa tcaaaagcat    164760
cattaaggcg agagaagtta cgtcgtactg ggatgaatgc tcgaagatag tacagacact    164820
atttgcacgg aattctatgc aggtattggg cctagaatgc actgagcctg tagataaggt    164880
attatattgg gcgcctgaaa aaagatgtgg gagtgtatct ggagggacga gagtagctgt    164940
tgatatagcc cgtagacatg gaatagaatg cgtcaacctc tatgataaga atgtgtttaa    165000
atccctcgag gaggaatact ccccgaggtt tgacatattt agtttataac aaaaagggga    165060
gccgaagctc cccataaatt agtccgcaat aagcttaggt aacttaacac cgagcagtac    165120
agacatctta cttcttcctg ccatcttatc catatccgca gcattaatca cacgagcttc    165180
gtcctcgtcc aatcctacag tatatgggtt aactgacaat gcatatcgta ccagtaaagc    165240
aacagaaggc tgcaagctag ctgggtcaac aataacttta aatgcaccaa catgctcagg    165300
gtcgtctaaa tccaagcctt cggtatatgg cgcataaaat aaagaaccta cagtttcctt    165360
cccaccaaat tctgccttaa caccaacaat aacgtaatca accggactgt tagtatcaca    165420
```

FIG. 20KKKK

```
sequence.txt
ataaagaggt aaaccgttat tcagcatacc gtatgcgttt tccggaatac ttccatcatt    165480
cttctgtgtt aaccaaccgg aagctgcaag caccgcagca caacgagtag atgctactgc    165540
ataagtacca gaataagaag tattacgttg aactgctgaa ttcatttcac aaatgaaacg    165600
atacagagta cgaccttgtt ccggagcaga atcttgttta gttaaatcta atacacccctt   165660
atcggataca ccagctactt taaaccgaga agaaaccgta atcaatgatt gcaagatgtc    165720
tttattaatg tcttctgcca tttcagtagc aagtaaatca tcaataagtt ctggagcatc    165780
gaacccatta gcttctaaat cttgagctaa ttctaccgtt aaatctgttt taagcttacg    165840
tgatttaacc tgggtctgcc atttatcaat tttaaaactg gcttcggtga ttgggtctga    165900
atcgggtcct tcaaattttt cagtgactgc agcatctgac aacatacgaa tattattagc    165960
tgctactgct tcagacacaa ttccaaattc atcggtttct gctgtatcgg taaacgggct    166020
atctttaagt actttaaaga ccacattctg atatttgaac atatcgtctt tattgaatga    166080
gtctttattt gccatagtga gttcttcaat tgactcacgt tctggcgccc cgatttgacc    166140
tgcataagtt gcacccgtat taaacgtcag gtcaccatta gggttaagat atttgatacc    166200
atatagcgct gctacaggct gtttagtacg ctgtgtagca acaagatcgg tatagattaa    166260
tttagtagtt gcgcgcgtta atgcaacgag attagggcga ccaattaagt tgctactcgt    166320
tgtagttgac tcgcgcagaa gttcgttgat tttagccatt gcgctttcct ctgtggattt    166380
ataagtttat ttatatccat taaaacaact aaagggagcc cgaaggctcc cttattggta    166440
ttagatacct ttaacccata cacgacggaa gtaagcattc ttaccaacag agttgacgat    166500
agaaggcata ccagaggtaa tacgaccttt cggctgttga gcagcagaat cggcgaacgg    166560
gttaataccg ataccgtaac gggttttgaa ccccatgacc ggttggaagt tcttcggatc    166620
ggaaccacgc agcggggtca gtgcaacata cggagcatag tagataccag catccattt    166679
```

FIG. 21A sequence.txt

<210> 1074
<211> 144994
<212> DNA
<213> Unknown

<220>
<223> Description of Unknown: Bacteriophage F125/10

<400> 1074

| | | | | | |
|---|---|---|---|---|---|
| ctttgttcaa | attcctatat | ttagtttaat | accaatacta | aggtataaat | tagaagaaca | 60 |
| aggtatagga | ttaatagaaa | cagaagaatc | ctacacaagt | aaaacgtctt | ttattgataa | 120 |
| tgaaaaacca | atcaaacata | atgtttataa | aggtaaaaga | gtaaaaagag | gtctctttaa | 180 |
| aacagaagag | ggtagaatat | taaatgctga | tgtaaatggt | gcatttcaaa | taatgaaaaa | 240 |
| agtattccct | gatgtagaaa | taccaaggga | taatgggttt | gtgtataacc | cattcttaat | 300 |
| aaattgttaa | aaaaacaaca | aaataagaaa | aaatttctca | aaaagtagca | ttatgtgaag | 360 |
| agaagtgtta | cattattatc | gagaattcaa | taataaagca | tagggaaggc | tttttctatg | 420 |
| tcttatagaa | tgctttaaaa | tagattacta | aaataaagat | tggagattaa | gcttatggct | 480 |
| aaaaagaatg | ttaatgatgt | attacaacaa | gaatctgtta | cagtagcaga | taagtattta | 540 |
| caagttaaag | ttaaccgtga | cggttatact | cgtacacatg | aaggacaata | tgcgtacaaa | 600 |
| gtagtttcag | agggagaaga | actattctta | taccctgtac | aaacagatgg | taaaggtaca | 660 |
| ttaaatgtaa | tgaagaaatc | acctattgct | tacactgatg | gggacaatat | ccatttcgta | 720 |
| gtaaacacag | tagtagaccc | ttataatcac | tcatttatcc | gtactgaaga | tatcaaagga | 780 |
| ttagataaag | gtaaacaact | tattcaagct | ttcttagctt | tcgttgaaga | ccgtttcaaa | 840 |
| tttggtgttt | ataacgtatt | tgttgcaaac | agcaaagagg | atgtattatc | tattgtagac | 900 |
| cctacagata | atgatgcaga | tgaagttaaa | gatagtttag | agcacgcaca | tgaagatgta | 960 |
| attgcggatt | tccctgctag | ccctgctcgt | aaggacgtta | aaggcgtaga | ttcaggagaa | 1020 |
| ggtcaaggag | acacttcaga | accatcagca | cctaagaacg | ttcaagttac | tcctaaggaa | 1080 |

FIG. 21B sequence.txt

| | | | | | | |
|---|---|---|---|---|---|---|
| gacggagcag | acgtatcagc | agaataatat | atagataagg | atggtaaatt | tggctaagtt | 1140 |
| aaatttatac | aaaggtaatg | agttactaaa | cagcgtagag | aaaacagaag | gaaaatcaac | 1200 |
| aatcacgatt | gagaatttag | atgctaatac | ggattatcct | aaaggtactt | ttaaagtatc | 1260 |
| attctcaaat | gattcaggag | agtcagagaa | ggtcgatgtc | cctcagttta | agacaaaagc | 1320 |
| aattaaagtt | atttcagtta | cccttgacgt | tgatagttta | gaccttacag | ttggagatac | 1380 |
| tcaccaacta | tcaacaacta | tcacgcctag | tgaagcatct | aacaaaaatg | tgtcatttga | 1440 |
| atcagacaaa | tcaggtgttg | ctagcgtaac | atcagaaggc | ttaattgaag | cagttagtgc | 1500 |
| aggaacagct | aatgttactg | taactactga | agatggtagt | cacactgata | ttgttgctgt | 1560 |
| aacagttaag | gaacctattc | ctgaagcacc | tgcagacgta | acagttgaac | ctggtgaaaa | 1620 |
| tagcgcagat | attactgcat | aggaggacaa | taaagaatgg | aaaagacatt | aaaagtttat | 1680 |
| agtaatggtg | aagttgtagg | ctctcaagta | gctaataacg | atggagctac | tacagtatct | 1740 |
| attacgggct | tagaagccgg | aaaaacttat | gctaagggag | cttttaaagt | agcatttgct | 1800 |
| aatgattcag | gtgaatcaga | aaaagtagat | gttcctgaat | ttacaactaa | aactcctact | 1860 |
| gaagaacctt | caggagaagc | atagtaatta | agaccaacta | aaaagttggt | ctttttttat | 1920 |
| tgacaattta | taatatctat | gatacactat | ataagaatta | agaaaaggag | ggaaagtaat | 1980 |
| ggatattcca | acaatattat | ttagaaatcc | atatgattat | acgaaagtaa | aaaaactaat | 2040 |
| ggaaaacaaa | gagcagtaca | ttgtagtaaa | gtttgattct | gtttctgttc | ataatttaaa | 2100 |
| tgttcaaggt | atgatgaatg | tcatccaaga | ttacctacac | atctatggtt | atagggttaa | 2160 |
| agagtacggg | caagaaaatg | cttctaaaga | tgatgaaaga | gacgttaaag | gttacttata | 2220 |
| tgaaagagta | ggtgagtagg | atatgggaat | tatagtaaac | tccaaccata | ttcaatcaga | 2280 |
| cactttatat | gagtatgata | gcttttttga | tattgagaaa | gtagatacat | tgaagaagg | 2340 |
| attgctttca | atacaagatg | aaccaactgt | tttagcagga | ttcatctatg | atgacatcac | 2400 |
| atttaataag | gttattaatt | ctaattcaga | tattgatgat | tatattaaga | ataatgatat | 2460 |
| ttattatgtc | tctgatatag | ggttactccc | tgatactttt | atcactgttg | attctgataa | 2520 |
| aaaatattat | tcattattac | aacaggtagt | tgagttaagt | aaagacccctt | ttcctaaatg | 2580 |
| ggtagaggat | gatgcaaaag | gcttaactaa | gtattataac | tttcaagact | ttgaagatgt | 2640 |
| atttgattta | aatagttttt | acaaaaaaga | agttgacatg | gtaagagaaa | agtgctataa | 2700 |
| taatggtaat | gtatatttat | tatatgaggt | tctgcctgat | tataaattac | ctctagctta | 2760 |
| tagtttactt | tcaaacaaag | agcatggtat | tgttattatc | ggttcacaga | cacgttctaa | 2820 |
| taatgatata | ctgactttt | atgttaaagg | tatggatgct | aaagcaatag | ctagtatgtt | 2880 |
| caatgtagaa | catgattatg | attctaatat | tttccataca | tttgtaaaca | gtcacattaa | 2940 |
| tattttagga | aatcaaataa | ctaagtttat | aagagagaaa | ggaagcagtt | atgagtaact | 3000 |

FIG. 21C sequence.txt

| | | | | | |
|---|---|---|---|---|---|
| ataaaacaat | agaagaagta | caagcagtta | ttattggggt | attatttaaa | gatgaaggta | 3060
| aaattgtaac | atctaagttt | aataaaatta | ctaaagagtt | tggtttagat | agaatcggta | 3120
| aagatgacct | taaagaaatt | gtagaggata | ttagacaaga | cgcttatcta | aatgaactta | 3180
| aaaacaaagc | aattaaaggt | aaagtaacgt | taggtgattt | aaaagatgtt | gcagataacc | 3240
| aagtattcga | aggtaataac | taccatgaag | aagtatctac | ttacgtagta | gctaaagaaa | 3300
| aagaattgtc | tcacttaaga | gaacagcgta | agcacaatag | gcatactgca | taccctcaaa | 3360
| ttatgtttga | tgaacttaaa | gaacatatgg | ttaaagaatt | acaaggggaa | acattagtag | 3420
| aacatcatgg | aagtaaagct | aatattaatg | atacagagtc | aattgtgtta | ttatcagatt | 3480
| tccatattgg | aagtattgta | tctgatatga | ctaatggtaa | atatgatttt | gaagttctta | 3540
| aagcaagatt | aaatcatttt | attaatacaa | cagttaaaga | aattgaagat | agagaaattt | 3600
| ctaatgtaac | tgtttacttt | gttggggact | tagtagaaca | tattaatatg | agagatgtta | 3660
| accaagcatt | tgaaacagag | tttactttag | cagaacaaat | ttctaaaggt | actcgattac | 3720
| ttattgatat | tctgaatgta | ctatctaatg | tagtttcagg | agaattaaga | tttggtatta | 3780
| ttggtggtaa | ccacgaccgt | atgcaaggta | acaagaatca | gaagatttat | aatgataata | 3840
| ttgcttatgt | agtgttagat | tctttattat | tattccaaga | acaaggatta | ctaaatggtg | 3900
| tagatattat | tgataaccgt | gaagatattt | atactattag | agatacctttt | ggcggtaaat | 3960
| ctattatcat | taatcacgga | gatgggttaa | aaggtaaagg | taatcatatc | aataaattta | 4020
| tcctagatag | tcatatcgac | ttattaatta | caggtcatgt | acatcatttc | tcagtaaaac | 4080
| aagaagattt | taatagaatg | catatcgtag | cttcatctcc | aatgggatat | aataactatg | 4140
| ctaaagagtt | acatttatca | aaaactaaac | cttcacagca | gttattattt | gtaaataagg | 4200
| aaaataaaga | tattgatatt | aaaacagtat | ttttagatta | aggatggtta | ataaatggat | 4260
| acaattttta | ttataggtgt | agcgtttata | acttttgcaa | catttaacat | agtctttaga | 4320
| ctatttgatt | tatggactac | cgagaaaaaa | atggtaagtc | aaggacaacc | cccgctaagt | 4380
| aattttgagt | actatcatgt | gatagtacct | tacttagtag | gtgttattgt | tattacacta | 4440
| agtattattt | ttagagattc | cttgtattcc | gcacaatcag | ggttcggtat | tattattaca | 4500
| agctttattt | acatgctagt | ttatgttata | attggtcttg | tagggtcatt | tatacttaca | 4560
| atattccaag | ctagaaaagc | tagacagtat | caaacacagg | aggataataa | tgaagttcaa | 4620
| tgatatttat | gagcaattaa | ttaaaaatga | tacagtacaa | aacattcatg | agtctcaaga | 4680
| tgacaaagga | aatatttata | caatccaatt | tgataaaggt | aatgataagt | atttatttaa | 4740
| tgttattaat | gatggattct | tgaaagaaat | gacaaacggt | atggtagacc | atcctgaagg | 4800
| tcagccatac | tcagtaagtt | taatcaataa | agaaacacct | agtatgtcag | tgaaacaata | 4860

FIG. 21D sequence.txt

```
tttaacagat gtagaagata ttgtacctac tattagaaaa atggaaaagg atttcttata      4920
gagtcaagtc tttacttgac tcttttttact atatatggta tattaatata gaggtgactt     4980
aaaaatggat tttaatttta gtgcttttga taatagctca ttagcaatga gaattagtga      5040
gggtgtatac tatttcaatg atactcctta ttactttatt gagcatgtag aagaagaaat      5100
gtctgagtat gttattgtgt atgacataca tgacagagag gaaaaagaaa atcctcagaa      5160
gaaatataga atagaacctt accaacgtac aatacctggg ggaacacctc ttagtaactt      5220
aattaagagt atgatgcctc aacgtaagta tcctaagaag gttacagaag accctatatt     5280
tgtagctaat gttattcctt taggaacaga tacagtaaca ggtaaaaccg gtaaaggatt      5340
ttttgaaaga gataaggata gaactatcta ttctcaaaag gaaccaacta aagtcgttca      5400
tggtcaatat acaggtgttt ttataggtct aacaagtgtt aagtggaata gaacatatac      5460
ccctctagaa agtgttgttg agtactacaa aagggttaaa ggggataggt taaatgtcta      5520
atgatgtagt taagttttat gaaaaagata ttaaagacct tatcagaact aaaaaacaca      5580
tgttcaaaga cgatgaaata actagtgata taaacgatat acgaatcttt aatgagaaag      5640
tcatttgtca aggtaagtgc agaacagatt gtttagtact agaccgtaat ggtacagtaa      5700
tgggtataga gataaaaaca gaacgagact ctacacagag actaaataac caattaaagt      5760
attatagtct agtatgtaag tatgtatatg taatgtgtca tgataaacat gtacctaaag      5820
tagaacaaat acttaaaagg tataaacata atcatgtagg tataatgagc tacattagtt      5880
ttaaaggcaa acctgttgta ggtaaataca aagatgctac accatcacca catagaagcc      5940
cttatcatac aatgaatata ttatggaaga caaacttaat gacaatactt agattgatta      6000
gagaccctca tacgtataga acagggtata gctataatgc tagtggtaga tatagtggcg      6060
gagaaggtaa tttctcccaa acaactcaaa gtaaaagaat gaaaaaacct gctattatta      6120
atcaaataat tcattatgta ggggtagata atacttataa actctttaca agaggtgtta      6180
tctatggtta taataatagg tgggaagtta tagaagaaga tttctttaat actatgaaga      6240
atggggtaag agtaatcaat gagcaaagac aaaccaaata gacgtaaaga gatacaacat      6300
cagcctgtta actttgcccc tatgaatact ctaacagggg ctaataatag tttctttgct      6360
aaaaagcctt cagagcctaa ggatgcaaca tctgttattg aatatcgtat actatttatt      6420
aaaagatttg ataacgtaac aagtacagat gtgaaattac agaaaaagta tgcactaaat      6480
cttattagtg aagcacttga tgttaaagaa acttacttgt ctcttaagca aaaaggaaaa      6540
aaaacagaat ctattttgca tacagataga gtttattatg ttcatagagg taaaaaactt      6600
attggaaagt gtagtatcag agaacaaaga acatttaaag gtaaacattt gatatttata      6660
ttcaaaacaa gacatagagt taaagcagaa aggaaagata aataatgtta aaaggatttt      6720
cagaacatgt agacaaacct acaactacta agaccttata caagacctta acaagtggta      6780
```

FIG. 21E sequence.txt

| | | | | | |
|---|---|---|---|---|---|
| aagtagaatt | actaggtgta | tcctacgata | gtgattactt | cccttcaggt | gttacagtac | 6840 |
| aatcttacat | tgaggatata | ggtaatgaag | atgagggtct | acagtttgtt | aataagataa | 6900 |
| atgtagtaga | atcaatgaaa | caggctgtag | taggtatgaa | taatcagtta | ggttcttcag | 6960 |
| gtcttggcta | tgtgagaact | gaacaactta | aaaaagagtt | agaagagact | ggactaatga | 7020 |
| cagatttact | tgctagaggt | actaacttaa | cctctactaa | gaaagtagat | attgtaagta | 7080 |
| cttttattga | gcctgaggta | acataccagg | atattactat | agctaaagat | attaaactac | 7140 |
| gtttgtataa | attagaagaa | gaatcaccat | taaatggtta | cactcatatt | gtatacttac | 7200 |
| ttactacaga | aaagctatat | gatggtcaaa | cactattcgg | tatgctctct | aaaaaagata | 7260 |
| agttatctaa | aggagatact | gataaattat | tagcattctt | cagaaacaat | agcttaataa | 7320 |
| gtaaaagtgt | attttgtgtt | aagttattaa | gtaaagacta | ctactttaat | ttatataaca | 7380 |
| cacatgagac | agggatattc | ttttagaag | acacagatgt | tattactatt | gcttgtggtc | 7440 |
| agtcatatgt | taaagttaat | actaaagata | ttaaatctag | ttatgttaaa | attgaagaca | 7500 |
| agactcataa | attaactgag | ctagtaatta | acttaaaagg | tgacgacaca | ttaactattt | 7560 |
| tattctaaga | gaatgttata | aatatgtgat | aattaagtat | aaatatacgt | tatatgagaa | 7620 |
| gttttcataa | tgttttaat | acagaaacta | gttaagtttt | ttctacttgc | tctagtttct | 7680 |
| gtgaaattat | atttatgaaa | agttaaaata | tcttttaggt | aaaggctttg | taaatagtta | 7740 |
| aaaaatatat | taaaatttta | tacaaagtag | ttaataaaat | tatattacat | ttatatatta | 7800 |
| tgaaataata | acagaaattg | tgatatatta | tatagtgtaa | ccttgaaaca | gttgatgttg | 7860 |
| tagggtttgt | ttatgttcgt | taaactggtt | tcagaacacc | agttaccata | ataaatgac | 7920 |
| agttaaggag | agctatataa | tggctagaaa | aaagaattta | cgaaataaaa | acagtgatat | 7980 |
| aaaagttgtt | cctgataaag | aaaaagaaag | catattatct | aagctatatc | ataataaatt | 8040 |
| actacgctca | aaggtagata | atgcattaga | tgaagatatg | agttatgatg | atattataga | 8100 |
| attatgtaaa | gaatatgatt | tagaattgtc | taagtcagct | attacaagat | ataaaagtaa | 8160 |
| aagaaaagaa | gctattgaaa | acggttggga | tttagaagaa | ttaattgata | aacgtaaaaa | 8220 |
| aacaagtgta | aaagatatta | aggaaaaaga | aactcctata | ttagaagagg | agcaactttc | 8280 |
| tccatttgaa | caatcaaaac | atcacacaca | aacaatttac | gatgatattc | aagtactaga | 8340 |
| tatgattatt | tctaaaggtg | caaaggact | agaatttgta | gaaactttag | accctgcgtt | 8400 |
| gatgatacgt | gcaatggaaa | caaaagataa | gattaccgga | aaccaattaa | aaggtatgtc | 8460 |
| atttattgga | cttagagagt | tacaattaaa | acaaacagct | caagatacag | ctatgagtga | 8520 |
| agtattatta | gaatttatac | ctgaagagaa | acatgaagag | gtattacaac | gattagaaga | 8580 |
| actacaaaat | gaattctaca | aaaacctaga | tttagatgag | gaaagtagaa | aattaaaaga | 8640 |

FIG. 21F sequence.txt

| | | | | | | |
|---|---|---|---|---|---|---|
| agctcttgat | agagtaggct | acacaattta | gatagtgagg | ttagagtaat | ggcagatgag | 8700 |
| attagtttaa | atccaataca | agatgctaag | ccaattgatg | atatagtaga | gattatgaca | 8760 |
| tatttaaaag | acggaagagt | actgagagtt | aagcaagaca | accaagggga | tatccttgtt | 8820 |
| agaatgagcc | cagggaaaca | caaatttact | gaagtatcta | gagacttaga | taaagaatca | 8880 |
| ttctactata | aaagacattg | ggttctctat | aatgtatctg | ttaactctct | tataacattt | 8940 |
| gatgtttatc | tagatgaaga | atattcagaa | acaactaagg | ttaagtatcc | taaagatact | 9000 |
| attgtagaat | atacaagaga | agaccaagaa | aaagatgttg | ctatgattaa | agaaatactt | 9060 |
| acagataata | atggtaatta | tttctatgca | cttacaggag | aaacaatgct | ctttgatgaa | 9120 |
| aataaattaa | ataaagttaa | agattagggt | tgacagcttc | tatagtttat | gatatagtat | 9180 |
| atgtatacta | aaaataaagg | agctaacaat | tatgtttatt | tcattaaatc | aagaagagaa | 9240 |
| agaattatta | actaaagagg | aaagtaaata | cacaccacta | gaaacatcaa | gagagtttaa | 9300 |
| cacacctaaa | gaagaattca | ttgtaacaag | ttataacgaa | ggtaaacctt | tagattacat | 9360 |
| tgcaaaagaa | gctaaggtaa | gtatgggatt | aatttacaca | gttctaaact | actataaagt | 9420 |
| aggtaagcgt | aataagaaat | cacctgtaga | agaaagaatt | gcacatatct | taaaagataa | 9480 |
| aaacttagtc | aaagagatta | ttaaggatta | ccaatatatg | aatttacagg | acatttatag | 9540 |
| taaatataat | cttcataaga | atggtttata | ttacatctta | gatttatacc | atgtagaaag | 9600 |
| aaaatctgaa | cttaaggaca | aagcattaga | agaggataat | attgtcgttg | agtaagtaaa | 9660 |
| gaggttataa | tatgagaaat | aaaaaatcat | ttcaagagca | gttaaatgac | atgcgtaata | 9720 |
| aagagaaatg | ggtatctgaa | gaggagttca | ctgaagaagt | ggctccttct | gaagaacctg | 9780 |
| aagtagaaga | agaaaaacta | tatactttaa | atgagttaaa | agagaactta | ctagatgctc | 9840 |
| aaggattaaa | agatgttgta | gctgattttc | ctgcatctaa | agatttatat | gaacctaata | 9900 |
| aactatatat | ctgtacaata | cctaaaggat | atcagtctac | tgaagtacaa | ccaggacaat | 9960 |
| atattggtat | tagtactgga | ttattatcag | agtcagaaga | cttcagtcat | ttaagaggtc | 10020 |
| aaatgcctag | aaatctttat | gaaacttctc | atgtttttaaa | acctttagtc | cgtattaata | 10080 |
| atacaagtat | cgaatatcaa | cagcatgagt | tacttgaaga | tattaaagaa | gacaagaatg | 10140 |
| tatatgatgt | tgaattagaa | gacttgagat | tagcaacagg | agaagaaatt | tcttatttag | 10200 |
| agattgttga | tagtaagttt | tttgaaagtc | gtattaatga | agttcttgat | ttttaccatg | 10260 |
| aactaacgga | ttccgatgat | ttgcttgagt | attataacaa | attacgagag | ttagtcggaa | 10320 |
| atgatagaat | gatttattgt | ccgcttttaa | ataaatgtgt | taaaattata | gattaatagt | 10380 |
| agtctcctct | tatattataa | ctgtaagagg | agacattttt | gtatagaggt | gttaattatg | 10440 |
| tcaagaaaag | caagtatatt | ttatatacta | gtggttattg | ttttggcttt | ctctatctca | 10500 |
| tcttattata | tatcttcttt | catgtatcac | gacaaagcaa | aaaatgaagt | ctctactgag | 10560 |

FIG. 21G sequence.txt

```
ttatcgaaca caggaaagat taaagaagaa aagaacgtag aatttgttgg tgactacaca    10620
ttgaaaaaag tggaagataa taaagcttat tttatggaaa cattacctac ttacctacca    10680
ggtagaacag gagataacag catagatatg aggtactaca aaacaagtag atttaaggaa    10740
ggggtaaatt tcaagcttat tagggtatat actgaagatg gagaagataa tccaattcat    10800
aagtataggt ttgaagcagt accaaccaaa aagtaataag gaggtgactt aaatgacaac    10860
attaattgtc gtcatcttta ttgctatcat ttattactta tggaacagtg attgagtcaa    10920
gttaattctt gactctcttt ttgttttatg gtatattaat atatagaaag gagagattaa    10980
ttatggaaat ggcagattta gaaagatttg atgcatttgt aagactaatt tcagatgatg    11040
agctttcgga ggaaagaata ctggagttaa gcgtagactt actaaacccg atactagaag    11100
gaggtacagc ttacagagct aaaaaacgta ttaaaagtaa atttggtaag ttagaagcaa    11160
aaaactttaa acgaaactat aaattcttac ttaagtcgat agctcaaata gaccaaagga    11220
gataggacaa tgacagaaag ggaaaaatta attaaagaga ttgaagaggc taacagagac    11280
atacagttac agttaaaaga agtagataat tataaggata gtatacgctc taaaggaaca    11340
agaaattata tctctacaaa ggtattagat tctattacgg ttggtttcat agttagtttt    11400
ttaatactca ttataatgcg tgtacttgaa tactttgtaa caggtaatgc tgtttattca    11460
cctttagcgc ctgcagttat cattatgttt gttttagcac tcggtacatg gaaagtaagt    11520
aagatgaaca aaatagtatc ttatagagga actattaaga tgtactggga gctaagtaat    11580
gctgagcaaa aacaagctaa ggtatttaag tatcctaatg atgaagtaga tattgtatca    11640
aaacataact taaggcaaat aactttagt gagattaata tacttcatct taaatatatg    11700
agatataata aagcagtaga acagcatact aaattatcta aagaactttt taaaaaagat    11760
aaagaaacgg ttgacaagaa taaataagtg tagtatagta ttactaaagg aggagagata    11820
ttatggttat acctagtatt aaagcacaaa acaaattcaa gaatgaatta gagtattata    11880
aacaaggtca cattagtgaa agtaaaatgt tagaattagc ttttgattac atccaagaat    11940
tagaacaaaa taacgaatac gttactaatt tgctagaaga ggagagatat ggtgagtaaa    12000
tttatcggag tgtacttatt taatttacta gtggtagctc tagtttacac agtaggattt    12060
ttattctttt atggtgtagc tagcttagtt attattttaa ctcatgctac tattgacccg    12120
ttcgtattag ctactttctt aggaatagga ttcttagtta ttagaactgc acacagaatt    12180
atggcacgag taatcaatga cgcagtagcc caagccatta aggataaaga aaatgaataa    12240
aggggaattt attatggata aaacattacc aaagtttagt gtatatgaag ttattgtaaa    12300
gactgtaatt atgacaccaa cagaaggaag ttctgaccta gaatcatttt acttttcaac    12360
tagagagtta gcagaaagat ttgttgaaga gaacacagtg gaaacaaaaa acggtaaacg    12420
```

FIG. 21H

```
                                    sequence.txt
tgtatctttt gctgttaaag aacgtaaagt aaatcaacca ggctaacatt aatttgttag    12480
ctttttttta ttgacaaatc attttatata gtgtatagta atattataca gaaaaggagg    12540
aattattatg aaagtttcag aagaagtaaa acagagttac ctagagaata aagctaatac    12600
taaaatggat aagataagtt ggtctgagtt aaaagctagt cctttaggta ttaccttagg    12660
tgatattata ttttatagtg tagttattat agataacatt atagctatta ttttaacttt    12720
aaccttgata ggtactatta ctgactcaat tgagagtact ttagcccaaa taatcgtagg    12780
ggtgttcata atcattacta tatatggaat cctatcagcg ttaatacctc ttctaattca    12840
taaagctgta tcaccgggat ggagttatac tgaatggaat gaatcctatt acatcagatt    12900
acctggggaa gagaactaca aatactatag taaatggtat ttagatttat taggagttaa    12960
agaattttac tataaaagag atagtggaga agaagtaaaa gaaaaaaata tatcatgggc    13020
ttttcaagct gaagtgaaaa gacctgaaga tgttaaccac tggaaaaacc agttgcttac    13080
taatagacct ttaacaattt tagaatataa aaaattaaag aaattagata aggaaagtga    13140
aattaggaaa caagaagatt tagaagaata caaacaatac aatagtaatt aaagaggtgg    13200
aaagcaatga taagctcatt tgatagtata ctacttgtca tatacattat tatagctttt    13260
gcagtagcta tggcaattat ctacttagta tttaaaggta tgactatttt actagataaa    13320
ctaatgatgt tattattaag taaaactaca ttagatgtag aagcttgttc tatgataatg    13380
gcagtcatca gtacaattgt gtttggaatt attgtacttt taatatggct agcagtaaac    13440
aatattttac tataaggagt tttattatgg attttaatga ttttataaac agtgaatcgg    13500
atagagtagg taatcctaaa caaaagaaga aggtagagaa taagctacct tcttctattc    13560
ctattgaaga tagagaaaag aaattaaaag agataagaaa gaaatcatta tatattgatt    13620
taaggagaaa aagaaatgac taaagaaaca aatgtacttt acaaagataa gtatagagat    13680
tatactatag ttgtaagact agcaggtaat attattgtta ctgaggtaga taagaaacat    13740
aaaacagcat ttacacctat tatatttgac aatggtgtag aaggcgtaga gcttgtaatg    13800
cgtataggtt ctgtagagct tagcatgaca gatttacgtg agttcacaaa ggaagtatct    13860
acagctcaga aagctttaga atattttaat aaaaaacttt acattaaagg cttgacagat    13920
gaagcatttt aatatatact aaaagtataa ataaaataaa gaaagagga atgattatta    13980
tgttattagg aattttatgg tttatatggg gatttgtatc gtactttgta ttgatgtttg    14040
gaattgagtt ttgtaaagat agatggatgc caggtgttat cggagcagga gccttactac    14100
tattcttatt ttggattatg aaatctatcc ataatgctat gacagtagta tacttgtatt    14160
aggaggttgt atagatggat atactaatta ttcattataa agaaacaaat aaacgagttt    14220
taaaagaaac aatacaaaca atacaaaatc atttaaatga tgaacatggt ttggttaaga    14280
tgacagcaac aaaacttagc agagagaata tagagaaaag atttaataac tataatatag    14340
```

FIG. 21I sequence.txt

| | | | | | | |
|---|---|---|---|---|---|---|
| tcattgcaga | agatgaccct | gataattcgt | atcattacag | tgaagctgta | gaagaagcag | 14400 |
| attttattat | agacatacca | atttcatatt | tagatataca | tgcaggagta | gaatgggatg | 14460 |
| ttgataatcc | tgtagatatg | ctagatagga | atccggattt | tatagaagct | gtaaataaat | 14520 |
| taaatgaaga | cttaatgtta | taaggaggaa | atagaatgct | aaatgaaaaa | ctaaaaaacc | 14580 |
| tggaagatac | aaaagtatac | atgattaata | gtattgcaag | tttactaagc | gcaagtacag | 14640 |
| gaaaatcaag | taaagtattt | tttgatgaag | gaactattaa | aattgtaagt | ggtgaaacaa | 14700 |
| aagcagtaga | agttattgat | aacttagttc | acccacactc | aggacgttta | cctattaaaa | 14760 |
| caacagaacg | tattgcgcta | ggtagattaa | cagattcttt | acagtttgtt | atttcagaaa | 14820 |
| tagaagtagt | taaagaccaa | attatagatg | aagaaaatga | agcttacatt | gattttgtga | 14880 |
| tggaagactg | ggactgggat | taatacctat | ggacttatta | actattgctt | ctgttgcttt | 14940 |
| tatagctgta | gtcattattg | atttgattaa | tgatgatatg | agctatatgc | ttactggtac | 15000 |
| tgcaatctta | ataaatattt | gggcaggatt | ttatggatgg | ttttcttac | tacaagcagg | 15060 |
| tatgttactt | ttcttactat | tagctaggaa | agttaaagat | gataaggagt | caatactata | 15120 |
| ctctagtgct | tcattaatat | gtgcactagg | aatgataata | aatcttcttt | cattttctta | 15180 |
| aaaataagta | ttgacacctt | tgtacttttg | tattatactt | agtatataac | aagtacagga | 15240 |
| gatgattaat | atgagtaaag | aaacaatcag | aagacaattt | tcaaacgcaa | ttgagattat | 15300 |
| ggcaacaact | aaggaatggt | ggaattttcc | taaaagtttt | aatacaagta | aagagtttaa | 15360 |
| aattaaaact | tttaaaaatg | acacacttgt | atttgaagtt | agggaaggta | gtagaaattt | 15420 |
| aggaagcttt | gtaattttta | caaacattga | ttttgattac | gataaactag | aaggaacttc | 15480 |
| aacacaatat | atgattaatt | actttgctaa | gaaattaact | aaagatatgt | ttaactatca | 15540 |
| taagttacaa | ttatagtagg | aggtggaaag | atgagagaag | agttaaaacc | ttttaatagg | 15600 |
| aaacaagtta | atgttaaggg | ttacttagat | gatgttaagt | attcaaagcg | tagaagacat | 15660 |
| aaaggtaatc | aacatgggtg | tgttaaaatc | acagttactg | atgtaaagat | taatggtata | 15720 |
| cctattgacc | acgttaacat | tgaagttggt | atctctttct | acgaaaaact | aaaggagctt | 15780 |
| caaggaaaga | gaattcaatt | tgtaggtact | gtttataagt | atgttaaaca | tgctagaggg | 15840 |
| cgcaaaggta | gaattaaagg | attttataaa | gaggattata | gcgtaacttt | agataagaag | 15900 |
| ttacaaaagg | aggaaaaata | atgattaaaa | gaagaaaaca | tttagaccac | tcattacagc | 15960 |
| ctgagaaagg | atggagaaca | gtacctttta | atgggtatta | tgaagcgcat | cctacgggtt | 16020 |
| taattagaaa | taaagtaacg | aaaaagttaa | ttaaaggtac | acagacaaga | aagaaccatc | 16080 |
| ctaagtggac | tgctcatgag | attgtatact | taattaaccc | taagaaaaca | agttattcta | 16140 |
| ggggagtagt | tattgcacat | acattccctg | aaatgattag | ccaatcaaga | ggagacctta | 16200 |

FIG. 21J sequence.txt

| | | | | | |
|---|---|---|---|---|---|
| agaacggtca | tgtgtgtttt | aaagatggtg | accgaagtaa | ttgtcatgta | gacaacatgt | 16260 |
| ttattggtaa | aggtaatgtt | aacaaaaata | tctataaatt | aaatgattct | tatttaacta | 16320 |
| gaaaagatat | tgaagaggat | gttaataatt | tagttaatga | aagattattc | tctcaattag | 16380 |
| aattattgat | taagaaaaat | gaaccggaaa | gaattacacc | tagtaatcac | tttattaaaa | 16440 |
| gagataataa | tgtgttcagt | atcacagatt | tatctaaaaa | ctcactagta | gagtttgagt | 16500 |
| tagaaatcaa | gaatattaag | taaggtggtt | atataaatga | atgagtggta | tgctttatgt | 16560 |
| tattacgaca | aagtaggtaa | aaagaaaata | cctaggcaaa | ttaaagctca | cagggatgta | 16620 |
| tctgtattag | aggatttaaa | agatagatta | gaagaacaaa | atcctaaaga | agaatacaag | 16680 |
| attaaaacaa | caaaagaatt | tgataaggag | agataattaa | tgttaacacc | tcaacaaaag | 16740 |
| gattcattaa | aagagcaaca | aaaaaaatta | agtaaaaaga | agaaataagt | cttgacaatt | 16800 |
| gagtatacat | aggttatact | taagttaaca | aataaagagg | aggtatgacc | tatgttattc | 16860 |
| gtaattttta | tattggcagt | actgtttgta | cttggattta | tgaatggatg | gaactcagaa | 16920 |
| gactagataa | ggagtggttg | taatgaagtt | agaagataaa | gtgttagaga | gaattgattc | 16980 |
| tcttggaaat | aaagcaggta | acttaagtaa | tcaagcaatg | gagtcattag | taaagtatca | 17040 |
| aattacgtac | ggtattatag | atattgttgt | aagtatttta | gttattgcac | taacaatatt | 17100 |
| tttaggtaag | gtttacctta | aagaatataa | gaaggttaaa | atggatttaa | aagaaagctt | 17160 |
| attgtatgat | gactacgata | ttctctcttt | acgcaatagt | tgcaggtata | ccaactgata | 17220 |
| ttatgagatt | aattaatccg | gaagtttatg | cagtaaaaga | tttaattgag | caagttaaag | 17280 |
| gaggaaattg | atatgaagca | gagagatttt | gaatttgaag | aggattttgt | attaacttac | 17340 |
| gagtgtgagg | attgtaagca | ttttgaagac | tggggtcatg | atgaagagcc | tgaagaatgt | 17400 |
| agtgaatgtg | gaagtagtga | cttaatcaat | aatacaagtc | atgaagatac | tgagtgtgat | 17460 |
| atgtgtcgag | gatatattga | tatgtggcaa | gatggatata | gatatatggg | agataataaa | 17520 |
| gagtatattg | aaaaagagga | atcaggttta | attgtgaag | attgttatga | gaaattagat | 17580 |
| atttaataag | gaggaaatta | atatgaataa | agcagtagaa | caagcaagta | atgcattagg | 17640 |
| tcaaggattt | tcagctatgg | tatggcatca | agtattagca | gggttaggg | ttatttatt | 17700 |
| aggattggta | ttatctttac | tggtttgggt | attagtaaaa | aaattccatg | tacctttta | 17760 |
| tcacccgaca | gcttttgtag | tgtactcaat | tatgttagtt | agtattgttg | ctagttttat | 17820 |
| ttggggcggt | ttacatgtaa | ttaaccctga | gtattatgct | attttagaac | ttaaaggttt | 17880 |
| tataaagtag | gaggaattct | atgactaaag | aagagttaga | gcaaaaagta | aaagaacttg | 17940 |
| aagcagagaa | taaagagctt | aaaaaacaaa | tagaacgttt | tgaagacgaa | ggaggaaaaa | 18000 |
| caaaagatga | acagtagaca | aaagaaaatt | ttaacattaa | cagtaagtaa | ctttttaatt | 18060 |
| ctagccttag | atactgtagc | actaattaga | tataaaaaag | gtaaaattaa | acaagagaat | 18120 |

FIG. 21K sequence.txt

| | | | | | | |
|---|---|---|---|---|---|---|
| tataacacag | ggcaaattac | aagaatgata | gctacaacag | ctaactcatt | aggtattctt | 18180 |
| tacttagaag | agcaagagcg | taaagaagtt | aaagatatta | aagtaggtac | ttttgaaatt | 18240 |
| ggagccttaa | aaagatttac | aaataataaa | taaaaaaagt | ttaagaaacc | tattgacatt | 18300 |
| aggtttcttt | tattatatac | taatattata | agaaataagg | aggttaactt | atgaaaggta | 18360 |
| ttatcatatt | ttacaaggaa | gagaccaaag | aggatttagg | atattttctt | gggtttataa | 18420 |
| actttaagct | agaaggatta | tcttacacaa | ctgaaggtac | tttagtagat | aatgatgtag | 18480 |
| tagttttaaa | ggataaccaa | attaatgagg | ataatttaga | gcagtttagt | atgtcaaaca | 18540 |
| ataatttagt | tattggaata | ctaggtcatt | catctctttc | agtacgcatc | tatgaaaaag | 18600 |
| gtattagaca | agagtttgat | agagtagaag | aatatttaga | ggagttgaga | caataatgat | 18660 |
| atttatatta | atttttggtt | tactatttat | tttatcttta | ctaggtattt | ttatttattt | 18720 |
| tatagttta | cgaaagaaaa | aacaattaat | agaagaaaga | gaatcatttg | gtatttataa | 18780 |
| tagaacaaaa | gaaaaactgg | gtgatgtaac | acgtttaggg | tatgaggaag | atgtatataa | 18840 |
| gttaatccat | aaccaatcta | ataaaacaat | catagaggat | aaaaagagta | aagttgtaga | 18900 |
| tacaattaaa | aagatgtatg | agctagaatt | aacgtcagta | gatgtttcta | aggtagaagg | 18960 |
| attatctcca | cttgatacag | aacctatgac | aaatatgaaa | ttactttcat | ataagctaga | 19020 |
| tagagaagga | ttatatagtt | taagtaaatt | tatttaggag | tgatacaatg | gaatttatag | 19080 |
| ataaaaataa | tgtaattaaa | gcttatgata | taccaaatgt | ttatttaaaa | ggttatgtat | 19140 |
| tacaggcatg | tgataaaaat | ggagatacaa | cagcttatga | tggttatgac | caaatacact | 19200 |
| ataaagaagg | tagagtatta | acattcccctt | ttgataaacc | attaagaaag | ataaatgtac | 19260 |
| tatcaggata | ttacaaacta | tttaaaaagg | aggacataat | atgatttatt | ttgttagtga | 19320 |
| tttacatttc | ggtcatgata | atattagaga | attcgaagca | cctacaagaa | gtcactggaa | 19380 |
| ctcagtagaa | gaaatgaatg | aaggtttaat | tgagttgtgg | aataatacaa | ttacaaataa | 19440 |
| cgatattgtt | tataacattg | gagacttctt | tttcaatatg | aaaccttcta | aagtagaaga | 19500 |
| tatacttaat | agactaaatt | ataaagagat | gatactgatt | gcaggtaacc | atgaccataa | 19560 |
| gaaacttata | aaactatatg | aacgtaatgg | tattacagta | aagtacgcag | acatgattaa | 19620 |
| aaaggatggt | aagagatttt | atctaagcca | ttatcctaca | ctaataggta | gaaaaaacat | 19680 |
| gtttaatatt | catggtcata | tacactcaca | attaatgggt | actgaatatc | acatcaatgt | 19740 |
| aggttatgat | gtagagggta | aaattgccta | tagttttgat | gatattataa | gtagagcagg | 19800 |
| tgaatataat | ggagaaattc | aaaggtaaag | atttatataa | aactagaatt | agaaaacaaa | 19860 |
| caattaaaaa | tttagttata | aaaacagaga | agctacataa | taaacacgga | aagtatagac | 19920 |
| ctattggtca | tgtttattac | tatccgaaaa | caaaagagtt | tactttatct | aagcctgaac | 19980 |

FIG. 21L

```
                                  sequence.txt
aaaagatatt tatagagtat atgaaagaat taggttttaa tgtaaaacac aggagacgta    20040
agaaaacact tattatttat aagaatgcat tcactgaata cattagtatg tatcatgaag    20100
caatagagca gattgaagga gggacataat ggaatattta tttttattta taggtattgg    20160
catgataatt tggggtttca tagcaccttg tcttgcattt gtagtttact ataaacatgt    20220
aagagaaaat cataatggat tcagtgatga ggaatctcta gaagaggcta cagtacttgg    20280
tatgggattc atgtttatag catttattcc tataggtata ctagttgtaa ttgaagaaat    20340
taagatttta ttcttttaag tgttgacaac tacaatatag tgtgttacag tataaaaaag    20400
gaggttaact aatgaagcat tttatttaa ttttagggat tgtaatccta gttattgcat     20460
tagggattgt aatcctagtt attgcattag gtattgtttt accggcatgg attttacagc    20520
tagtattatc tgcattcgga gttaaagtaa gtatttgggt atgtatcgga atatttattt    20580
taatcagtgc aataggaagt atgtttagta gaaattaaag gaggaattac aaatggcaaa    20640
atatgaatca aatattaatg gagagaatta tattgcaaca ccgtcacaag ctttaagaga    20700
agcactagca aaattaataa ctgaggaaaa gagctttgca gagtaccaaa ctaaaggtgg    20760
ggaacagtat gaatcacagt tacaactaag acactttgat gcaatgatat ctcagtatga    20820
ggaagctatt agagtactag aagataaata tagacctcag attttattc cgaaagataa     20880
taaggaggaa aattaattat gaaagcagaa tcaatagcaa gattttttaa tgacaaagta    20940
ttacaaatag aaggttataa agtaagattt ccgcaggcta gttcatctta tattttagat    21000
atagatactg tagatgaatc agtattgttt ttagacgctc aagtatctac actttcaggt    21060
aagcatttat tagatacagc tattacaatt gagagacctg aaacattaag tgctaaagag    21120
ttatatacag aaattagtaa taaactgcaa gctattgtag gagaccaaac taaaacaact    21180
atagaactat caagatattt taaggaggaa aaataagtgt ctaataaaac tattacaaat    21240
catttattaa atttaaaagg aataaacatt gaaacgtata gtattattgc tcgtatcaag    21300
aaacaaacta gttggggtga taaggagat tcttttgaaa taagcataag ttataaagct      21360
gataaagacc ctagaacagt gagatatatt acaactgaaa ttactattga ttatagtagt    21420
aataatccaa aagaaatttt attacaatta aaagataaga ttttttctat tgttgaggaa    21480
caggtagaga ctgacaatga ttttattgaa tctattaaag aaattaattc aactaaagca    21540
ttagaaaaac taaagcctta tatcaataat gaatattatt caatgtttaa atcttctatt    21600
gaaaggaaa tacctgtagc tttatcttct gaagtactca atagatgtac aggtaaaaca     21660
agcacattag cttatttagc actagaaaag gatttaccct tagtagtgtc aaatgaacct    21720
atgagaaaaa tgcttaaaaa taaattccct caccttagag tatcttctgc tgaagattat    21780
tcaaattatg atattaaagg tgaaattgta ttaatagatg aagtagatat tgaccagtta    21840
tatagtgctg ataaagtatc tgttgatgca ctattagtag gtatcattaa aaattaaata    21900
```

FIG. 21M sequence.txt

| | | | | | |
|---|---|---|---|---|---|
| aatttataaa | tacctgttga | caacaggtat | tttttatagt | atactttaga | tataaagaaa | 21960 |
| aaggaggtaa | tataatgata | cctataatag | ttatacttat | tggactcata | ttatttttat | 22020 |
| ctagtggtta | taagttggta | ttaggtaagt | actatgatga | tgtagattta | aaaatactat | 22080 |
| ttaccatatt | tggtgttggg | attgcattac | tacttggagg | atttatatta | taaaggagga | 22140 |
| aacaataaat | gaattatgaa | gaggtactaa | gaactattaa | ggaaaataaa | ccctgtaaag | 22200 |
| ttagattcac | aggaaatatt | ttagcaattg | ttaatgagga | atttaatgca | gatactgata | 22260 |
| aaggagtttt | acagcttgat | gtatcgaata | tcaacaaaga | gggctatata | agattacagc | 22320 |
| aatattgttt | agaaagagat | gactatacgg | tagtaggagc | tattttattt | taaggagagg | 22380 |
| taaatatgaa | ttatagagat | tttattacag | attgtattag | cggtggttac | aacgtacaca | 22440 |
| tcagtgttac | agaaaaaaga | gtgcacatca | tttctgagat | gacatcagca | tcttatccta | 22500 |
| aaaaggaaat | taacttagat | gaactacaag | cttatgtgta | ctatatgaat | aactttggaa | 22560 |
| gtcaaattac | aacggagggg | ttataaatgg | aattggttat | taatattgta | gcagtattgg | 22620 |
| tcggtatgta | tgctatttat | ttctatgtta | caaaatttag | tactggctta | tcaggtattt | 22680 |
| taattgtttt | agggatggct | attggtcttt | acttctactt | agactattta | aatgtcagag | 22740 |
| aaaatgttat | tcgattagtt | tcagtaatgt | ttggagcttt | cctatttagt | attgaaatga | 22800 |
| tttataataa | aattatgttc | gaaattaaaa | aaagcaatgt | tcagaagact | gttagagtgt | 22860 |
| atgataaaga | gcagtaatga | tttttaccat | aaagagtatc | taaattactt | taagtgctct | 22920 |
| ctatggtacc | ttaaaatagc | ttagaattga | aattaaggag | atgaatattt | atgtatcctg | 22980 |
| aaatagatgt | agaaaaatta | gcgtacaagc | taaaaagtac | gagagaatat | ttagaaagca | 23040 |
| ttaaaataaa | agaagtagaa | atttatgaaa | tctatcatct | taaaacaggt | aagttagttt | 23100 |
| ttaaaggtga | atatattgaa | gtaaaagaat | tactgaggaa | aatgtataaa | gagaatttaa | 23160 |
| cacttgtaga | tgtagataca | atgttaagta | ttggtaaagg | atttattgat | gtaattaaga | 23220 |
| atatatcagc | agaaaatgta | ttccaaataa | catataaaaa | ggagctctca | acaaaatgat | 23280 |
| taaaatattt | tcagaagtag | ataaagaata | caaacccatt | attactgaaa | agtttcctaa | 23340 |
| tggtgagatt | aattttaaat | acgatgattt | aaagtattta | gtagaagaga | acttaagatt | 23400 |
| tgatgttttc | tttaaatggg | aaaatgacgc | agatttaatg | catttgtata | tgtttactaa | 23460 |
| gtatttagag | caactaggta | ttaaagataa | agctgaattt | ttagagattg | catatctacc | 23520 |
| ttatagcaga | atggatagag | tagaagaagg | gcataataat | atgttcagtc | ttaaatacat | 23580 |
| tacagaattt | attaataacc | ttaattataa | atcggtatgg | gtagtagaac | ctcatagtcc | 23640 |
| tgtaacagaa | gaattactta | ctaattctgt | tgctattgat | gttacactta | aattattaaa | 23700 |
| tcagtatatt | gaaatgtccg | aagagcctgt | aacaatagta | ctacctgata | aagggcata | 23760 |

FIG. 21N sequence.txt

```
cgatagatat ctatttgatg tagaacgtat cttaatggaa tctaatattg aatcatattc      23820
aattgtatat ggtgagaaga aacgagattt tgaaacaggt aagattaaag gtattaaaat      23880
aattaaagat aaaaatactt tatatgataa ttgtattata ctagatgact taacaagtta      23940
cggcgggaca tttgtaggtt gtaaaaaagc ccttgacaaa cttaaggtaa gtagtgtatc      24000
attaatattg actcatgcag aacgagcttt tgcagaagga gcattactta gctcaggatt      24060
taaagatatt attgtaacag actctatgtt ccctaaaaat aattgggaaa aagctattgc      24120
taaacataga gctagaatca acggaactga attacaaata aaagatatcg aaagatattt      24180
ataaaaggag aaaaacaaat tatgctaaac ccaactttaa tgtgtgactt ctataaacta      24240
agtcacagag aacaatatcc tgaaggtaca gaaattgtat atagtacatt agtacctaga      24300
agtaataaat attatgaaca cagtgataat attgtagtat tcggtattca atcacttgtt      24360
aaaaaatatt ttattgatat gtttaataaa gagttctttta acagacctaa agaggaagtt      24420
attaatgaat acaaacgtac agttaaattt acactaggac aagaaaatcc tgatgctaaa      24480
cacttagaac aattacatga cttaggttat ttacctattg atgtaagagc tttaaaagaa      24540
ggtactgttg ttcatcctaa cacacctgtt atgacaattg aaaatactca ctcagatttc      24600
ttttggttaa ctaattactt agaaacgatt attagtactc aaacatggca agcaatgact      24660
agtgctacac tagcatatga tatgcgtaaa atgctagata aatatgcaat ggaaacagta      24720
ggtaatattg aagcagtgga tttccagggt catgacttca gtatgcgtgg tatgagttct      24780
ttagaaacag ctcaattaag ttcagcaggt catgcaatta gttttaaagg cagtgataca      24840
gtacctgtag tggatttctt agaatcatat tacaatgcag acgtagagaa ggaaatggtt      24900
gttgcttcta tccctgctac tgagcactca gtaatgtgcg caaatggtaa ttatgaaacc      24960
atggatgagt atgaaacata taacgtatg ttaacagaaa tatatccaac aggaattttc      25020
tctattgtat ctgatacttg ggactttggg ggtaatatga ctaaaacttt acctagatta      25080
aaggatatta ttatggaacg tgatggtaaa gtagtaatca gacctgatag tggagaccct      25140
gttaaaatta tttgcggaga ccctgatgca gatactgaat atgaacgtaa aggtgcagta      25200
gaagtacttt gggatacctt tggaggtact gaaactgaaa aagggtacaa agtattagat      25260
gaacatgtag gattaattta cggagactct attaactatg aacgtgctca acaaatttgt      25320
gaaggattaa aagaaaaagg ttttgcaagt attaatgttg tattaggtgt aggtagtttc      25380
tcttaccaat ttaatactcg tgatactcac gggtttgcaa tcaaagcaac gtatgctaag      25440
attaaaaatg aagaaaaact tatctataaa aatcctaaaa cagatagtgg taaacgttca      25500
cataaaggtc gagtagctgt atataaagac ggttcatggg aagataactt aaccttacat      25560
caatggctaa acaaacaaaa tgttaatcaa ttagaaagag tatttgaaga tggtaagctt      25620
tatagagacc agtcgttaag tgaaattaga gaataatta aaataatta ataaatattt      25680
```

FIG. 210 sequence.txt

| | | | | | |
|---|---|---|---|---|---|
| aaactcccta | ttgacaaagg | gagtttttta | ttatatagta | gggttatagt | aaataaagga | 25740 |
| gtgaaagaaa | tgatttataa | aatatcaaaa | cataattact | atagtaggtt | tgaatattca | 25800 |
| tcttatttac | ctgatgaagg | atttgcatac | atagattatg | tagatgtcat | tcttataggt | 25860 |
| gtagataatc | cgaggaagag | aaaagttatt | actttaaaag | cagatgagtt | taatcctagt | 25920 |
| gattttaagg | ttggtcataa | atataatatt | ataaaaatac | tatggtttga | gaaatgggaa | 25980 |
| tggttacagc | catagggagg | agaggtatac | aatgattata | gataaattaa | atggagttaa | 26040 |
| attagagatt | ggcggtcatg | ttgtatcatt | tagtgtaagc | aaatttaaaa | cgattaatgg | 26100 |
| tgagagacaa | ttacttgatt | accaccatat | caaaagacgt | aaacagaaat | attttagaac | 26160 |
| tactgaagaa | ttctataatg | agtacaaaga | aataaaaccc | gataagaatg | aaatagatga | 26220 |
| aatgtttgaa | tctttaggtt | atgtagatac | taaactagaa | gatgtagtaa | gaaaccaaga | 26280 |
| gaaagtgaca | gagatattag | gagttagtga | acaatactta | aaccaattgt | cttataaggc | 26340 |
| tatagaggaa | tatgtagaca | aaatagttac | cttagaaatt | aaagaattaa | aaggagaaaa | 26400 |
| atagtatgag | taatagttgg | gaaaaagaag | gagttaacta | ctgggaaaat | gaagattgcc | 26460 |
| ctagagaata | cttagagaaa | gcatttatag | aattagttga | atacgtagaa | ggtgttacag | 26520 |
| taccatctag | agatgttcag | cagttgagag | aggataagct | tagagaagat | attggatttt | 26580 |
| atgagtatgt | agcagataaa | taaatacaca | tctacctatt | gacttaggta | gatacttatt | 26640 |
| atataatagt | atacaaggag | atgaagtatg | atgaatggaa | aacaaattta | tgtattttta | 26700 |
| agtgaccagt | atagtaaaga | tatactcagt | ttacaattag | gacttattaa | ggaatggtct | 26760 |
| agaagagaac | taacttattc | agatgatgtc | gggtcagatg | cagatgttgt | tatttgtact | 26820 |
| gatatagtaa | gagatgattt | cgtaaaaaaa | ctaagtaaaa | ataatagcaa | tgcattattt | 26880 |
| gtgtttatta | gttctttttta | ttggataggt | tataaaggcg | gagaattttt | tgttgcagtt | 26940 |
| caagactatg | tgaaaggtat | gtaagatatg | aaaaaattat | taatattatt | tacattagct | 27000 |
| agtactttac | tattagcagg | atgtacaccg | gataatcatg | aaggaaaagt | tttaggaaca | 27060 |
| ggagaatata | gagagccaac | tacttatatc | aagtcaggaa | gtgttactgt | accagttatt | 27120 |
| ggtgaaatga | aatactatgt | agatttagaa | acagataaag | gtgaagaccg | tgtttatctt | 27180 |
| aatagagaag | tttatcataa | atttgataaa | ggtgatgatt | tctctaatgt | aggtaaaaaa | 27240 |
| gtatataaaa | atgatgaatt | aatatataaa | ggggactaat | tagtatgaaa | caatttatac | 27300 |
| atgataaaaa | agatagttat | aatagtacaa | atcgtaattt | tgatattcaa | tattataaag | 27360 |
| gtataccttt | acaacaaatt | gataggggat | atggtcaagc | aagagctagg | agatttacaa | 27420 |
| taaataatac | gaaccaaaat | atatggatac | ctatgacata | tttaaaacct | aatggtactc | 27480 |
| ttaaaaataa | cattgatata | gattggatac | ttgttaaaga | aaaatgtagt | ttaaagaaag | 27540 |

FIG. 21P

```
                                        sequence.txt
caggattagt aataaaaata aaaattacag gagatgtatt ataatgtata tattagaaag    27600
aacaattaga ggttttgccg gtcaaacaga agatatttta ccttattact ttaaaagtaa   27660
gaaagaaatt gttaattttt taaaactaat ggagttcctt aaagaagaaa caaattattg   27720
ggttaaaaag aacggtaatt atactattat aatcagggct aaaaggatat tatacattga   27780
agaacatata cagaagttaa aggagtggga gaatgactta tgatgtttat gtattatata   27840
aaagaggaga acctattgca caaggtagta tggaacattg cttagatgtc tattattggg   27900
aaagggtaca cggttatagt aataaaggtt atgaactatt acctatggga tatgaacagg   27960
aggaataact aatgataaat atagaacatg attatacaat aagaactgta gataatagaa   28020
agtatactta ctatagtaaa catgaatctc cagttacttt atataaaaat attataggta   28080
aagattgtat tgaagtaact aaatacggga aagataaaaa agttattata gctactaaat   28140
atattgtatc tattgaacga tggtaaataa ggaggtataa ctaatgaatg ctaggaaagc   28200
acgtaagaac actaaaaact ataaggactc taatgtagta actaaagagc aacacctaac   28260
ttatatttat aataagttaa actacttgat tgcaaataat agtagtcagg gtaaaacata   28320
tgtggtaatg aacctaagaa cagattatcc tgatgagttt tctttatcta aattaaaata   28380
tctaaaagaa attaaacagc actataaaga cctagtattt aatgtgaaaa cgcaagtaag   28440
gaaggcacag tggtcagaga aaagtataat caggtactac tttaacctag gctatataga   28500
cagcgtgtta gtacctatta tacacattag ttggtaatta caaggagagg tagttatgtt   28560
ttttaaaaaa aagaagttaa gcaatgtaga gaaacaaata agacaaaacc gtaataaaga   28620
agacaaagaa agaaaagaac atcaagataa gttagataca gatatgtata aacatatga    28680
attagataaa attgtagaag aacatttaag aaagttaaac actatatccc ttgaagaatt   28740
ataattaact tcagtgtgtt tagggacaag acttgtttat tattactcaa taggtaagga   28800
ttggaataaa caagtatata gtttaaacga attagaatat atgaagaaga aatttaagaa   28860
attaggattt gaaactcaga taacaaacga agatataggg tttcaacctt atatttattt   28920
aagattatta tgggatgcat aagtaattat tattaaagga gggatagttg gtgctgtacc   28980
tctaatgact attattattg cacagttaat tacagattat catgatagac attaagtatt   29040
gaatactgtt gactaataag gaggatatat taagaagtta aagttacctg gtaatattgt   29100
tgactagcaa gaagaagaaa atattattac tattaagtac ctgggaaaac ttttacctct   29160
ctcactcagc ctattactta ctaccgactt ccctaactac ttattctata gttataatat   29220
tcatttatta tacaatggta aactatagta ttccacctgt aaactatgct gaagcggtag   29280
taatctattg ttattatata ataatcttat ataatggtac gttaatctag tatattacat   29340
tagaatgatt ctaatctagg attttaatct ttagacccta ggaaaagtgg tactaaaata   29400
taaaacccta taggtatggg attcttatt ttaaaattac taaaaagtat taggttttcc    29460
```

FIG. 21Q sequence.txt

| | | | | | |
|---|---|---|---|---|---|
| ctagggcaaa | gttttaatgt | acctaaaata | gtaagtagct | ccttatcatt | tagggttcta | 29520 |
| taattgagaa | tattgaaagc | taatccgctt | caattgtaat | taattgttga | caactatgaa | 29580 |
| gtgggtatgt | tatacttagt | atataaaata | ataggaggaa | ttaataatga | atctgacatt | 29640 |
| tgaagataag | ttagaagact | tactaaaaaa | ggtacgtagt | ggtgagatag | aacctatcga | 29700 |
| gtactctcaa | gttaatgatg | agcaccctaa | tggtaaaact | acttgtggcg | ttacttttaa | 29760 |
| gtttgatatc | gacacaccaa | ctaaatagga | atatgaagcg | gttaattccg | cttctcttac | 29820 |
| ttagagtata | taagtaactg | tatattgtaa | gtaggagtaa | tcaaatttag | gagatgagat | 29880 |
| agatgataat | attatttacg | caggattatg | ataaaaccct | aatgaaagtg | atattagggg | 29940 |
| atattaatac | tatgagacct | aattggaagt | acagtgttaa | ccatcctgag | aaagaagagg | 30000 |
| atgttcatat | acaagcttat | gaaggggaag | atatatttga | tgatatagag | gagttatcag | 30060 |
| atagtacaca | ggatatagtt | ataggtgtta | ctgaagatga | ttgtatatca | gagtctcctt | 30120 |
| atgactttaa | tggtgggctt | agattagtca | ctaaacatat | taaggaacat | atagagaaat | 30180 |
| tcttataggg | agtgataata | tgattgatat | atacttagga | gaaggttata | ataagaata | 30240 |
| cttgtctaag | gcactcagat | taatcaatga | ccatgctcct | agggagttaa | gttatgattt | 30300 |
| taataatgta | gaagcggatg | ttaatattca | cacgatgtta | tatgttaaac | ctgaagatag | 30360 |
| gtatgtctat | aaggatatat | cttatgactt | cccgggtgat | ttaattattt | gtatagttga | 30420 |
| agatgatgct | attgtgtatc | accaaggtaa | acaggtttca | ggtattagta | ttttaagaat | 30480 |
| aatagaagag | ctcatttaag | aagcagttaa | gtaaaaaagg | ataaattgta | ctagaaaatg | 30540 |
| tataccgctt | ctgtatggaa | ggctgagagg | gcttagaatt | gaaaggggag | atataatgat | 30600 |
| agagatatac | cttagtgaaa | attatgataa | ggatttatta | aaagcggaat | taaaatggat | 30660 |
| taaggagacc | gcttcaagag | aactaactta | tgatgttaat | aggaatccta | acttagatgt | 30720 |
| acatgttagc | ccatttagat | atactaaaga | tgaagtaaaa | gaaataagtt | tacatcctca | 30780 |
| atttgaagac | gatgtatgtg | tatttatagc | ggagacgtgg | atacatgaat | accatagagg | 30840 |
| taaatcaata | ggcgtagata | gtatggaaga | atatgtaaag | gagatgtaag | tatgtttaaa | 30900 |
| gtatattaca | cagtctacca | taaaggtagt | atgaaaacaa | ttaaagataa | gctagataga | 30960 |
| agtagtttaa | tatacttctt | gtatgatact | tggtataaag | atattagtaa | tgtattccct | 31020 |
| aatcactata | ataaagagtt | tggaagtaat | agtgatgata | tagacataga | taaacttatt | 31080 |
| gaagcggtta | atgaggaggg | tatattactt | atcaatagag | gtaattatgt | tacaataaga | 31140 |
| gaatggtagg | ataggataaa | cttaggatag | aaaataattt | aggatgagtt | acgataggat | 31200 |
| aggatacgat | aggataggat | acgataggat | aggatacgat | aggataggat | aggggttaa | 31260 |
| gttaggatgg | ttactttaac | atacactatt | attcataaag | aatctgatag | ggtaatagct | 31320 |

FIG. 21R sequence.txt

| | | | | | | |
|---|---|---|---|---|---|---|
| agtggtttag | atgagttaga | ggttataaac | ttagttcaaa | ggatggtaaa | tactaatcta | 31380 |
| gttactgata | tatcattaga | tgattatata | cgcagaccaa | gtggagatat | agatgtactc | 31440 |
| aatttactag | tagatattag | aagacaaggc | gtatttgatt | tcaatcacac | ttggcacgta | 31500 |
| ggataggagg | gataggatga | tagttatata | tacagatgtt | tctaaggatt | atttaaaaga | 31560 |
| cgagttctta | ccttggctta | atgaaaggga | tagatactta | gaagactata | aagatgaatt | 31620 |
| acctgaggat | atagattcct | cttatattgt | atcagttgta | tactgtaagg | atatggaagg | 31680 |
| tctattagaa | agaaaagaca | ttgttattgg | taatagctat | aatgaacctg | tagctttatt | 31740 |
| aggtgttcct | gagtttttg | gtaattatag | taattatttc | tactatagag | gagaaagtat | 31800 |
| tagtaaacat | gacctaggag | aaattgttag | gttaaaagct | tggcaacgta | tgggcggaga | 31860 |
| ttgactaagt | agctctccct | aatttcacta | agtagctccc | taggaattgc | ctaagtagct | 31920 |
| cggtatgatt | ttaccctaag | tagctccctc | tgttttctac | tagtttattt | taaccgcttc | 31980 |
| aggtgtctat | atatagacgg | ttggaataat | agcagaccgc | aaaaataaat | acactaggat | 32040 |
| attattccca | gtgtattata | taatttttt | atttaaatct | ttttatattt | ctatttattg | 32100 |
| ttattctact | tacattatac | atatttgata | attcttcttg | tgtaaaacct | ttttcagtat | 32160 |
| ataatttata | aatatttttt | ctttcattat | ctgttaatga | tttaccacgt | ttaaaattgt | 32220 |
| ttattgtttc | atctttatga | tgtaaattat | tatgttctgt | agggctaata | cattgtaaat | 32280 |
| tatttatatg | gttattttgt | ttattgccat | ctatatggtg | tatatgataa | tcttgattaa | 32340 |
| aatcattgcc | aaaatattca | tatactaaac | gatgtataga | atgatgttta | taattaattt | 32400 |
| taactatttt | atagccttgc | ttatgattat | gaggttttac | taactttca | atcatataat | 32460 |
| aattaccgtg | tcttttatt | ctaccatagt | tagatactga | ataattaaat | atattattaa | 32520 |
| tattatttc | tatgcgtttc | catttctcat | taggtaaatt | attaatacta | ttataatctt | 32580 |
| ttaaattgta | ttgtaataaa | gtatcaattt | taacttttct | tgccttgttt | atatcatctg | 32640 |
| tcatacgata | aaagttattt | ttatcttttt | ttaattcctt | atttgttttc | tttgaatata | 32700 |
| ctttgttttc | ttttatatag | tatttgaaa | acatttcaat | gttatttata | ttatgtttca | 32760 |
| tcttctcaac | tccttaacta | tattctacta | tataataggt | aatttgtcaa | gttaaaaaag | 32820 |
| tttttaaaaa | cctattgact | tattactttt | tagggtgtaa | tatagatact | gtaataaata | 32880 |
| acacgaaggg | aattgatgaa | aatggaaatc | aaagaaattg | ccgatacaat | tatgtattta | 32940 |
| tttaatatgg | atggttacag | atgtgcagaa | cctccattat | atgaaagcac | actaaaccac | 33000 |
| acacgcacac | acacggcgtt | aattgtttct | attaagggaa | actatgacac | agtgcagatg | 33060 |
| ttccgcaaaa | cgcctataat | gagcatgaga | gggcaaagcc | aaccggctag | tatgttagta | 33120 |
| aatgtaattg | atgatgtaat | tataatagta | tatgaaaatg | tagtgtacgg | agttcaaaac | 33180 |
| aaagaaataa | aattcattga | agaaatttaa | aaatagggt | tgcaatcctc | aagcatctat | 33240 |

FIG. 21S sequence.txt

| | | | | | | |
|---|---|---|---|---|---|---|
| agtaatataa | taggtgtagg | ggatagcaac | acacctcaaa | aaaactttt | aaaaagtta | 33300 |
| aagaaaagtg | ttgacacctt | ataagataca | tgttattatt | aagataacaa | ataagacaag | 33360 |
| ccacttagca | aataacgaaa | ttaaataaaa | aaattataga | ataggatttg | attattatga | 33420 |
| caaacaaaaa | ttacttatac | gaagaaactc | acacagtaca | agggcaagac | attacggctt | 33480 |
| tcagaattcc | aaacgacaca | aacggcaacc | cacgttatgt | agtgcatttc | atggatttaa | 33540 |
| atattaaact | agcagactat | gacaacatca | ataaactata | cggatttaat | aaatatcgtg | 33600 |
| ctaaatggtt | tggcggtggt | gtagtattcc | aaagctataa | tatagaagat | acattaaatt | 33660 |
| ttgcactaga | taaagttaaa | gaaatagaag | cggttaagaa | ttaaaaccgc | ttctgaatta | 33720 |
| aataaaaaaa | ttatataaaa | aggatatgat | aatatgatat | tagaaataga | aactaaacca | 33780 |
| gttaaaacat | tgaaagcaat | taaagacgat | acaaaaaata | ttaaaaatag | tatagcagaa | 33840 |
| catttaggat | taaatagaga | acaatttaaa | ttatcaaatg | gtttaataac | tttaaaaggt | 33900 |
| tattcagaag | aatttaaatg | ttggtataat | ttaactagca | caattggtaa | ttttcctaaa | 33960 |
| tatttaaaat | cagaattata | taatgaatat | aaattatatt | gtaatgtaga | attaaaaact | 34020 |
| aaataaatta | aataaaaaaa | ttatacaatt | ccctaggatt | agatttctag | ggatttttat | 34080 |
| ttatttaat | ttatataaaa | aatttattta | ttaaataaat | tagtgtaaaa | ttgactattg | 34140 |
| acaaggttgt | attttttatg | gtataatgaa | gtgaagacct | ttttagtat | aaaaaaatta | 34200 |
| ttatataaaa | aatttatatt | aaatgatttt | agaaccgctc | tttctcgtta | cctcgtcatt | 34260 |
| tatatagcgc | aagggatagg | caacttagcg | ctttgtttta | ctttctatat | atagtatact | 34320 |
| atgaataatg | gtaattgtca | acacctttca | gaaactttt | ttactttctt | ttattattat | 34380 |
| ataaaaaaat | tatacatatt | ttatggctcc | acttccatta | tataataatt | cagtcttaat | 34440 |
| gtcaatagat | aaatgtaaaa | aagttttta | aattaatttc | attaaatcta | ttgacttgtg | 34500 |
| tttctttcta | tagtaatata | taggtatacc | aacaagggag | gcaatacaaa | tgctaaaatt | 34560 |
| caaatggaaa | aacaaaacaa | ttaaatcaac | tcaaaaaacg | gataacattc | tattacttat | 34620 |
| tataggtggt | ttagttgcaa | caatcacacc | taaacttgta | aactggtttt | tactactaca | 34680 |
| agataatata | aatattttt | taagataact | attgacaacc | tagaaacaac | atgttaatat | 34740 |
| taagatacaa | ggtaagggaa | gcggttgacc | gcttccaacc | taaataaaaa | aagtttaaaa | 34800 |
| aaactattga | cagtcacttg | aaaccatgat | attattaaga | taacaaaaaa | caaacagaaa | 34860 |
| aggaattgat | gaaaatgttc | aaattacaaa | ataaagtgga | aattatcgta | cctaaggaag | 34920 |
| ataacaacgg | cgttgagatt | gcagacaaac | gtattaaaga | atatgtaaac | agtatcacaa | 34980 |
| tggaagcggg | cggttgcact | attacagaaa | ttaaggggca | atggtattca | gaagatgaaa | 35040 |
| agcgtatcat | ggaagataac | aacttaaatc | ttgaatggta | ctacattcca | gaccgtgcaa | 35100 |

FIG. 21T

```
                                 sequence.txt
aattcatgac agttgaatta aaaggcattg taagacgttt aattgaagtt tacggacaag    35160
aggcaatcag tattaaagtt aatggcacat tgtacattgt agaccaatca gacattgaag    35220
aattacacac aacattatta aatatcatga aataaaaaat ttatataaac cgcttcggat    35280
taaattcttg aagcggtttt tttatgtaaa atttatgctt gacaaatgta ttaaaaaatg    35340
agataataga gtgacgactt ttttagtat aaaaataata ttatataaaa aagttataga    35400
gtttttaagg ctccaagtcc attatatcaa ttttgctact ggttgtcaat actttctttt    35460
tttatataat aatttaatta tcttaaagat accgtccact tccattatct caaattttcc    35520
cccaaagtca agaactttct ttcaaataat ttatttaaaa aagtttacaa aaagggttga    35580
cttatttgt actatagtgt aatatataaa gtgtagtaag gaagcggagg aaataaccta    35640
aaaaaagaat ttaaaaaaac tttaaaaag gtgttgacaa acttccaaat acatgataat    35700
attaagatag ttaaaaaaac aaaaaaacga aaaggaattg ataattatga acagattaga    35760
aatagtaaaa gatacggcaa tggaatatat ccttatgatg gataacagtg ttatggacgg    35820
agttatgaca caagaggaat acaacgaagc ggttagctt gaaaaggtgt atgactacac    35880
tctatcagaa gcaaataaag aatgtaaatt cttaggcggt aaagttttaa ctttcctagt    35940
acatgaagca atcgaagaat acgcataaaa aaacttaata aaaggggttg acattcaacc    36000
cctaccatgt taatattaat atataccaaa tgagaggaat tgataattat gagatacgaa    36060
attgtaacgc tagttaatca agaattgttt atgtatgcaa cattcaacaa gcaggaagca    36120
gaagcaaaat atagtgaatg gtgtgaactg tacggtcaag aaaatgtaag catggaaaaa    36180
aattaaaata agctgttgac aaactaaccg cttcatgata atattaaact atactaaaga    36240
aaaggaaatg atacaaatga attattaaa ccaagaaaac caaatcgtaa ttagcatagc    36300
aacattagag agtgtcaaac aagccctaat ttgggaatac atcgaccaca tagattataa    36360
catctggaac aatgaacttg atgacacaga agcggttgta aaaatttctg gtattcttca    36420
atcaatcaaa tttgcagaca ctatggaaga cctgcaggaa tatattgggg atattggttg    36480
gaaattaatt taaagaatt tcaaataact gttgacacct tagcagatag atggtaacat    36540
tagggtagtt aaaaaatact aaatgaaaag gatttgattt attatgaaaa aaaatgttaa    36600
agcaagcact attgaatggt tagaattgac tcaagggcat ggggagtttg atggtttcga    36660
tgaagaagat atggacttca gaaaactaga tgatgaagat attaaatggt attttgaaaa    36720
ttggtacttt acagaggaaa aacaagaaca gattatagac gaaataggtc aagaggaatt    36780
tgaagaagcc tattcagatg atattaaaga atacaacaat taatacagga agcacacaga    36840
gacacacaga gaagcttaac cgcttctcta atattaaact attaggagat gtttataatg    36900
acaaaattta aattgattga taaaaatagc ttttacgtaa atgacaatta caataacgaa    36960
acttatttaa cttctcaaat tgttctatca ggtgaagcgg gtagattgtt agatgatatg    37020
```

FIG. 21U sequence.txt

| | | | | | | |
|---|---|---|---|---|---|---|
| atagaagatt | gtgaagacga | acacgacaaa | gacaattaca | agaaactaga | cactaacaat | 37080 |
| attgatgata | ttgattatat | attggaatgt | gctaacgttt | atatttaccc | ttacaataaa | 37140 |
| acggaattta | aatattaaaa | taggagatgt | tgaatatgaa | cacaagacgg | gcaaataaag | 37200 |
| cgttaaacga | agcggttaga | ttattagata | agcaaataga | agacacacag | aagaccatgc | 37260 |
| aggagctaaa | caaacaacta | gaacaacaaa | taaaagctaa | acaggaacta | atgacactag | 37320 |
| ttgacgttat | gactggtgat | gatgagtaat | gaacattaaa | gaagctcaca | aggtcgttag | 37380 |
| gagtgcaaag | agcaaactcc | tgcaggagca | ggagcacata | acaaaccata | tcatagagga | 37440 |
| ctacatcata | gaggagcttc | acagacgcac | acagggaagc | ggaacaatac | agatgaacaa | 37500 |
| taacaccgct | tcatatagca | atggctcata | tggtagctta | gaagagctta | gagaagctta | 37560 |
| tgacctatcg | tcattatcta | ctggtgagat | taaagaattg | cttgaaacat | ttgtttaaat | 37620 |
| ttatttaaaa | aagtttagtc | aaaactattg | caatatcttc | agaatactgt | ataatagtac | 37680 |
| ttgtaagata | aataaaacaa | agaaaaggaa | tgattaatta | tgaaagaaca | aatcaaacaa | 37740 |
| tttgagaaag | aattagaaat | ggcggtaaat | aacttattcg | tattacatga | ttgtggcgta | 37800 |
| tcacaagcaa | agattgaaga | acaaaaccaa | aaagttgtgt | accttaaagc | tatcgttgag | 37860 |
| aacatgaaag | cctacgaaga | aatcagagtt | gagccaaaga | gtgaagagca | atttttcaaa | 37920 |
| gaacttgaag | aagaacttga | agaagaagaa | aaaattttaa | aaggaattta | agaggagggc | 37980 |
| aaacgccctt | ctttattttt | atcctattat | ataattttt | tatattatac | ggggcaggg | 38040 |
| gtaaaatgcc | actcaatggg | ggtgggtcta | tataccccta | cggtctaccc | aggtacttat | 38100 |
| tttttggagg | aaattatgaa | aataaatatt | taaaagtcaa | caccctatat | gataagtcaa | 38160 |
| cattataacc | ctaccctgta | agtcaacaat | ttatagtata | aataagaagc | ccttaaatat | 38220 |
| aaagtcaaca | tatctaaaat | aaaaaagag | aaagaatatt | attcttcctc | tgaggtatta | 38280 |
| ttaataactt | ctaattcatg | aatagtaatc | atatcttctc | taaataatgg | tacatcttct | 38340 |
| atattatctt | tataatagta | agtatacccg | tcttgaaggt | atccgcttat | tttttcttca | 38400 |
| tagccttctg | ctttaatacg | tttaattaag | ttctccttat | ttgtgtaaac | tttatcttct | 38460 |
| ctgtaagaat | agttatcttc | atagggttca | caattatcgt | gttctacttg | atatagtttc | 38520 |
| atattagtta | tcctcccttt | cataagacca | ttcaccgtat | tctgcactaa | agtgggctgt | 38580 |
| gtctgtaccc | tcatcttcat | attctacact | ataccatgca | tcttcttctg | tttctgcatc | 38640 |
| tatatatctt | acttcttctg | tagtaataat | acgttttacc | ttaaatctct | ccatttgttt | 38700 |
| ttcctccttt | atattttcct | ctagtatttg | ttttaatgtt | tggcagtctt | tttggtctag | 38760 |
| agtatcccaa | ctctctagat | tttgtaattg | ataaagtaac | tcatttacaa | tttcatcgaa | 38820 |
| ggcttctgct | tttctatata | cttcttctag | ttctgtttct | gctaattttc | tatccccttt | 38880 |

FIG. 21V sequence.txt

```
aatttgttct gctttagtta ctaagatatg ggctttattc atttcctcta taataaagtt    38940
tttatagttt tccattatta tttatccctt ctattttcta tccgttgttt tatctcttcc    39000
ctattgcggt ggtgctcctt actcatttct ttacgttcct tatttgttaa ccttattcta    39060
taaacaaggt aattaatgta tagggtgccg gctgaccata gtagcaagaa tgttattaga    39120
taagtccatg agatactaat ttctatcatt gtgattcctc cttatctatt gtaaaggatt    39180
tacctgttct agagaatagt ttaaacattt cttcttcaaa atgcccatca ctcatatctt    39240
tatctttcag catttcacag agtttgtccc atgcttctgc tttattataa attgtttcta    39300
cttctctatc tgtttcatca ctataatttt catatataat ttgtaataca aaatccttct    39360
catcgtaaca tttttcatta atatcatatc tcattataat tcctccttat attctttata    39420
gctcttgatg gctatttac aaatacctct atttacagca acaaatacta taaatgataa    39480
tagtgttata actgctctta catctcctgt aaaaggtaat aattggaaga gcaaatagct    39540
ttctaaaaca ctaatagctg taatggtagt tagatataat atagatagta agtaatcctt    39600
taattttagt ttaacaaatg gttttttgtg ctcatctgtt cttacaatac cataaagtat    39660
tataaaccac ataacaggta ctaactgtat aataaaatca ttatctatat tcaatgcatg    39720
tagagcgtaa ataataactg caggaatacc tataatgaat gctaggaata cagaaaatat    39780
aattaacatt atagggaggg ctacaagaaa acctagcccc tgttttgaat actctaatgt    39840
gttttaccct aggaacttaa aaaatgtttt attcatcttc ttcctccctg gaattacttt    39900
ctgtaattgt aatttctaac atattattgt aataatcatt cttttgattg atattatagt    39960
tatcattgta ttcattaaag tctacataaa tatattcatt tgcgtcattt tcataaataa    40020
tatctatagc tgtaatatct gaatatgctg taatcatttc ataagcgttc gtattatcag    40080
gataagcaaa accaacttga ggtatttcca taggcttatc aataagaata ccaaaataag    40140
tacagtgacg tgttcggctt atatttgaag tctctttata tgtaccgtag taatctatac    40200
cttctgtaat acctgatata tggaacctgc ttacgtcttt agattctaat cttacaacat    40260
cgcaattttc taatactaaa tcaatatatt tgatattcat tttaactctc cttttatatt    40320
aataattctt tccattcttt atcaaccttt ttaagttctt ttttattata gtctccatct    40380
ttagttacta cagtgttcca ttgaaacttc tgtaataagc taaaattatt tataatccat    40440
atattacttt tactataata catattatct tcaaatctta tatctttttc tataaaatat    40500
ttatatattt tatatcttct ttcatctgca cctgatattt taataatttc attagtatttt   40560
aattgagtgg ataactggaa gataacatct tttactttca ataggtcttt aacattacct    40620
ctacctacat ggtcattata ataatcgtac ttaactttt tcttttgttt tctatcatta    40680
actacaatga atatattata tacgatataa gctttaaaat gggtataggt agtaggtgct    40740
tctgaatcat cacattcttt tcttaggtct gtacattgta tttttaacat aatattattt    40800
```

FIG. 21W sequence.txt

```
gatatgttga ctacggtaga accatcatgt tttttattga gatttatctt atccatttta    40860
taattaccta cttattgtag atacaatgta ctcgaacatc ttccattact ttgcctaata    40920
gattctgacc tttccagtta ctttgctcta atattttagg gtcatttgct ttaagaccta    40980
ctccccatat tttatcataa ggtgaagctt ctacgaaatc tttacgtaca tctgtgtcta    41040
atattctttg ctttaggtgt gtagtcataa atttatcttt aactacttct accataatat    41100
catatcttac tttattccat tgctcttcat taaaattacg aactttacga cctaaacttt    41160
tagcatggtt tggattctta gcatttagta tttcacctgc tatttgaaag tcattaaagt    41220
atcttgcttt acgccacata aaggcttgct ctgagttatt aaatgttctt ccttgatgtt    41280
taaactttat agggtagaag ttagaataaa tatcctcttt accccaaaac ataatatatt    41340
cacttgtttc tctcataata tttctccttt aattccatag tgatggtaat acaatnttaa    41400
aattatctaa tattttactt tgtacctgtt caagctcatc atatttatcc atatcaaaat    41460
catccatttc tttatgataa tattttatta agcttaaaat atgttttatc atatctattt    41520
gtgttctttc tttgccgtct acatctacaa aagtatggta ttccatatcc acatggttac    41580
tactctctac aaatgcgttt aagtcagcgt ataactggat aaagaaggac atgtcataat    41640
tccaatactt aggctcattt ctacctagtt ttttcttcat tttcttatat tttttattct    41700
tttttagtcc aaaaacttct ttttcaaagt catttaattt aagacctttta aaatattttt    41760
tcttcatttc ttaacctcca atttaataaa tggaaaatca atgtttctaa atactgcgcc    41820
gacatcacac attaatatgt ctccattaat ttctacttct ccactgtcag ttggtgtatg    41880
accacataca taggtaaaac catcttttct aggttgaaaa tctcttgacc atattaattg    41940
gtcaattgtt tgttcttcta caggcttcca actaaccccca cctgaatgag agaatatata    42000
cttgtcttct ttatagtact ttctacaatt aaccataagt attttaaatt ttctatagtc    42060
gtctgattct ttaagtttct ttagttcact tttaataaaa tcataattat ttcttagatt    42120
ttcctctaca ctactatatt ttaaagttac cgtactcaca ccgtaagagt taagtgtttc    42180
tatacaatat cttgagagcc attcaatatc atagatactt aatcggtcta cgttttccat    42240
aatattataa aactcatcat catggttccc taacagagtt actacattat catcattaga    42300
cattaaatca aatatatagt taacaacatc ttttgacctt ttacctctat ctacataatc    42360
tcctaaaaat actattgttt cttcaggttt tctttcatta tttattttat ccataattgt    42420
taataatttt tggtattctc cgtgaatatc gggaacaacg tatatagcca tctaatctcc    42480
tccttattgt atataactat cttaccatac ttagtaaaaa aagtcaataa aaaaacctac    42540
cttagtaggt aggtaattaa aattatttat atgttaattt aatttcaaca tttttatact    42600
ttttacgacc atctgttcct gttgactcta gtgtaagaac agatacaaaa tctttaaccct    42660
```

FIG. 21X sequence.txt

```
ccggtgttct gttattagtt gtaccttccg ttgcagtagg tactgttaac cagtaagggg      42720
agttagatgc taagcttgta ttattaacta gtgttttgcc attatattct aacttagtaa      42780
cagacttacc tgttaaatct aacttagttt tatctatatt aatcatgaaa ctttggtctt      42840
ctttccagta tatagctgtt ggtgtgaatg ttgctgtata cgtaccatca ccattactta      42900
caggtgttat agttcctgat gtatctcctg ttggtggtgt actggctgta gtatctttgt      42960
aacctacttg agtatattcc cctacaatat tagttttgt tttatctaca tagataactt       43020
taatgtaatc tctcataaac tctagtcctt gagcattatc atctatagtt atgaaagcat     43080
ttaagaagtt ttgaacttcg gaaattctat tatatttgtt accatcttca taagcaggta     43140
aagtatacca gtaaggtgaa ttagatgtgt agccttcggg gtttatcaag ctcttaccat     43200
tataagaaac atttaatatc ttattagcag ttaagtctat atcatctgta ctcatgttca     43260
taacaaagct tgtatctttc ttccatctca ttccagttgg tctgattaat ttagaataaa     43320
caccattacc taaatcctta acagaagtgt caatagatgg tgggcttgct atagcaccta    43380
cagtaccttt actttctaag aatgattgta tagtgtatga tataaattca tgacctttag    43440
cattaggatg taagccatcc tccatgcctt ctttccaagc aaagaatgtt ttatttacat    43500
tgttatccca tactctaata ttactctccc tatataagtc taatacagga aatgaaaatt    43560
gttttgctat ttcttttata acatctacca attgtcctaa agtatatcct tgtccgtttt    43620
caacttcttt aaaaggatta ctttcaatcc taggtgttgg tgttagaaca acaataggta    43680
ctgtaggaaa aaccttagat agttgataat aagtataata gattgaacct gctactgtag    43740
tgtaagagtg ttctttagct gttcctaggg gttttgtttt accccaact aaaccatagt     43800
catttgtacc taacataacg caaattaaat caggtttatc tgtaatagtg taggctacgt    43860
ttttacggtc ttggtagcct gttccacttg tacctttatt aacatttatt aatcctgttc    43920
tgtcagcaat aaaattggtg tagttttttg ttgttcttgc atttacttcc gtaatactat    43980
ctcctatgaa tataactttc ttatctttca aaggtgagat agttgttgta cttggttgtt    44040
gtgttggttt attatcagct ataagcttat ttatttctgc cataaattct tctttatatat  44100
ggtcgttaaa ttgggtatct ataacatcct gtaaacctat aatattttct gcttttatat   44160
tcataggttc tacttcatta taagtaacaa taataagttt gtcctgggat gatgttaagg   44220
taacaaattt tggtatatct acttttattg attcttcacc attaatatcc caacaaattt   44280
taaagtgccc tgcttcgtat gttgtatcag gatttaaatt ctctataact atttgaccta   44340
ttgaatcttc tatgttttca cttgatttta aagattatt ttcatagtca taaagcttca    44400
atttcttagt catatttact tctccttta ttgaattttg tacaactata atatatcaaa    44460
aaaaatttaa aaaacacct atttaactta aataggtgtc cgacagagct cccgtactta    44520
gattacggtt aataatattt tacgacaatt atatgagacc ctctgtcgtt gaaacgctcg   44580
```

FIG. 21Y sequence.txt

```
tcactgcgtt ataccteaca agatattttg acagttagct tgtgagaaga agattgtttt     44640
ttattgtact tagtttatac actctcaaaa gtacatgtgt actatatatt tatacaccaa     44700
gcgtttggtg ttagatacgg aatggaggga cactaccatc cggagtctac ggtcagatac     44760
aaagcctctg ccgggcaaca tacggtatct ctcgtacatc aggttgacta aacctttaga     44820
gcttttcact ccttctctta taaccagtaa cttaagagaa ataggtttta cttagtagat     44880
atgaaacaat aaatccacat acaatattaa atcatagtca agtgattgca catatgtcta     44940
ataccctataa gttttctgct agcctggtat atggactctg caggactcga acctacagtc     45000
aaaccgttat gagcggttgg ctttaccttt aagctaagag tcctagaaat atcctgagag     45060
aggactcgaa cctcaacgac taggtagcta catctagcca atgccattac tcaggattgc     45120
tagtaacgct aaatagaatt ataacgttac cgtagacctt ttctacgctt ggtagatagg     45180
taaaatataa tgatttcaaa gtacccatat agttaggctc ttactctcat tatcaggtta     45240
aaaaggctaa ctgtatttag cattatataa gaggctttag ttaactacta tactaataat     45300
ataccataaa ttatacttaa tgtcaagtta atttatcaat tgaatctata atttttgatg     45360
tgctacgtat atccgcttct ctactatgtt taaggagata ttttaatttc attaaaaaag     45420
aatttttttc tttttctata atatcttctt tatcattgta ttctgaaaac ataatgaatt     45480
ctatacctat actatttcta ttatgtgaaa acatatttat agaaaaaggt gaatcaaaat     45540
tttttatcatc tttattaata ctaaagtctt cagtaacatg taattcattt atttcagata     45600
tttcaaagta cccattaact cttttaagtt caagataact attatatcta aaataacgct     45660
gttcttctat taacttctct tttgttagat aaggatactc atttataaat ataggattac     45720
ttgttccata gttatctcta atatattctg cgtcctctaa agaatcagta taacctaaaa     45780
cttcataact tgttgtatac actgtatctt cttcccacaa gtcatagtcc atttcctcta     45840
tttcttcttc taatatataa attttttcca tatattactc ccaaatacca ataagatttt     45900
taagcttagc tataacctct tcttctgttt gataagaaaa taccctgta atatgttcat      45960
agttacctac aatttcataa tcttgtgtac catgtttatc tactaagtat gagttattca     46020
taacatttaa actatcttct gagtaactaa aatttatgtt atagtctact aaaaaattaa     46080
taatatttt catttacata acctctccta tcggatattg tcctagcatt cttgttccat      46140
tttcattata aaaagtatat tctactacaa taatattcat catatctaca tatatagctt     46200
ctatatatgg tgtaatattt tcctcttctt gtatgtgctt acctatgata tcatataata     46260
attctgagtg tattctttta tctctcatta tagacctccg taaggaatgc tacagttttg     46320
tctttcaaag atttttctac taattccata gcatctttat agtgtttgat attagattca     46380
ttatacttaa gtttatcttt tacttcttga attagaggct ctactttatt aaccaaatct     46440
```

FIG. 21Z

```
                                   sequence.txt
tttttcttttt caatacttac attgcttctc ttattgtcta atacttcttt tggcatatat    46500
ttaactttg   caaagtcttt atagctaaca tttaagttat ctaaatcatc taataaatca    46560
ttatagtatt  ctaaatgatt atagaatgta taaaacttaa caaggtcttt accagttaat    46620
tctccttttt  ttagtatgtt attaatatta ccgataaccg aatatgctat aggcttaaaa    46680
ttagctctaa  cataagttaa aaatataaaa tcatcataaa ataaatctaa aacagtttta    46740
ttaaatctag  tattttagc  ttgctctaat tgagcacata aattaagaac attatcaaac    46800
ccactttta   gcactaaaga gataaatctt tctactgcat agtatcttga tacttctgta    46860
tgcttacttg  ctttttcatt attcctaaat atagtatctg ataaaggttg aacaactaaa    46920
ctcatgtaat  ctttatctga atgctcatct gatgttcctt gataagtact tccaaattct    46980
attgttgata  ataagaaact tttttctagg ttcattataa catcctcctt ttatttgtta    47040
tttaaataat  aacatatatt gataataatg tcaatactta tatatcttct tctgtatcaa    47100
cttcatcttg  tttatactta aagtgttcat agactttaaa tagtataatc cctagtgtta    47160
ttaatcctaa  aatatatttc atagtaatcc tccttaataa ccatgtttag ttacccatcc    47220
tgctaaagca  tccatagcca tatcatattc ttcttcattt ttaattctta taattttctc    47280
tatttcttcc  tttgctttct tagaactaat aaaatcaata tcagtatcct ctaggttagt    47340
taattctaaa  ttttctctaa taaaattctt ttgacttggt gttatagaat taactcttac    47400
attttcgtga  tttagaaatt ggtaaaagtc catattactc atccttttta acgtattctg    47460
ccatatcttt  taaaatactt agtacatact ctaaatctct atattggtca tctaatgacc    47520
ctataatagc  atatggtgtc atatcccagg catgtgcaca gtcaaaccct aatactctct    47580
taccctcata  gtcataatca tcgtaagtga tacctctatg agcacgtctt tctaaggagt    47640
catattcttt  ttcattgata tctgaaggta aagttatata tccatttaga tgaccagttt    47700
cagggtgtct  cttaacagtt agtttaactc ctttataata aatatcaaga cttaaatctt    47760
ctcctagaat  attgttttct ttttctactt tttccataat gtattgaggt gcttttttaa    47820
acataatcag  tcatctcctt tttatttata tctttactat acactatttt ttctattttg    47880
tcaacaaaaa  aaggctacta attaaagtag cctaaatact aattatttag cattgtattt    47940
ccattgccaa  taaccatttt tctgtgagaa ctcaaagtga aaccatcat  agtcaaattc    48000
aatattatag  tctccatctt gaagtggttt tgaatttagt acaggactat tactctttgc    48060
caattctgct  agaaactcat gatttacttt ttccataggg tttactcctc ctaattattc    48120
ttacagtact  aatatatcat aggtctttt  ctaagtcatt tttaaaagtt tcctcgtagg    48180
aactagcgta  agtaacctca taaccacta  cgttagtata tcctacatat aatgacttat    48240
aattagattt  tatcttaata tcttctgatt gttctagctt atttaagact tcatttaaat    48300
catctgagga  atagtgttca ttatctattg ttattgtttt tccttgggta tagatatcaa    48360
```

FIG. 21AA sequence.txt

| | | | | | |
|---|---|---|---|---|---|
| tttcttgtat | catcatttca | tcctttgat | tattcattat | ttgattataa | gtttctaaat | 48420 |
| catcaatgtt | atctgtatct | gaaccttta | ctaaccattc | tcctctcttc | ttaaggaggt | 48480 |
| catcaaactt | ctcatgctct | ttaattatct | tttctacctc | acttggtatt | aacacagccc | 48540 |
| tagcatagtt | tatatgccac | atagacatat | tatcaataag | ataattaacc | attcttataa | 48600 |
| tctcttttc | atttgccata | taccaacctc | cttatatcta | ttattaatat | aagagaaaag | 48660 |
| cagacttatt | aaaagtctgc | ttctttacct | aattctaatc | ttctattttt | catatgagga | 48720 |
| atcgtttttt | tatttcctgt | taataatgat | aattctctag | ctttttcttt | agataatgtt | 48780 |
| agtagtccat | tataattatc | tactttacta | ttatattgtc | tgactaagta | ctctagttca | 48840 |
| tcttctatac | ctgctagttc | tcctgattta | actccaagta | actttctata | catgtcataa | 48900 |
| tcttcagaaa | gactttctac | tttgttttta | gatacagaat | cataaactgc | ttgtaaatta | 48960 |
| ccttcttcaa | taagtttaaa | attatattca | ccaatgatta | attctttttc | agaagagtca | 49020 |
| agggtaacta | aaccacttgt | attacctgta | aagtcacctt | tataatctac | aacaattcct | 49080 |
| tcagttattt | tatctcctaa | ttcaatagtc | ccatcttcat | tttcttaaa | tttatgagca | 49140 |
| tcataaactt | ctactttgtc | acctaatctc | aaatcttgag | ttaagttatg | tttaccgata | 49200 |
| attctatcca | ttacttaacc | tctcctttat | taatagggtc | ttgtgttaag | aacatttcta | 49260 |
| agttctcttt | tgtaataggt | aaccaaaaat | atttactttc | cggaattgta | actgtataga | 49320 |
| agtcttcatc | attattaact | ttgatgttaa | catctgtaaa | ctcatcttgc | attaaccaat | 49380 |
| gagttacagt | taagttatat | gacccatcac | taacataccc | taaatcaata | tcatgtctaa | 49440 |
| aagccaaatc | ttctaaatgt | tctaataaat | cattctttc | attatgtttt | tcttcttctg | 49500 |
| tattattttt | aattgggtta | attaactctg | tacaaacgat | atcgtacaat | tcaccatctg | 49560 |
| taacctcata | gttcttttca | attaatacat | cttgtatttt | attgattgaa | tttgtaacta | 49620 |
| ctttcccata | ttcttcttct | gtaaatttac | atttatctaa | atcaacatct | gtaattaatt | 49680 |
| ctgcaatcca | tttatttaaa | attgatactg | ccattgttct | agaaataata | ctatcgtata | 49740 |
| ccatatttat | ttaatctcct | tatttaggtg | aatgtggtct | tctaatgaaa | aatcaaaagg | 49800 |
| cgctacacca | tttcttttat | tatttgtttc | tttttaagt | ataacataag | ttagtgaaaa | 49860 |
| agtcaagata | gttactacag | ctattgataa | aagtttaatc | gggttttca | tagttactct | 49920 |
| aactccttaa | gtttattttt | tactttctct | ttatcgtact | tataatcttt | actagagttt | 49980 |
| tcatttttt | ctttctcttc | ttcattaagt | tctctatact | gagcttcttc | tacctcttgt | 50040 |
| tctttattat | cgttattttc | ttctgctttt | tgaatttcta | catttttact | attaccacca | 50100 |
| tttacctttt | ttctaaaaag | aaaccaaagt | attaataaaa | tgatgagtaa | aataataatg | 50160 |
| cttaatacaa | cagcccaaat | attattagcc | attacaacct | acctccgaat | agttttttta | 50220 |

FIG. 21BB

```
                                      sequence.txt
cagctcttaa attttcagat gaatcgttat ttatatcaat ccctacgcta gaatcaaaaa      50280
ttacagcatt atcaagtata tgctctgtta atttattacc ataactactt ttacttacca      50340
cactaccata accatgatta gttaggtcaa ccatatcagg ttcaacttct agtactctaa      50400
aagatattct acgtaagaat gaaggattta ctaagtaaaa ggaagattta aaaacattta      50460
atctttgata agaatgtttt atattaacaa caaaccctgt taacttatct tcatacccctg     50520
aatttgataa tttacctaag taaaggttta tactatatcc ttttgtttct aatgtttgaa      50580
tagcacttaa cattatagca cctctataag caagattttc agggtcttcc ctccaactaa      50640
tactagaatt ataaaataca tcataacttt tcttctctgc tttaactctt tgctgagaca      50700
tcatagaatt aggtaatcct tttatagcat taggtacgtg aggttgatat ccttccggag      50760
ctacgacagg ttttcttttt actgacttat ccattctaaa taatgcatct gtcattttt      50820
taagtttaac taccatatca tatgactctc tatcacccctt aaccattaag ttataggctt     50880
cttgaaaact atgagtccct gtaaaatcat agctacctgt atcggatgaa ttatctctac      50940
ctgaaactct attctttttt aaagcagaaa agaaatcagg tagaccatca tatttaatta     51000
catttaattc tgagttatct attaatcgtc tacccattga tttgcctcct attctaatcc     51060
taatttatcc ataattgtat caaaatccat tgaatctttt gatgtactat cagattttct     51120
aggttcctgc ttaggctctt gttgcatacc taaaagcttt cttgttgctt ctgtgtatct     51180
gttaccttca ggtaaagagc taataaattg attaatctca tctttcggta cagatttaaa     51240
gataatactt tctacaacaa actcatcttc cattactcca tctaatttac taccattaat     51300
aattgcacgc attgagaata cataaggtaa tcctttttca tcattctcat gtcttaattg     51360
ttgtacaaag tttactaggt cttcattgct tgatagttga tgttccacct tagtatcata     51420
gtcaaattca acttgagcaa agcggtctaa tgtagctccg tctaattgtt gtctacctac     51480
ataaatatgg tctgctcctg ttcccatagt attacctgct gacacaactc tgaaatcttc     51540
atgagctgtt acacgtccaa tagggaagtc aaagtattta tttgcaatag ctgaattaag     51600
aattaatagt acttcaggaa tagatgcatc catttcatct aagaagaata acccaccttt     51660
tgtaaatgct ttatagaatt gagtttcatg aaacttacca tttgcatcaa taaatcctgt     51720
taatttaaat tcttgcgtaa ttgcattact aaaatagaaa tctaaatcta ggcttctgc      51780
tacttgttcc aatacatggt tcttacctga acctgctcca ccttttaaaa atactggaat     51840
attttggtta actagctta gtatatcttg gtatctataa tgaaagattc ctgagatatc     51900
tttaattgtt tttccttctt gttgtaattc aatttaact ggtaaattac taagttgttc      51960
ttctacatat tcttcaattt gttttttaac gtcagtaata ataatttctc tactctcagt     52020
tcctgctttc tcaacaattg catctacaat tgcttgttcg tacggattag agttttctc      52080
tcctagtttt tttgctaaat ctgctgttgt ttccatttgt tgctctacca atctctctaa     52140
```

FIG. 21CC sequence.txt

```
tctttcaata gtatcttgct ttgccatatt tatcattctc ctttgatttg ttatacattt      52200
attatattac aagtatttga atttgtcaac aactttctaa aacttttttt agttgctaat      52260
aaaaaaatac cttacaccta taacttaaca tagggtaagg taattgtcaa cacttttgtt      52320
aaaaatacat taatttaaaa aaatcatcaa tatctttagt ttcatgtgta tccatatcat      52380
acataaacat acaattatat gtatgattat tcattatttc taacatgtta tgcatagaag      52440
ttgcattatt gaattcctct aaatcaatag ttaccgtaag ttcttgacct tcataaagta      52500
tgtttgctat ataatatttc ttaacacctt ccattgttcc atgagaagtt tcattatgat      52560
taagtacttc tacacctagt gaaggtaaat attctgaaaa gtaatattta cagaaatata      52620
taaaattgtc tgttcttta gacacgagta ctatctccgt actttatatt tctttctaat      52680
cgtacataat atgtttaat tttttgtact tctttatcta ctgcatcctt tcttcctaac      52740
cttgtagtat atttacaat attaaatatc atagaatcaa caaagccatc ataagaaaaa      52800
tgttcttcta gaaaagaaat aacatccttg ctacctttat agtgctcagg taaatgtgca      52860
tctacttgta tattataata attttctaaa agacctatac tctcaccaag actagacaaa      52920
gcgtaaccta aatcatttga atcattagac cattccttag atactgatag tgcatcttct      52980
ataattgtta cttttaattt atctaaataa tcttctactt gagcttgtgt tttcataaat      53040
tcttttgcgt tcatgtaata ccctcctaaa ttatataaaa aaacaccctg cttggctaca      53100
agcaaggtga aaaaggaaag atattatgga agtgtactat ctaagtacac ctcataatat      53160
aacagttttc cttgctagtt attacttatt ttttaaggtc ttcttctttt acaaacactc      53220
cattaataag cttaccttt ctgtcttta tctcatcata agccatatca atacactctt      53280
caatatctat atctaactgt aagcatagta ctgttaatac tacaaaaata tccccaacac      53340
tatctcttgt tacatggtca ttacttttag caatacctga agctaattct cctgcttctt      53400
ctaataattt tagcatttga ccctcgggtt tacctgtttg taagtttcta tcttttgccc      53460
attgtttaat aagttctact ttttccatta ttctatatct cctttaattt ctgtatcttt      53520
gataattagg ctatcagagt cacttgttac atttaaatta tcttcaacta attcatgtaa      53580
attattagta atatcttctt catacctata acctacacga acataagctt taactctgat      53640
atctatatta acataatctt cttggaattt ttccattcct aacttccttt attgtatcat      53700
attattatac tattgtcaat taatctgagt agtttccttt agcaagttga tacttttgt      53760
gtaattcttc atataattct ctcataccctt cgtagtttct catatcatct tccaagaaac      53820
taagataatc taataatact tttacatcct caggttctaa agttataact ggttttacca      53880
ttaggcaacc tccttaaatt cttctttatt tattttctta atatcttttt ctaatgcttc      53940
ttttaattca ttaggtaatt tataggcatc aattgattgt tgttgcccta gtacatatcc      54000
```

FIG. 21DD sequence.txt

| | | | | | |
|---|---|---|---|---|---|
| attatctgta | atacgtattt | caactgtaaa | ccatgaatta | tctaaatctt | cttctagtct | 54060 |
| tgctaacaat | attaagcaac | tgttctttat | aattcgatta | gcatacccgc | caacacaatg | 54120 |
| agatagcatt | ttaccttcat | ttttcagttt | acttacggta | tctgcaggaa | ggaattttac | 54180 |
| ttttctacca | tcttttaatt | tataagtttt | atcaattatt | ttttctaatt | tattttcata | 54240 |
| tttagattta | agctctgcat | catctaattg | ttgttgaata | gattgtttct | cgtctgtaac | 54300 |
| tatatcatgt | tctaatttta | gagagaatgg | tgttaagtta | acactttcta | atgttctata | 54360 |
| accttctcgt | attaatattg | ataaatcatg | aagataatct | aaatagtagc | tatccagtgc | 54420 |
| atatcctgtt | atacgttgtc | tatcttgagc | atctacatct | aaataatgag | tcattttttt | 54480 |
| gtaattagca | aaagatatag | ataatatttc | atttacaata | ggttttactt | taaagcatc | 54540 |
| tgtaacattt | cttacatcct | gaaccattaa | aaatgtatca | tcaaatagtt | gatgtagatt | 54600 |
| aacttcattg | tgtaaatgat | tatagtaatt | atacaatgta | tctgaaaatc | ttaaataatt | 54660 |
| actctgttca | aaattattta | atgttagtaa | ttttttatac | gtttgctttg | taagattaaa | 54720 |
| tgcttcatgt | attttccact | taggatttt | aggtatatga | aatagtaatg | aatttctttc | 54780 |
| aaataattca | aattcctcta | agttatttat | tttgtcaata | tttttaacaa | tatctgttaa | 54840 |
| gattgttaag | taattagaag | ttgaattttc | tcctttgagt | ggtttatatt | tgtttcctcc | 54900 |
| ataatttaca | cgcccatata | catcaacctc | atcaaggcac | caactagaaa | gtccaaaacc | 54960 |
| atcatttctt | aatgtttctt | caattatttt | aataataaca | ttcttactta | aattaggtgt | 55020 |
| tgaataattt | tttaaaataa | catttaataa | aacagccaaa | tttaattcat | ttttatattc | 55080 |
| acttttacta | atatcgtctt | tgtatagatt | taaagttatt | tctttattaa | caagactgtc | 55140 |
| tgttaagaaa | accttaactt | ctcctgtttt | aacatcaaat | gaacttttat | tttctaaaac | 55200 |
| ccatctattt | cccatattat | atttatctct | aatgtgtcta | actttaagac | caaaagatga | 55260 |
| actattctca | gtacttggat | gcatgtacca | agtactactg | tacaatgaat | ctgatatttc | 55320 |
| cttataatac | ttactagagc | ctttttctgt | atcttcatta | agtctggaag | taatagatga | 55380 |
| ctttattaaa | ccgtacttac | cttggtataa | gatatccata | atatcattat | tcaaactatc | 55440 |
| tactacttcc | ttatactcat | ctaattgtct | agattcatac | caccttaaac | gggtttcatt | 55500 |
| ttctaattct | ttaatttttt | cttctacata | acctttagat | tttatttgtg | ttatacgttt | 55560 |
| actaccatat | aaaggaaatt | cttttctttc | ttctctactg | gatgcaatat | attctttgta | 55620 |
| acttcttcct | ttatttcttt | caattacacc | ttcaactaat | ttttcaattg | tttcataagg | 55680 |
| attacctgta | aagtttgtta | cttctttatt | accacatagt | gctaagaata | aatgtatttc | 55740 |
| tgtagcagta | tcaaaactaa | atatattatg | aatatctcta | aatagttcct | tagagcctaa | 55800 |
| gttaattata | ttattttct | tcttcttaag | gaatacatct | tcttctccta | tatagataca | 55860 |
| tcctttatta | actttaggta | aattaataat | ttcttgttct | gttaatcctt | tttgtttata | 55920 |

FIG. 21EE sequence.txt

```
tgttattgcc atttaaaatc actccttatt tgttatgtac taatcatacc atagtaaata    55980
atatttgtca acaaaaaaag aagaactttt taaagttctt ctaagtgagt ttcgtagata    56040
accttttgaa ttttatttaa tggtttcaaa tctaaattac gaataagttt ttcgtacttt    56100
ctagaatttt taaaattgat agtatttggc atagcaagag cctcatcaat gtctttagta    56160
tagcttataa catctgaata aatatctact tcttttacat atagaccttg agttaaactt    56220
ttaaatacta cctcattatg tgctacaact tcttctttct tttctatgct cattttttgta    56280
aacctcctgg tctattctac acaaacaagt acgtactcta aactagttaa tgttactgat    56340
ttaatattat ttaattcttg taatttctta atatctacac catagttttt acttatagtc    56400
cataatgtct ctcctgctct tactttatgg taatacttat tcccttcttt aataaggtca    56460
ttcaatatta cctacctcct tgagtaatag ttagcttgta gataacatat aagtataaga    56520
acaaagttta caaattcagt agctataatg tgaacataag tatgtgataa aaccatactt    56580
aatattaatg aagctaatcc taatccaata ataaggaata gaaatctgtt tgttccttct    56640
gcactttag ttttatagaa tgttgttatc tgagttacat acgcaaggat aatagtaata    56700
gttgcaatag tttgtgttaa ggctgtaaag tcacttaata aaaatagtaa cactgagaac    56760
acaataataa aaggtataga gaaataatcc ttttttctat acgaagctac taataagcaa    56820
acaataccaa gagttaaatt aacaccaact gatactactt gaaacattgt agcgtcagtt    56880
ataagtaaat tgtaaaagct aatacctact gtagctacaa ttaaatacca aaaataacta    56940
ctaactcctt taacactatc tgatttaact aaagctatta gacctggtat ataacctact    57000
gtaactaata tagcatataa tatacttaag taatgtgata agttatccat cttgtcctcc    57060
taatttctct agtcttttta aaacttcttc ccaagaaata aacccttctc cattagttag    57120
gcttagcaca catccgtaaa taaattggtt cgtactaaat tcagccctat cagggtcatc    57180
ataaccttt ccatgtcctt gacgaatatc agagcaatag attaaaacag gtttatttac    57240
aatattataa gcttctaaaa tatcatattg tgttaagggc tctaagtctc taaagtctat    57300
atcttcatat ttatcaataa ttttttgagc ttggtgtttc attcctaata aaataccaag    57360
ttctgcaatc gttcctagcc cctcattaag aatgtcaaat acaaaaatat ctgattcttg    57420
catagcttta aaatcattgt ttaagatacg ttcagctaat ccagtttgtt ctgcattagc    57480
tttatcgttg attgatttgt cctgatgagg gctataagga gttactccta caatacccct    57540
tacttgttcg tgttgtttag ttctatattc taccatagct tggttaagta gatgacctcc    57600
catgtaacaa accttatctt tagtataatt aaccatctat agtatctcct tttcttcta    57660
gaatacctct taaaatgtgt ggcatctttt tcttaatttg tttttctata attttcatca    57720
tattttcttt ttcttcttcc atgatatcat caacaaaatt ttgacctact tgtttcataa    57780
```

FIG. 21FF sequence.txt

| | | | | | |
|---|---|---|---|---|---|
| ttaaaccaaa | attttccaat | tctaaatcat | ctttagacaa | tctgttttct | tctatagctc | 57840 |
| taaaaatcat | tttttccatt | cttgattttg | tgatagcata | atctgctaca | gaatcattac | 57900 |
| ttctaacttc | tgatttcatt | ttcttacgac | taaactcttt | aaattcctta | gatactaatt | 57960 |
| taaaataatc | atcatgttct | gatttaccat | ctaaatattt | aataacaata | ccttctcctg | 58020 |
| tattaggttt | aacagtcata | tctgattttc | ctactaaatc | ttgaatttct | tgagggttta | 58080 |
| atttattaag | ataaaaagat | ggttctataa | tcattaaagt | ttttacagtt | ttcaaaccta | 58140 |
| atgtttctga | taaagaaatg | acttctgaat | aaggtaaata | ggtttcacta | tccttatcgt | 58200 |
| atacatcgaa | tacataaaaa | ttattataac | actcttcttt | ataatttacc | ttatgtttaa | 58260 |
| ctaaccattc | tccaaatata | ataataccTT | ctaatataga | taaatctaat | ttatctgtca | 58320 |
| tgttttcatg | tacccaatta | taaaaaccgt | ttaatgtttc | gttttcattt | aattttttc | 58380 |
| tacgagagaa | acatactaac | tcaccattct | ctgtagtaaa | acttgcgttg | cttccatcta | 58440 |
| attttcttg | aactacaaaa | cctctatctt | taaatttgtc | taaagataat | cctttatttt | 58500 |
| ttactttagt | ataagatttc | attaattagt | tatcctcctt | tgaattatgt | actattgaaa | 58560 |
| ataaaataag | acttacactt | gccaaaaatg | ctaatactac | taaaccaggt | aaatttagaa | 58620 |
| ctgttgataa | gaataatgct | actgcactta | taacataaac | tagaccgcct | aataataaag | 58680 |
| ttaataatac | aattgttata | agttttacca | accagttatt | attaataaat | actttagcta | 58740 |
| aataattcat | aaaaaagcct | ccttagttat | tataatataa | gtataccata | tctaaggagg | 58800 |
| tttgtcaaca | tattatttta | ccatttgaaa | ttatctgcgt | attgggctaa | cttagaacgg | 58860 |
| aaattaactg | taaaattatg | gaatactgca | ccatcatatt | ttttaaaata | ctccatgtaa | 58920 |
| tccccaaaac | ctgatttact | ttcatttttt | aaatctattt | gtttaaagtt | accttctact | 58980 |
| attacagtag | aattttttgt | atgaacccTT | gtaagaactt | ttttaagttc | actacgttta | 59040 |
| aagttctgtg | cttcatttat | aattatagta | gaatctctta | gatttccacc | tcttaggaat | 59100 |
| agatgtgata | tttgagatac | ccaacaatct | cctagtttat | cttctttaac | attatcttcc | 59160 |
| atcattaaca | tttcagttat | ttgttgttca | ggattcatat | taagttcaat | aagggcatcg | 59220 |
| tgtaatccca | tgaaataagc | catttctttt | tctgtctgat | tacctggtct | gcttcctaaa | 59280 |
| tcctctgata | ctggtgaaat | tataaatact | agctttctat | ctttattaag | atagtctgcg | 59340 |
| taagcacagg | ctactgagca | cattgtttta | cctgtaccgg | cttgactctc | attccaaagt | 59400 |
| atttcaacat | tatcattaaa | gaaatcctca | cagaaatcta | actgctcggt | tgtagctttt | 59460 |
| tcaaggaatt | cattaaagac | tagatgttct | cccatgttgt | atcttacatt | aggataatct | 59520 |
| tttaacttaa | agtctaactc | ttttagttgt | attgccatat | tttaaagttc | ccctatctat | 59580 |
| aaatagtttt | actctctttt | aatatagtac | taatttccga | tatattctcc | tgttgaagag | 59640 |
| caataattac | tacattcaca | ttcagggtag | ttatcacaaa | cttcttcgtc | ttctacatca | 59700 |

FIG. 21GG sequence.txt

| | | | | | | |
|---|---|---|---|---|---|---|
| tcataaccaa | tatcataatt | attataatta | aaatctacaa | tacaattttc | actattacct | 59760 |
| ttagataatc | ctgtataaat | aatatcatcc | acagaatccc | aatcgttatc | tgccaaataa | 59820 |
| tttacgctat | ctaatactga | ttcattatca | ggtaaataaa | tactaccgtc | tgaaaattta | 59880 |
| attagaatat | caccttgagg | taaagtatca | ttaattaaat | caatctttgt | ttcttcttca | 59940 |
| atagtgaata | cagttccttc | taatctttcc | ggtgtagtat | gcgttaaatg | ttttacagta | 60000 |
| tctcctgatt | cttcatagaa | tcctactgca | ttcatatctt | tattatattt | tgcaataaat | 60060 |
| ttaccattgt | cacttaccaa | atattgacta | gttgaattat | agtcgtttgc | gtcatctact | 60120 |
| gtcatgcaag | ggttataatc | tttaacataa | taactaattt | tcctaacatc | tgttgtttgt | 60180 |
| actttcttac | cttcaccttt | aattactgaa | ttaattttttt | tcataatatt | ttctcctttt | 60240 |
| tatatatcaa | ttgatttttt | tgcaagatta | tcggcatagt | cattccattt | atcatttgaa | 60300 |
| tggctcttta | cttttacaaa | atttatatct | attactttt | ggtattctct | tatcatattg | 60360 |
| atatatgttt | tacttagaat | atttcttgca | gaccaagtac | cttcatacca | atgtattaaa | 60420 |
| ccaatataat | ctatataaac | tattgcctga | ttgtatccta | gttttatagc | ctcttcaata | 60480 |
| ccataacaac | aagccaatat | ttcacctgca | acattattat | actttattaa | tcctggtttg | 60540 |
| tcaacacttt | tactaatttc | cgctattata | tttccttctt | tacttaccaa | gacagcacct | 60600 |
| gagcctactt | tacctttatt | atatgaggag | ctaccatctg | tgtatatatt | tacactatcc | 60660 |
| tgcatattta | taatcctcca | taaattgagg | gaattcacaa | tctgagtata | cttctctaca | 60720 |
| aaaagatact | gagatataat | taaaatcaaa | acatttgaaa | cagtgttctt | gaacttcttt | 60780 |
| tttatcttta | gcaatcacat | taaatttaaa | accatcagct | attactgtaa | atactccttt | 60840 |
| tttcataaaa | caaatacctc | caccaattttt | attttaaatt | aataactaat | tcaataaatg | 60900 |
| atttaatagt | tttattttta | ccttcatcaa | tatctgaaaa | gaagttaatt | aaactatcat | 60960 |
| cctcatcaaa | taaatcttca | acatcatcaa | atttatttaa | tatgtctgta | acactataac | 61020 |
| cttcttctga | tatatactca | tgcaagtctt | ctccatcttc | tgacagtgtt | gcttctattt | 61080 |
| taccattttt | actttcaatt | aaatataaag | tatttaacac | tttaacagaa | tctacaacta | 61140 |
| cactgtagtt | actaatagta | ggatattctg | tataaagtat | ttctacatta | gtattcatat | 61200 |
| aactatcaat | tacagagtta | actgtatctc | ttttttagctc | agatacatta | tgttttcgta | 61260 |
| tagtagggaa | ttcttcatca | tattctacta | attcttttct | atctgtgttc | aataacttgt | 61320 |
| ctaaagaaga | caacaatact | attttatact | ggttatcagg | gagactatct | gtaatttcca | 61380 |
| ttattgttaa | aaacgtatct | tcacctagaa | ctttgtttat | atcttgtaac | tcaaatgaat | 61440 |
| ctaccatttc | aatagtatca | tctatatcat | ctgtagtcat | taaaaaatta | actaaattat | 61500 |
| tattctccat | catcttcctc | caattctttg | aataactctt | ttcctggagt | atttaacgct | 61560 |

FIG. 21HH sequence.txt

```
ttctctaacc gcattaaatt agcgcttctt ggtttctttt ttccatactc ccaataagat    61620
ataagagagt aatgaacacc tatctcagaa gctaggctcc ttaatgtatg tcctttttct    61680
actctaattt tttgaaggtt tagaggttta ctttccttt tttcatccat aattatttct    61740
cctctacttt taaaaattta aaatcctcag atgcttttgc atttttagt atatactcgt    61800
gtgacttatc tcttgcctct gccttgcttt tagcatataa ctctatatga aatacatgag    61860
gttttttaa agacggtgat tcatatctcc aataaacttt aaaaagtagt gtttcttttt    61920
ttaaaacatt aattcgaaac catcttttaa atttattcat tcattatcct cctttattta    61980
tttgttaaac taattatagc atagttaact tatgaagtca actataatat acaaaaaaga    62040
ctaagaaatt aatcttagtc taaatcgtta ctaatagttt ccgttggcat tatggaagtt    62100
taaagctcct gatgttgaac cgtaacggtc aatcatatat tgttttgcac ctttagtttg    62160
ttctgctata gaaccaccac tccatgattt acctaatcct tggaataacc cttgggctcc    62220
tgatgttgga ttaacagcat tcgggttcaa tgtagattca cgcatagcaa tttcaatcat    62280
tgcttcatct ccgcctgctt gtctaatctg ttctgctaca gaaccacctg tacttttagt    62340
agctgtagtc ttagtttcta ctttaggagc ttctactgac ttaggagctt cttgagtagt    62400
tgtttcttgt ttaggttgtt ctactgcttt attttgtgta tcaaattgtg cttgttgttg    62460
gtctacttt tgttcaggtg tttgctcttc tcctgctaat ctagatactg tattatctac    62520
ttgagttgaa cctgaatgat attcataacc aaagttacca ttataattat agaaatgata    62580
agtaaattca ccatcactaa atgagaaatc ataattacct tcttgaattg gttttgtatt    62640
aacttctact gaatttgatt tagcttgttc tgctaactta ttatagtcaa tttcgtctgc    62700
actagcttcg tttgtagcca tacctccaaa agtaatagct gtacctaatg ctaatgttgc    62760
aaaaattgtt ttcttcataa atttaaaact ccttaaataa tttttagaa ttgtttattt    62820
gtaaaccgac ataagtaatc ataacatata tctttaaata acgcaagtat aatatagcac    62880
taattagtgt aatattatta aggttttatt acaaacatta cagttatcag ataattaaat    62940
acaaaaaaga gaggtattaa cctatctaat ttattatttt cctgttacat ctacaatagt    63000
tccgtctccg ccaatttgaa taggttgttt tccatcccat ttttcaatta gctgttgttg    63060
taaaacttca tctgttaatg attcacttct gatatcatta gctttcttct caccttttgc    63120
ttctacttct tttttcttag catttcttc agctatctgt ttatcgactt ttgtacgttc    63180
taattcttga tttgcttta ctctttcgtc aattgctttt tgagtattct tatctgcttt    63240
aggactagat aatgcaatat cttcaattac aaatccttgt ttttctaaat tatcatttaa    63300
gctatctaaa gtatctttt taatttgtcc tgttttaaca ccaaatgcat caattactga    63360
gtacttagat actgattgac gtacattatc ttgtacacga aacgtaagt aacctttttc    63420
taattcttca atgtcagcac taccaaaacg attaaataag tctacagctt tagttgcatc    63480
```

FIG. 21II sequence.txt

| | | | | | |
|---|---|---|---|---|---|
| tactttatat | gaaacatcaa | tatccatttg | taaattctta | ccgtctgaag | ttgccacgtt | 63540 |
| taaatcttta | tatttatgtg | tttgtgtttt | agttggatat | ttgtttacct | tatcaaaagg | 63600 |
| tgctgttaag | tgccaacctg | gtgatttagt | atcttcctta | acaccattta | ctgagtacac | 63660 |
| aactccaaca | tgaccttgtg | gaatctttgt | aatacacatt | aataaaataa | taaatcctat | 63720 |
| aattgctaaa | aaccctatta | ctcctgaaat | aactactgac | ttcctcattt | acatttctcc | 63780 |
| tttttctatc | tcttttatta | aactatttaa | agcttttttcc | tctttgtcta | tttcctgttt | 63840 |
| gtctgctttg | gtaacaagag | attgcctacg | gtcatttaag | aattgttttt | tatattttac | 63900 |
| atattgttct | aaaccgtatt | cttctaatgt | accttgccta | actaattccc | tgtattgttt | 63960 |
| tcttatgtta | cttttcttct | ctctcattga | aagaaaatca | aatacgtaac | tcataccaaa | 64020 |
| acctacaagg | actagaaaaa | caataaaaat | agcaaagtat | gttaaaaata | atgccatgta | 64080 |
| attcctcctt | tatttgatta | catatataac | tatacactat | gtattacgtt | ttgtcaacac | 64140 |
| tttttttgcaa | aaaaaataga | cggatttaaa | atccgtctaa | atttatactt | tatttaaata | 64200 |
| ttgttatact | tttagtttct | tcatactctt | tcaacattct | atctctaaga | tttattgctt | 64260 |
| cttttatact | atctacttga | tatgattggt | accttatatt | atttcttgtt | atagaaactc | 64320 |
| tatatttacc | attagttctt | tcttgtatgt | tttttaatcc | ttctagttta | gagggtctat | 64380 |
| taactatatt | ttcacttcta | gtagtccatc | tacaattttc | cggagaatag | ttaccatcat | 64440 |
| tatcttttct | atctaattgg | tatttatcag | aaggtctttt | acccatatca | tataaaaaag | 64500 |
| attcgaaaga | gtttttccat | ctatcacaaa | cttcaatacc | tcttcctcca | taatatggat | 64560 |
| aactgtcttg | atttttgtta | tagcatcttt | ctttcatttt | tctccatact | gtatactcag | 64620 |
| gatgtttttt | agaaccatta | cgtgatttca | tacaaccaca | acttttataa | tagtataatt | 64680 |
| gacttttaga | taaaactcta | tccataccgc | aatcacataa | gcataaatat | aatttacctt | 64740 |
| taatcttatc | tgaacctaca | tattcttcaa | caaataattt | ttctattttt | ttacctataa | 64800 |
| tattttccat | aaaatctctc | ctttgaaaat | attataacat | atatataagg | ggtattgcaa | 64860 |
| ccccctttatt | tattaacctt | tgaatacacc | ccaggcaact | ccaggtacat | gtgaaggtgg | 64920 |
| aacaccttga | caagttctaa | cagggcaata | tactctgtta | ccattgtaag | cattataacc | 64980 |
| tatccaaata | tgacctgctt | ggatacaaac | ttcgtcatat | acaattgtag | ccctgccgg | 65040 |
| taagttaccg | cctactggag | catttaagaa | tggagaacct | attctagtta | ctataggttg | 65100 |
| gttaccatta | acaaatgttg | catttttccgg | tttataccaa | gttccgtact | ggttctttttt | 65160 |
| ccaagagcct | gtaactggtc | tagttgccgg | tgtacttgcg | ctacttgttt | ttccatcttt | 65220 |
| aactactgta | gaacttgaag | tcccttttatc | catgtagttt | ttaatttgtt | taatgaaata | 65280 |
| atcttttaat | ttattcatta | ttgcttgtga | tggtcttcct | tgtgttactg | gattaaatcc | 65340 |

FIG. 21JJ sequence.txt

```
tgtatgaaga accatagaac ggtgagggca ggcagttggt acaaattcca tatgcaatct    65400
tacagtttta cggttaggag taagacccca ttctttaaat ttctccgctg taaattggaa    65460
tactgcttgt tcatttttaa ggaattgagc atcactagca ctcattgatt gacagacttc    65520
aatacctgca aatctaaagt tacctgagtt tgctcctgtt ccatctcctg tgtgccaagc    65580
aatttgattc ttagcatcta ttgcttccca tacataacct tcagagccgt agtaatgagc    65640
aataccatta gcgtatctag cataacctgc attagctaat gaattctcgt attgttgtcc    65700
tgaagaacga cctgcatcgt tgtgtattac cattccttca ggttttttac cacgtttatc    65760
cattgtatag ttaatgtgat tcttagaaac ttttagtgtt gctttctttt taggtgcagg    65820
agttttactt gcgcttttct tagctgtttc ttttttaaca gtagttcctg cttttacagg    65880
tatttcaatg aagtgagtta atccgtaata attatctaca cgttttgtag gttttttatt    65940
agcataacca ttccagtttt gctctaaaat agtaaacgta gaagtattac ctccatcata    66000
tacaatacct atgtgacccc actgttcata actaccggat gtaaataccg caatccaacc    66060
ttttttaggt acagtagaag gtttattttc atgtatttta aatccagtac cataactctg    66120
tttaatttgg tctttagcat taccccaagt tctaacttta ttatctgtta accataaaac    66180
atagtctgta ataaggtctt gacactgagc gtgatagtaa ccatctgcgt caatggctcc    66240
tgcttccatt acaccaaatg atgggtcata acttgtagct tttttaactc tgtaagggct    66300
atctactgtt ccttttgcat aagcgtctaa acgtttattt atttctgctt gagtcttagc    66360
cattacttaa cttcctcctc tgcaaatact ttaccatgtt cctcggtatc ttcttcatct    66420
tgagaaggtg ctgaaccacc atcaatttca tcttcaatag caggtacttc atcactatca    66480
tctgtgtcag gttctgcatt gttttcgtag ctgtctatct caaaagtact agcgttattt    66540
gcatttgctt gccattgaac gaattcatta gggtctttac tatcacgagg tttaagatag    66600
tctgtttgaa caatatcact atctttaaga ccttttagtat tattatcaac aataatacct    66660
aaacctgcta atagtgttag tatagaacct acaatattta caccttgctc aatttgagct    66720
gagtagtcta aaccgaaagc acctgtaatt tggttagcaa ataatgctac tgctgatata    66780
attgctaccc aaaatgtttt gctcttagtt cttgtgctaa ggtttattcc tccaacaact    66840
ttaggttgtt tagtttcatt agccattaaa aaaccgacct ttctattata tttatttcta    66900
acaataatat aacagtaggt cggtcatgtt tatctatatt aatttaacac ttactcatta    66960
atttggttta gttttttgat aacttcagac atttgtttgt tatctaaatc ttctaattta    67020
gtttcaggaa gtagctctaa cttatcccaa acttcttctt tattagatac tttattatta    67080
ataattgcct taccaactaa actttccgta taatataatt gttttgctga tgccatttgt    67140
atctctcctt ttaaatatgt aaagtatata gctagtatcg tatcctagga acaaacactt    67200
gcgctatata ctcaatgaaa tcctaccctc attcgaggac acagcaaacc ggttcgtcaa    67260
```

FIG. 21KK sequence.txt

| | | | | | |
|---|---|---|---|---|---|
| ccgcacatat | gaattctcag | atttcatttta | tgtaaaacac | accctctttg | atttgcacaa | 67320 |
| agactaaggg | ttttggagac | ccttgtacta | ctaattatac | taagggtgtt | tattatggtt | 67380 |
| tctattggat | ttgaaccaat | gacacctaga | gcttcaatct | agtgctctac | catctgagct | 67440 |
| aagaaacctt | aaaacgaccc | atacgagact | cgaactcgta | ctctctgccg | tgacagggca | 67500 |
| gtgtgttaac | cagttacacc | aatgagccaa | aattataatg | ctatacccta | accttacctt | 67560 |
| aatgtatagc | aggtttttat | ataagctcga | agcaacgatt | attaccactc | ataacaacta | 67620 |
| tatattaagt | gaaaggaggt | gaaatgaaca | aaacgtggta | attggtactt | atataggaaa | 67680 |
| tatgtataat | ctacaaggag | taagttattg | gttcataaag | gagtgtgaac | aataaataca | 67740 |
| tgaaagagtg | aaagtttact | ccctgtagat | tcttttttaa | ttatcaatca | aaggaggaaa | 67800 |
| ctgataattg | ttaataataa | actataaaga | ggaaaatatt | tatagtcaca | ttctgatata | 67860 |
| atgcaactaa | atatccaagc | ataacccgtc | tcacgaggaa | cctacctata | agacctgtta | 67920 |
| ttaagtgaat | cactacgatt | gactctatta | aggagctacc | ttaagtccat | ctcacgcaat | 67980 |
| ttaaaaggga | cttacaaacc | gtaaacggt | aataagttta | ttaaataatg | tgatattaac | 68040 |
| atattagtta | ataactttca | catggtcgaa | gaaaagtaaa | tttatttgat | taccaaatta | 68100 |
| tttttatcaa | atatagctct | tttgaacctg | tagatttatg | ctactcatac | tgataaacctc | 68160 |
| tattatctaa | cacatttctg | tgctccaact | acagttagtc | gttacagcgt | atctttctag | 68220 |
| gattccgcta | agacccctaga | aagaaattaa | accctagccg | ttatcatact | ctacagacct | 68280 |
| tataagtaag | taccaagtat | accaatcgta | tttaacaata | ctaatgacga | cccatcctac | 68340 |
| cgatatatct | ccgataggtt | ttgattcgtt | tgattatctt | gtaccttatg | actaccaaat | 68400 |
| cattattcag | tcactatgct | cagatattta | gttgtattat | ttatatatta | attataacat | 68460 |
| aattttatt | acttgtcaag | ttaatttaa | aaaaattat | agaagtaggg | acgtttacct | 68520 |
| acttccattt | aatttacaca | aggatgataa | cattgttatt | gttttatact | ggaaaacaat | 68580 |
| gtaataaaaa | cagtgatgtg | taaggtattt | gttttattgt | taattacatt | atagcatata | 68640 |
| ctgataccttt | tgtcaagtta | atttaatact | ttttttaaaa | tattagttat | cttttgttaa | 68700 |
| ttcttcctga | atagcatccc | atcttctttc | tgcttcacta | cgattatctt | ctatatgctt | 68760 |
| tgtagtttta | caacatttaa | tacaatatat | atctttgata | tgaccttctt | ctctttttatt | 68820 |
| tgctcttttt | cttggtactt | tgaatacatt | tccacattct | ttacatatta | aacttgagta | 68880 |
| aaacattttt | tgtcttttca | taattaatca | attccttttc | tcttttattt | gataatttaa | 68940 |
| ctatatacta | tactgataaa | taagtcaaca | gttttctaaa | aaataattta | aattattttg | 69000 |
| aagaatcctt | taatatcagt | acttacaaga | gaaaaagtac | gtatttagaa | aataaggagt | 69060 |
| actcctatta | tatataatta | tattctgata | tacagtaatt | aataatatta | aatatataat | 69120 |

FIG. 21LL sequence.txt

```
tataattaat agggttggga aaattgatat aaacataact gatactgttt ataaatactc    69180
agtataaaag taaaatccct tagtatcagt acttacaggc aaaaaagtac gtatttagaa    69240
aataaggagc tctcctatta tagttatata tatatattta ttactattat taattactat    69300
ttaaatatat aattataatt aacaatgtta gaaagtcaac aatagcataa ataaaaaagt    69360
gactacttaa agtcactcaa taattagaat actattttaa aagattctat tctgtttgga    69420
ttaatatata cttgaggtga agttatagca cttcagtat atacttttat agaggtttca     69480
tccattcctc ttaacatata atctatatct tgcctattgt aactcttttc atcagtagat    69540
actaaaaagt atttagctcc acttgacatt gttatttcaa tatgttttga catctacaat    69600
ctctcctatg caaatttgtt aaagacaaag gataatatag ctcctagaac aagtaaaaga    69660
accttctcag ttgtatcctt tttcttagta tccttagttt ttgtactttc agcaagttct    69720
gaaatctttt catcaagtct ttctaattgg acgtaaattg ctgattgttt ttcactattg    69780
acagctacat ctttatctat actaactatc attttctta gttcagctac ctcaacttct     69840
aaatctttga aagttcctct atctatataa ttaccttctt gtatcttaga cttaatagtt    69900
tctacttgag aaacaaggtt gtttatctcc ttatccaact agaatcacct ctaaggtcta    69960
accgtttcag attcagaatg gatatcataa ttttctaaga aatcattgat aatctccata    70020
taattatccg taacgacttt tccgtaagat gtttttgtat caatttcgaa tctaagttta    70080
ccgaagtctt ggaggtctaa ctctttatt acaatattcg ggtcatcaga aggaaggtaa      70140
taatagtcga agtatataat tgagccattt attagtagac ggtctattct atacatatga    70200
aagaatcttc tgtctcgttt gaaatgagct agtgaatctt taaactctaa cttaagtata    70260
tccttatatt tagtcaaagt ggtaacctcc ttactattaa ttttaaatt tacttatttt     70320
gtgttataat agttatgata aaggcagtta ttataattat attaagaata aagataataa    70380
ttatttttc tgagaaaata agccaaatac tacaaacaga taaaacatag atagctgata     70440
gatatactat attaatagtt accttacttt tatcttttct atagataaaa taacctaaag    70500
aagttgtaac accactaagt ataaataat agaaacaaaa aagaggtata gacagaaaaa     70560
aagatacgat aatcattgtt aaacacctat ttcttttga cctattattt ctagaacttt     70620
tagattatac cactaatata acattaaaag ccagtcataa aagtcaattg ttagattaat    70680
aatataataa aaaagacaa taggaggtta agtggttga ataataacat agctatattc      70740
atattcaaaa cattggttat cattatattc ttactgctat ttttgtctgt tgttaattcc    70800
ttatccctta tttactcaat aagaccgagt gtagttatgg catactttac ctttggaggt    70860
attgtttctg atgtcgcact tactatgaca gataagttct tacttaagaa agaagaccct    70920
ctacctgagt atgttcttaa aaaagtagag ataaatgata aagaaataag cataattaag    70980
aaaatcatag aaagtaatta tgatataaca tcagaagaga taaaagttag agctaaagca    71040
```

FIG. 21MM sequence.txt

```
caacagagat tagaggaaga tagcaaagag gaagataacg atgaaaacga agaaagaaat      71100
taaagaacaa aggaaagaac ttaaagacgg tgctacaact gtttctttag taaaaaaagg      71160
ggataagaga atagctagcc ctagtagaat ttgtagttta tgtggtcagc agttatcagg      71220
tatgagttac actaaaggaa aagcattatc aaaagttaat cattttcatt tacagtactc      71280
taagtacatt tattttgata tttgtgcaga tattaacaat tgttataaaa atttaagaaa      71340
acgaggtgaa atggattgag tgcagaaaat attagagata taattaataa gaaaaagtta      71400
gaagaagagg atacaagaaa atatatagct gatggattta tgaatggtat cggtaaatta      71460
atgtatgaat tcaataaaaa agtagataat aaagaaatag aagttaaaga ccctaacgat      71520
ttatataaac tatttgtgat attctctcaa atgcagaata tggttaatga aacttctgaa      71580
ggtggagcaa tacctcaact atctagacct caacaagaat tatttgaaga gattacaact      71640
gaagatagta atggggagtc tactgtagac ttacaaaaaa tatcagaaat gtcagcagaa      71700
gatattacag aaatgatttc tgaaaaagag aaagtaatga atgaggaaaa ttcaaaaaca      71760
ttctaagggg aaagatataa catggatgga aaagaactaa ttaaaatagc acaagaaaca      71820
tttcaaacag aaaaaataac aagagagcag atagaccata taatcaatat gttaaaccct      71880
tctacctata tgcttaagta tcacacgcta agaggtcacc ctataacttt cagtattcct      71940
aatagggata gaagtaaagc acaagcacac cgaccttggc aagtccgtaa acatactatg      72000
cggactataa accttttcta aaattggaaa ctcctaacaa gtgaagttga ggacaatcaa      72060
ttgctaaatc gtaactaaga taaatatttt aattacgtaa atgcctaacg actaaatttc      72120
caagtaagca ataaaatggt attgtgtaga attggaagag agggaaaccg taacgaaaag      72180
gacttttacg cctaactgta aagtatgat atagtctaat cccctaataa atatcgggaa      72240
accgagggta gtaaatgata gtaaatgaca ctcatccaaa caaagcagtt attaaaagca      72300
gacaattggg gcttagtgag atgggtgtaa tggaaatggt tcattttgca gatatgcata      72360
gctatgccaa tgcaaaatgt ttatatacct ttaattagag aggcttcacg tagcaatgcg      72420
tgttgaaaaa ccttgttaaa cggggaaacc cctaacgtaa agacgagggc aatcccgtgc      72480
taaatgttga ctaacctaat attatatgat atattagtta tagtcagcta aatgccgaac      72540
gactaaattt ctaggtaggt atctaaatgg aggtactgag aactagataa aaaaactact      72600
taaaataatt agacttaaaa aaatactgtt ggaaggagga tatttaatgg gaaaaaaatt      72660
aactaatact gagttttaa atagagtatt tcagttagtt agtgatgaat actcatttt      72720
agaagagtat aaagggagac ataccaaatt aagatgtaaa cataatttat gtagttacga      72780
gtgggatgta gaacctggag cttttttagg taataagaac aaagcaggaa gtagatgtcc      72840
tagttgttat ggtaatgtta ctaaaacaac agataaattt aaaaaagaaa tatacaattt      72900
```

FIG. 21NN

```
                                        sequence.txt
aactaaagat gaatataggt tactttctga gtatattaat gctaaaacaa aagtaaaaat      72960
taaacattct aaatgtggta atacttttc tatgacacct aatacttta taaatggaag       73020
tagatgtcct gaatgtaacc ctcaaaaacc gtataataca gattctgcta aagataggat     73080
aaataaagaa acgaatggta cttttgaact agttagtgaa tacaaaggtt gttatgagct     73140
tatgaagtta aagcatcatg aatgtggaaa tattgtagaa ataaatatgc agagtattga     73200
tagcaataga ctaaattgtc cttattgtta taataggtct agaggtgaat tactagtatc    73260
ctcatttctt cttcaaaaa acataccatt cgaagtccaa aaaagatttg atgggtttaa     73320
gaaatatcct tatgattttt atatagctga ttataatacg gttatagaat atcatggaga    73380
acaacattat aaacctatta agttttatgg tggagaagat agattggtaa ggcagaaaaa    73440
tatagattta aagaagaaaa attttgttga gggtaaaggt ataaattact tagaaatacc    73500
ttacacatta aacaatcaaa ataaagtaaa tgagttttta attaattatt ttaagtagaa    73560
gtaaagcaag gaacccttaa ccaaacttaa gggttatgat atagtctaaa ccgtatataa    73620
atactaggaa actagcggta taattgtcct acaaatgaac aaatgaagaa atttgttcag    73680
tctcgtttaa atcctgtatt agaaaagaa tattttaggg atattgttga ttgggataaa     73740
gactctttag gttttaaaaa gataagaaat tctagtttat tctttagaac aagttctaaa    73800
gcaagtactg tagagggtgt ggatattgac tatttatctt tagatgagta tgacagggta    73860
aacttattag cagaatcgtc tgcactagaa tcaatgtctt catcaccttt taagattgtg    73920
agaagatgga gcacaccttc tgtaccgggg atgggtatac acaaattata ccaacaatca    73980
gaccaatggt attacggtca tagatgtcaa cattgtgatt acttaaatga atgagttat    74040
aatgattaca accctgataa tcttgaagaa agtggaaata tgttatgtgt taatcctgaa    74100
gggtagatg agcaagctaa aacagtacaa aatggtagtt accaatttgt ttgccaaaaa     74160
tgtggtaaac cactagatag atggtataat ggtgagtggc attgtaagta ccctgagcgt    74220
acaaaaggta ataaggggt acgaggatac ctaataacac aaatgaacgc tgtatggatt    74280
tctgctgatg aattaaaaga gaaagaaatg aatacagaat ctaaacaagc attctacaac    74340
tatattttag gttatccttt tgaagatgtt aaacttagag ttaatgaaga agatgtttat    74400
ggtaacaaat cacctattgc agaaacacaa ttaatgaaac gagatagata ttctcatata    74460
gctattggta tagattgggg aaatactcac tggataactg ttcatggtat gttacctaat    74520
ggcaaggtag acttaatacg attattctct gttaaaaaaa tgacaagacc tgatttagtt    74580
gaagcagatt tagaaaaaat aatttgggaa atatctaagt acgaccctga tattataatt    74640
gcagataatg gagactcagg taataacgtt ttaaaactca ttaatcattt tggaaaagat    74700
aaagtatttg gatgtactta taaatcttct cctaaatcta caggacaatt aagacctgaa    74760
tttaatgaga acaataatag ggttacagtg gataaattaa tgcagaataa aagatatgta    74820
```

FIG. 2100 sequence.txt

```
caagcactta agacaaagga tataagtgtt tatagtacag tagatgatga tttaaaaact      74880
ttcttaaaac attggcaaaa tgttgttatt atggatgaag aagatgaaaa aactggagaa      74940
atgtaccaag ttatcaaacg taaaggtgac gaccactatg cacaagcaag tgtttacgcc      75000
tatataggat aacaagaat aaaagaactt cttaaagaag gaaacggtac aagctttggt       75060
tctacatttg tttctactga ttacaatcaa gaaggaaata aacaattcta ctttgatgaa      75120
tagaggtgaa atagacttga cagataaatt attttatggt acaattagta atgaagaaat      75180
taataaaagt gtattgaatt tgttattggg tgaggaatta tccttagatt atgtttctaa      75240
aaatagtgat actttagatg ttaaatatga acatgtctat aaatctctag gattcgataa      75300
tttctttgat tgttttttat atgctaatag agagcctgaa atagtccaca aaggtggaga      75360
taaaaatctt ggtggactaa ataaggttaa acgtactgtt attcgtaatg gtaaagaaat      75420
ggaaatgaca gtttacgaag acggtaataa agagaacgat agtaaagaaa aacaagaagg      75480
aaaagaagaa gttagtagaa gtgcagtagg agcaagagct atttctaatg gtgaagaagg      75540
aaaggtaaac cctaaaaaag tagcaaattc attatctagt ttaagtaaaa agggtgtaga      75600
tgtatcccat attaatacaa acttatcatt gtataaagag tttgttgatg ataacggtga      75660
tacattagga attacatctt ttaaacgaac tgaaaatgat ataatattag aatcttatgc      75720
aagttcacct gattcagatg gtgtaggagc aagagctatt atggaattat tacgtttaag      75780
tattaaggaa aataaaaatg cagttgtgta tgacatagaa ttacctgaag cagtagagta      75840
tttaaaaact ttaggattta aacctaataa agatgggtac atcttaagaa aaaagatgt       75900
aaaacaattc ttaggtgatt atagtgattt tatttagcac tatagtcatc tattctattg      75960
tatttattct atatattgta ttaaaaacaa tttatataaa gtctaatatg agtagaatag      76020
ataacacaac tgaattatta aaaatattac aggaagatat tgaaggtaag ataaaaaagg      76080
aaggaagaaa taaatgactt tagaagaaaa taaattaaca ttagaagaat caataactcc      76140
acttagtaaa gaggagaaag aagatagtat taaagaattt agtagtttat tatgtgaaat      76200
ggtaaatagg ctatacaagt cttataatgt atttagacaa gaccctatgg atgaaactca      76260
acgtctagat ggctctttaa tggtctttca aagtagatta aatgacccct taacaggaga      76320
tttacatgat aagatgtata aacttgcttt ttcaaaacgt attgatattt tcgaagctaa      76380
taagcaattt agaaaagatg tagaagcagg taaagcaatt gagttaggtg atgtagctat      76440
tatagataca gcattaagta acatcctttc aggcaatgag ttccaaggaa gtatttcatt      76500
tatgcttaga aaagactttg aagaaaaaga acgaattaga aaagaagaag aagagaaact      76560
taataactta taaaagggaa gaattatgag actatataaa atgaggtatc ataattgaaa      76620
aagaaaccac aaggcaatga ggtaatcata accataataa cggttatgat agcagtattt      76680
```

FIG. 21PP sequence.txt

| | | | | | |
|---|---|---|---|---|---|
| gtagtcatta | tgaccatatt | ttttaataaa | tatcaagatg | ctaaagaaga | taaagataga | 76740 |
| tatcaaagat | tagtagagat | ttataaaaaa | gcagatgata | atgatggtga | gactaaaaag | 76800 |
| aaatatgtta | aaagattaaa | taaggctgaa | gaagaactta | aaaaagtaaa | aaaagaaaca | 76860 |
| aattataaag | attataataa | gaagtcaagt | aaagaaagac | aaaaagaaga | taaagaaact | 76920 |
| agagagaaaa | tatatgatgt | aactggtgat | gatgacttaa | tattagtaaa | aaataatatt | 76980 |
| gattttagtg | ataaagtaga | caagcccgaa | atacttatta | gtgaagatgg | aattggtacg | 77040 |
| ataactgttc | ctgtagatag | tgggtatgaa | aaacaaacag | taggttctat | tattactagt | 77100 |
| gtattaggtt | ctcctttcct | atcacctggt | tcaaatagta | tagatggttt | aagtgttatt | 77160 |
| aacgataatg | tttatccaaa | tacagtagat | agcatagtag | aagatacaaa | accttctatt | 77220 |
| aacttaccaa | tggataatcc | tattataaca | aatccggttg | aaccaactat | accttcagat | 77280 |
| actatacctc | ctattgataa | tccttcagtt | ccggtatttc | ctgagaatcc | agtagataat | 77340 |
| aatcaaggaa | atacagataa | tccaaaccca | ccgcctccag | gatatacaga | tgaagatggt | 77400 |
| ggaaggggct | ccggtggtgg | aggaaattct | gaaccaccat | caacggaaga | accttcggat | 77460 |
| aatggtaaca | ctggaggagg | agattgggaa | gaaaaacctg | acccaggaga | agaaccttca | 77520 |
| gataatggta | ataccaggagg | caatggtgga | gaagttacgc | ctgaacctga | ccctacccct | 77580 |
| tctgaacctg | aacaaccgaa | tgaaaattct | gatgaaggta | atgaagaaaa | accatctgaa | 77640 |
| ccgtctgaca | atcctgatga | aaatggagga | tgggaaactg | aaccaactga | acctgagtca | 77700 |
| ccttcagagc | cggacgataa | agtggacgaa | gaggataaaa | atgaagatac | tacagatgat | 77760 |
| aaacagccca | ctgaacaacc | ggacgataac | aacatagata | atgaagataa | aactgaagag | 77820 |
| gagtaattac | tcctcttttt | tgtttgctat | attaaataag | agttaaatat | aaaaaaaatt | 77880 |
| gaacattacg | gtggtgaaaa | ctttgttagg | aatgaatatt | ataacgtcac | tatcagtagt | 77940 |
| atttacctgt | ttaagtctttt | taactttaat | gattttttgtt | catagtaagt | tctctagtaa | 78000 |
| aaacgttttt | gttttgtatg | taatttatgc | tataatagga | ataggtacat | acatagtttt | 78060 |
| aactatgttt | caaacaacat | ctgtacttat | taagaatgat | gtaatagatt | ccatagaaaa | 78120 |
| tactgaacat | tatattggat | tcaatgaccc | tataattata | tttactataa | gttttatagg | 78180 |
| tgcaatactt | ggaggaattt | ggtacaagat | gatgaaaatt | attaaaaaga | gtaactttaa | 78240 |
| agataaaaaa | taaaaaagac | ggtgaatagg | ttgatattct | ctaaagataa | aaaatgggat | 78300 |
| gaagcaaaag | atttcatcaa | aggtcaaggt | atgcaagata | attggataga | gattgtagat | 78360 |
| tattatagac | agataggtgg | aaaacacgta | gctgttttta | ttgctttaaa | caaagtaaaa | 78420 |
| tacatgattc | tagaagcaac | aaaagacaat | aaagtaatat | tagtagataa | agataataat | 78480 |
| atactattag | aagattatga | tattgttatg | gaaagtaaga | agatgttttta | ttacattgaa | 78540 |
| gaaccgttcg | aggttaaaat | aaatatccct | caacatatta | gagatgtaac | ttataataat | 78600 |

FIG. 21QQ sequence.txt

| | | | | | |
|---|---|---|---|---|---|
| actgttgtat | taactacagt | aagagggagt | agaggtgact | agtaattggc | agatttattt | 78660
| aagcaattca | gattaggtaa | agactatggt | aataatagta | ccattgctca | agttcctatt | 78720
| gatgaaggat | tacaagctaa | cattaaaaaa | atagaacaag | acaataaaga | gtatcaagat | 78780
| ttaactaagt | ctttatacgg | acagcaacag | gcttatgcag | agccatttat | agaaatgatg | 78840
| gatactaatc | ctgaatttag | agataagaga | agttacatga | agaacgaaca | taacttacat | 78900
| gatgttttga | aaaagtttgg | taataaccct | atccttaatg | ctatcatact | tacacgttca | 78960
| aatcaagtag | ctatgtattg | tcaacctgca | agatattcag | agaaaggttt | aggttttgag | 79020
| gtaagattaa | gagacctaga | tgcggaacct | ggtagaaaag | aaaaagaaga | aatgaaacgt | 79080
| atagaagatt | ttattgttaa | tactggtaaa | gataaagatg | tagatagaga | ttcatttcaa | 79140
| actttctgta | agaaaattgt | tagagatact | tatatctatg | accaagttaa | ctttgaaaaa | 79200
| gtatttaata | agaataataa | gactagacta | gaaaaattca | tagcagtaga | cccttctact | 79260
| attttttatg | caacagataa | aaaaggtaaa | attattaagg | gtggtaagag | atttgttcaa | 79320
| gtagtagata | aaagagtagt | agctagtttt | acttctagag | aattagctat | gggtataaga | 79380
| aaccctagaa | ctgaattatc | ttcctcagga | tatggattat | cagaagtaga | gatagctatg | 79440
| aaagagttta | ttgcctataa | taacactgaa | tctttcaatg | atagattttt | ctcacatggt | 79500
| ggtactacta | gaggtatttt | acagatacgt | tcagaccaac | aacaatcaca | acatgcatta | 79560
| gagaacttta | agcgtgaatg | gaaatctagt | ttatcaggta | ttaatggttc | atggcaaatt | 79620
| ccagtagtaa | tggcagatga | tattaaattt | gtcaatatga | caccgactgc | taatgatatg | 79680
| caatttgaga | aatggttaaa | ttaccttatc | aatattatat | ctgctttata | tggtattgac | 79740
| cctgcagaaa | ttggtttccc | taatagagga | ggagctacag | gttctaaagg | tggctctact | 79800
| ttaaatgagg | ctgacccagg | taaaaaacaa | caacaatctc | aaaataaagg | tttacaacct | 79860
| ttacttagat | ttattgaaga | tttagttaat | agacatatta | tatcagaata | tggagataag | 79920
| tatacattcc | aattcgtagg | tggagatact | aagagtgcta | ctgataaact | taatattctt | 79980
| aaactagaga | ctcaaatatt | taaaacagtt | aatgaggcta | gagaagagca | aggtaagaaa | 80040
| cctattgaag | gtggagacat | tattctagat | gcttcattct | tacaaggaac | agcccaatta | 80100
| caacaagata | aacaatataa | tgatggtaaa | caaaaagaac | gtttacaaat | gatgatgagt | 80160
| ttactagaag | gagacaatga | tgattctgaa | gaaggacaat | cagcagattc | tagtaatgat | 80220
| gataaaagta | accctgaagt | aggaactgac | tctcaaataa | aaggggattc | aaacgtttat | 80280
| agaacagaaa | cttctaacaa | gggtcaaggt | aaaaaagggg | aaaagtcttc | tgattttaaa | 80340
| cactaataag | gaggtaaaat | taaatgtcag | ttatatataa | agataataat | tggattgatt | 80400
| taactaatgt | tccttatta | caaaaaggtg | atagtggata | tcgtaaagat | ataccaagga | 80460

FIG. 21RR sequence.txt

| | | | | | | |
|---|---|---|---|---|---|---|
| aaaattggaa | aaagtgttta | aatacagaag | taagtttttc | ttataaaggt | aaaaagggtc | 80520 |
| tattttatgt | aacttatcgt | aaggaagata | aaggaaaagt | taaagttgaa | tatgataagt | 80580 |
| atgttaagat | aatagaccct | catgatttaa | agacactaaa | tataaataaa | atagttaatc | 80640 |
| ctcctaataa | agctaagtat | cgtgagcagg | aagtaattaa | tggtgatact | gtaagaaata | 80700 |
| ttagaaaagt | taagaataca | ggaattgttt | atactatgtt | atgttcagag | tatgaagaag | 80760 |
| aatatgatat | aagagaaagt | gatttattaa | gagggagagg | tagcccttat | aaatcaggta | 80820 |
| gaaaagtatg | ttataacaat | tcattatatt | ctgttgaaaa | tttgagagaa | tatatctgtg | 80880 |
| atttagaata | tgctaaaact | gtaactaagt | tttcacataa | agatataaaa | tgcaagtgcc | 80940 |
| ctatatgtag | tgaagagaaa | gttatgaagg | ttaataaatt | agttaataac | ggttttctt | 81000 |
| gtcatagatg | tagctcaact | ataacatatc | ctgaacgatt | aatgatagga | ttactagaat | 81060 |
| taaataattt | aaactatgaa | tatcaaaaag | tatttaaaga | cctacctaat | agaaaatttg | 81120 |
| atttttattt | acctaaatta | aatatggtta | ttgaaactca | tggattacaa | cattataggg | 81180 |
| aattaaatgg | ttacatgaat | catgaaaaaa | caaaggaatc | ggatttagag | aagtataact | 81240 |
| attgcaagaa | taataatata | gattatattg | aaatagattg | tagttacagt | gatttatcct | 81300 |
| ttatattaag | taatgttgag | aatagtaagt | taaatagcat | acttaaaaat | aagaattacg | 81360 |
| ataatcttag | caattatatt | ataagaagta | aaaatgatga | tgttaagtat | aatatatatt | 81420 |
| tggattactg | caaaggatta | agcaagaaag | aattgaaaga | taaatataat | aaaacgagtt | 81480 |
| attatataaa | caggtctatt | gagatattta | aacattaatt | aataagccta | gaataaatct | 81540 |
| aggctttgtt | tattttttt | gtaatttaat | tttgataaat | gtaataacta | tggtatacta | 81600 |
| tatgtaattg | atattaatac | ataaaaaata | ttaatatttc | acttacaagt | tattattgtt | 81660 |
| atattattaa | cgtaaaagta | aataaaataa | caagtggagg | tgtagacacc | tttggaagaa | 81720 |
| ataaaattta | atgcttttgt | acctatggat | ttgaagaaat | ctgtatcaac | agcttctgat | 81780 |
| actaatgagt | attctatcgt | ttcaggatgg | gctagtactc | caagtatgga | tttacagaat | 81840 |
| gatatagtta | atcctaaagg | aatagatata | gagtatttta | agtcacaagg | gtacattaat | 81900 |
| tatgagcatc | aaagtgataa | ggttgtaggg | atacctacag | agaattgcta | tgtggatata | 81960 |
| gaaaaaggtt | tatttattga | agcaaagcta | tggaagaatg | acgaaaatgt | tgttaagatg | 82020 |
| cttgatttag | ctgagaaatt | agaaaaatca | ggtagtggaa | gacgtttagg | tttttctatt | 82080 |
| gaaggtgcag | ttaaaaaacg | taatataaat | gacaatagag | ttattgatga | agttatgata | 82140 |
| accggagttg | cattagttaa | aaaccctgct | aatcctgaag | caacatggga | aagctttatg | 82200 |
| aaatcatttt | taactggtca | tggtacatca | cctgacactc | aagttgatgc | aggagcttta | 82260 |
| agaaaagaag | aaatagcatc | tagcattaca | aatttagctt | acgtcactaa | gattaaagat | 82320 |
| ttaaagagt | ttaatgatgt | atggaatggc | gttgttgaag | atttgagtaa | atctaatagt | 82380 |

FIG. 21SS sequence.txt

| | | | | | |
|---|---|---|---|---|---|
| atgggatatg | aggaatcagt | ccttacgtta | caactagcta | aaggtttatc | tcgtaaagat | 82440 |
| gcagaactag | cagtaatgga | tataaacaaa | caaaaactag | aataggtaag | gagaatacat | 82500 |
| tctatgagta | aagaaatgca | aaatatttta | gaagagtatg | ataagttaaa | tgctcaagag | 82560 |
| gcagtttcga | aatctgtaga | agatgatgaa | aagaatacag | tagaatctac | cgaagagcaa | 82620 |
| gtagcagaaa | caactgaaga | acctgctaaa | gaacctgaaa | aagtatctga | ggaagatgct | 82680 |
| aaagaagcac | aagagcaagg | tgaaaaagtt | gaatctgaag | aggtagcaga | ggacaatgaa | 82740 |
| gatgaggaag | ttgaaaaatc | agctaaagaa | tcaaaagacc | ctgtagacca | aaaagatact | 82800 |
| aagacagaaa | ataaagacaa | cgagaaacgt | aaaaataaaa | aagataaaaa | agaagattct | 82860 |
| gattctgacg | atgaagataa | agatactgac | gatgataaag | ataagaaaga | agataagaag | 82920 |
| gaaaaaactt | ctaaatcaat | ttctgatgaa | gatatcacaa | cagtatttaa | atctatctta | 82980 |
| acatcttttg | aaaacttaaa | taaagagaaa | gaaaactttg | ctactaaaga | agatttaagt | 83040 |
| gaagttagta | aatctattaa | tgagttatca | gcaaaaattt | ctgaaatcca | agctgaagat | 83100 |
| gtttctaaat | cagtagacac | tgatgaagaa | gctgtagaaa | aatcagtaac | atctacaaat | 83160 |
| ggagagcaag | aaaaagtaga | aggttatgtt | tctaaatcag | tagacactga | agaacaagct | 83220 |
| gaaactggtg | aagcaaaatc | agaagaagct | gaagaagtac | aagaagataa | cacatttaaa | 83280 |
| ggattaagtc | aagaagaacg | aactaagttc | atggattctt | acaaagcaca | agctaaagac | 83340 |
| cctagagctt | ctaaacatga | cttacaatca | gcttaccaat | cttacttgaa | cattaacact | 83400 |
| gaccctacta | acgcatcaga | gaaagatatt | aaaactgtaa | aagactttgc | acaaatttaa | 83460 |
| ttaatgcaca | aagttgtgtt | atattatacg | gtgtaactaa | agaatataaa | tagggtacat | 83520 |
| tttactgtac | cctacataaa | ataaaaagaa | cacaaatgaa | aggtgataaa | tttatatgac | 83580 |
| tatcgaaaag | aacctgtcag | acgttcaaca | aaagtacgct | gaccaattcc | aagaagacgt | 83640 |
| agtaaagtca | ttccaaactg | gttatggaat | cactcctgat | acacaaattg | acgcaggagc | 83700 |
| tttacgtaga | gaaattttag | atgaccaaat | cacaatgtta | acatggacta | atgaagattt | 83760 |
| aatcttctat | cgtgatatct | cacgccgtcc | tgctcaatct | acagtagtaa | aatacgacca | 83820 |
| atatttacgt | catggtaacg | taggtcactc | tcgtttcgtt | aaagaaatcg | gagtagcacc | 83880 |
| agtatctgac | ccaaatatcc | gtcaaaaaac | tgtatcaatg | aaatacgttt | ctgatactaa | 83940 |
| aaacatgtca | attgcatcag | gtttagtaaa | taacattgct | gacccatcac | aaatccttac | 84000 |
| agaagatgct | atcgcagttg | ttgcaaaaac | aattgagtgg | gcttcattct | acggtgacgc | 84060 |
| ttcattaact | tctgaagttg | aaggtgaagg | tttagagttt | gatggtttag | ctaaattgat | 84120 |
| tgacaaaaat | aacgtaatta | acgctaaagg | taaccaatta | actgagaaac | acttaaatga | 84180 |
| ggcggcggta | cgtatcggta | aaggtttcgg | tacagctaca | gatgcttaca | tgcctatcgg | 84240 |

FIG. 21TT sequence.txt

| | | | | | |
|---|---|---|---|---|---|
| tgtacacgca | gacttcgtta | actcaatctt | aggtcgtcaa | atgcaattaa | tgcaagacaa | 84300 |
| cagcggtaac | gttaacactg | gttacagcgt | aaatggtttc | tactcatctc | gtggattcat | 84360 |
| taaattacat | ggttctacag | taatggaaaa | tgaattaatc | ttagatgaat | cattacaacc | 84420 |
| attaccaaat | gctccacaac | ctgctaaagt | tacagctact | gttgaaacta | agcaaaaagg | 84480 |
| tgcttttgaa | aatgaagaag | accgtgcagg | attatcatat | aaagtagtag | ttaactcaga | 84540 |
| tgacgctcaa | tcagctcctt | ctgaagaagt | aacagctaca | gtatctaacg | tagacgatgg | 84600 |
| tgttaaactt | tcaattagtg | ttaacgctat | gtaccaacaa | caaccacaat | tcgtttctat | 84660 |
| ctaccgtcaa | ggtaaagaaa | caggtatgta | cttcctaata | aaacgtgtac | cagttaaaga | 84720 |
| tgcacaagaa | gatggaacaa | tcgtattcgt | agataagaac | gaaacattgc | ctgaaacagc | 84780 |
| agacgtattt | gttggtgaaa | tgtcaccaca | agtagttcac | ttattcgaat | tacttccaat | 84840 |
| gatgaaatta | ccattagctc | aaattaatgc | ttctattaca | tttgcagtat | tatggtatgg | 84900 |
| tgcattagca | ttacgtgctc | ctaaaaaatg | ggctcgtatt | aaaaacgttc | gttatatcgc | 84960 |
| agtttaatag | aataagaaaa | actgaataca | agagaatagg | gataaactta | gggtttatcc | 85020 |
| cttttttatt | aaaataaact | tgaagggatt | taataaatat | gttatactat | aagaaactat | 85080 |
| tagataaaaa | aatggctact | gtttatggta | cagtggagat | tgacaaagat | ggagtagtta | 85140 |
| aaggattaac | taaagagcaa | gaaaaagaat | ttgcaaatgt | tccaggtttt | gaatttgaag | 85200 |
| aagaaaagaa | aactactaga | aaacaatcag | cttctactag | taaagaagaa | gagcctaagg | 85260 |
| aagaggaaaa | gaaagcctct | actagaaaaa | ctacaagtac | tactagaaaa | tctacagcac | 85320 |
| gtaaaacaac | agccaaaaaa | gatgaaaata | agtaaagggt | gaattaaatg | gttaactcaa | 85380 |
| tgtttggagg | ggacttagac | ccttatgaaa | aatcattaaa | ctatgaatat | ccttatcatc | 85440 |
| ctagtggtaa | tcctaaacat | atagacgtaa | gtgagataga | taatttaaca | ttagctgatt | 85500 |
| atggatggtc | accggatgca | gttaaagcat | atatgttcgg | tatcatagtt | caaaatcctg | 85560 |
| atacaggaca | acctatgggt | gatgagtttt | ataaccatat | attagaaaga | gcggtaggta | 85620 |
| aagctgaaag | agcattagat | atatctatac | tacctgacac | tcaacatgag | atgagagatt | 85680 |
| atcatgagac | agagtttaat | agttatatgt | ttgtacatgc | ttatagaaaa | cctatattac | 85740 |
| aggtagagaa | cttacagcta | cagtttaatg | gtagaccgat | atataaatac | cctgctaact | 85800 |
| ggtggaaagt | agagcatcta | gcaggacatg | ttcaattatt | ccctacagca | cttatgcaaa | 85860 |
| caggacaatc | aatgtcatat | gatgcggtat | tcaatggata | ccctcaatta | gcaggtgtat | 85920 |
| acccaccatc | aggagcaaca | tttgcacctc | aaatgatacg | attagaatat | gtatcaggta | 85980 |
| tgcttccacg | taaaaaagca | ggaagaaata | aaccttggga | aatgcctcct | gagttagaac | 86040 |
| aattagttat | aaaatatgca | ttgaaagaaa | tataccaagt | atggggtaac | ttaatcattg | 86100 |
| gtgccggtat | tgctaataaa | acattagaag | tagacggtat | tacagagaca | ataggtacca | 86160 |

FIG. 21UU sequence.txt

| | | | | | | |
|---|---|---|---|---|---|---|
| ctcaatcagc | tatgtatggt | ggagctagtg | ctcagatact | tcaaataaat | gaagatataa | 86220 |
| aagaactatt | agatggttta | agagcttact | ttggatataa | tatgatagga | ttataaggag | 86280 |
| ggttagaaaa | tggaaaaacc | gtatatgata | ggagccaact | ctaaccctaa | tgttattaat | 86340 |
| aagtcaacaa | catatactac | tacaacacaa | gcagatgaac | aagataaacc | taagtatact | 86400 |
| actagactag | agtttgatac | gattgacatg | attaggttta | ttaatgaccg | aggtataaaa | 86460 |
| gtattatggg | aagaagcata | tttctgccct | tgtcttaatc | ctgatacagg | acatcctaga | 86520 |
| gtcgattgtc | ctagatgtca | tggtaaaggg | attgcatatc | tacctcctaa | agagactata | 86580 |
| atggcaatac | agtctcaaga | gaaaggaact | aaccagttag | atataggtat | attagacaca | 86640 |
| ggtactgcaa | taggtaccac | tcaattagaa | aagaggattt | cctatagaga | caggtttact | 86700 |
| gttcctgagg | tattgatgcc | tcaacaaatg | atttattttg | tgaataaaga | tagaattaaa | 86760 |
| aaaggtatac | ctctatacta | cgatgtaaaa | gaagtaactt | atatagccac | tcaagatggt | 86820 |
| acagtctatg | aagaagatta | tgaaattaag | aataatagat | tgtatttaaa | tgaaaaatat | 86880 |
| gagaatcata | cagtaacttt | aaagatactt | atgactttaa | gatatgtagt | atcagatata | 86940 |
| ctaaaagaaa | gtcgttacca | atatactaag | tttaatcaac | ctaaatcaaa | atttgaaaac | 87000 |
| ttacctcaaa | aattacttct | taaaagggaa | gatgttattg | tactacaaga | cccttataaa | 87060 |
| gttaatgatg | gtatagaaga | agacctagaa | attcaagtag | atgaccctaa | ggcttcggca | 87120 |
| tctaatccta | gtaatttagg | tggattcttc | ggaggtgcat | ttaaataatg | ccagttcacg | 87180 |
| gaaagagacc | taatttattt | aaaaataaaa | actataagca | ggtaggtaag | agaacaattg | 87240 |
| atggtatgcg | ttcagaagtt | cttgataaat | tacaagcaac | agcacagcaa | gtagagaata | 87300 |
| ctagtattaa | acgtatgcct | acttacctac | aaataacaga | gaaaagctt | gaaaagaag | 87360 |
| gagtagtaga | ccttaaaaaa | gcttttgctc | actcatctaa | aaagaaaact | agtaaagatg | 87420 |
| gcggatggta | tttaactgta | ccaatccgca | tcaaaactag | tagaatgaat | aacagtactt | 87480 |
| accaagatat | gagaacttta | aaagtagata | aaggtacagg | ttcagtctct | aagataactg | 87540 |
| attacctaga | aggacgtaga | aagaatgtaa | gccacccttc | aatgaagcct | gagcctatga | 87600 |
| ctcataatat | gactaaagtt | aaaagaggaa | agcaatcttc | ttactttata | tttagaactg | 87660 |
| tttctagtaa | gtcacctgct | agttcttgga | tacttaacag | agataaagtt | aatgaagata | 87720 |
| acttctctaa | aacaactcta | aaaactgtta | agcaattaat | gaactggaag | atgaaaaatt | 87780 |
| taaattaaga | ggagggatag | tattaaatgg | caataacatc | agttgattca | tatttattat | 87840 |
| cagaaataaa | gcctagactt | aacactgtgc | tagagaattg | ttatattata | gatgaagttt | 87900 |
| taaaagactt | tgattatcaa | actagagaga | gctttaaaga | agctttctgt | ggtaagaatg | 87960 |
| cacaacatga | agtaacggta | ggatttaact | tcccaaaatt | taaaaataac | tatgaagctc | 88020 |

FIG. 21VV sequence.txt

```
attacttgat acaattaggt caaggacaag agacaaaaaa ctctttaggg agtattcagt     88080
catcttactt tgaggcaaca ggagatacct tagtcgaatc ttctacagca ataagagaag     88140
atgataagtt agtttttact gtttctaaac caataggaga gttaataaag gtagaagata     88200
tagagtttgc taaatacgat aatcttcaag ttgaaggtaa taaggtatca tttaagtatc     88260
aaacaaatga agattatgag aactacaatg ctaacattat atttaccgaa aagaaaaatg     88320
attctaaagg tttagtaaaa ggattcacag ttgaagaaca agtaacagtt gtaggtcttt     88380
catttaatgt agacgttgca agatgtttgg atgctgtact gaaaatgatt ttaatatcta     88440
tgagagatag tatagaagag caacaaacat tccaattaca gaatttgtct tttggtgata     88500
ttgcaccaat aatagaagat ggtgactcaa tgattttttgg tagaccaaca attattaagt     88560
acacaagttc tctagatttg gattatacta ttacacaaga tattaataaa ctaacttttta     88620
aagaaagaaa ggattggaag taggatggct agaaaaaaga cacctgaaaa taacactcct     88680
aaatttaatg gttatgttca tatagataca ttccttgata ctgcaaaaac ccttttttaat     88740
atgaaggatt cacaagtagc aggatttaaa gcttatatgg aaggtagtca ttatttgttt     88800
agtgagcaag aattcttacc atcattagag aagtatctag gtaggaaatt agatatataa     88860
taacattcag ataaggagaa ttaaatatgg cagtagaacc attcccaaga agacctatta     88920
cccgtcctca tgcatctatt gaagtagata cttcaggtat cggtggctca gcaggttcaa     88980
gtgaaaaagt attttgctta atcggtcagg ctgaaggcgg agaaccaaat acagtttatg     89040
aattacgtaa ctatgcacaa gctaaacgtt tattccgttc aggagaatta cttgatgcaa     89100
tagaattagc atggggttct aaccctaact atacagcagg taagatttta gctatgcgta     89160
tagaagatgc taaacctgct tcagcggaaa tcggtggatt aaaagtaaca tctaaaatct     89220
atggtaatgt tgctaacaac attcaagtag gattagaaaa gaatacatta agtgattcat     89280
tacgtttaag agtaatcttc caagatgacc gtttcaatga ggtttatgat aatatcggta     89340
atatcttcac aatcaagtac aaaggagaag aagctaacgc aactttctct gtagaacatg     89400
atgaagaaac tcaaaaagca agtcgtttag tattaaaagt tggagaccaa gaagttaagt     89460
catatgattt aactggtgga gcttatgact acactaatgc tattattaca gacattaatc     89520
aattacctga tttcgaagct aaattatcac ctttcggaga taagaactta gaatctagta     89580
aattagataa aattgaaaat gcaaatatca aagataaagc tgtatatgta aaagcagttt     89640
ttggtgactt agaaaaacaa acagcttaca acggtatcgt atctttcgag caacttaatg     89700
cagaaggaga agtaccaagt aatgtagagg ttgaagcagg agaagaatca gctacagtaa     89760
ctgctacttc acctattaaa actattgagc cgtttgagtt aactaagtta acggcggta     89820
ctaatggaga accacctgct acatgggcag acaagttaga taaatttgca catgaaggcg     89880
gatactacat tgtcccatta tcatctaaac aatcagttca tgcagaggta gcttcttttg     89940
```

FIG. 21WW sequence.txt

| | | | | | | |
|---|---|---|---|---|---|---|
| ttaaagaacg | ttctgatgca | ggggaaccaa | tgagagctat | tgttggtgga | ggattcaatg | 90000 |
| aatctaaaga | acaattgttc | ggtagacaag | catcattatc | taatccacga | gtatcattag | 90060 |
| tagctaactc | aggtactttt | gttatggatg | atggacgtaa | aaaccacgta | cctgcttaca | 90120 |
| tggtagccgt | agctctaggt | ggtcttgcaa | gtggtttaga | aatcggtgaa | tcaatcacat | 90180 |
| tcaaaccact | acgtgtaagt | tcattagacc | aaatctatga | gtcaatagat | ttagatgaat | 90240 |
| taaatgaaaa | tggtattatt | agtatcgagt | ttgttcgtaa | ccgtactaat | acattcttca | 90300 |
| gaatcgttga | tgacgtaact | acattcaatg | ataaatcaga | cccagttaag | gctgaaatgg | 90360 |
| ctgttgggga | agctaatgac | ttcttagtaa | gtgagcttaa | agttcaactt | gaagaccaat | 90420 |
| ttattggtac | tcgtactatc | aatacaagtg | cttcaatcat | taaagacttt | atccaatctt | 90480 |
| acttgggtcg | taagaaacgt | gataatgaaa | ttcaagactt | ccctgctgaa | gacgtacaag | 90540 |
| ttattgttga | aggtaacgaa | gcaagaattt | caatgacagt | ttacccaatc | agaagcttca | 90600 |
| agaaaatctc | tgttagcttg | gtttacaagc | aacagacatt | acaagcctag | tctaggtgac | 90660 |
| ggagtacctg | gattaggtac | tcctattaat | ataatttgaa | tactttagga | gagtgaatac | 90720 |
| agatggcatc | agaagctaaa | caaccgtcc | atactggtaa | taccgtccta | cttatgatta | 90780 |
| aaggtaaacc | ggtaggaaga | gcacaatcag | catcaggtca | acgtgaatac | ggtacaactg | 90840 |
| gtgtatacga | aatcggttct | atcatgcctc | aagaacacgt | atacttacgt | tatgaaggta | 90900 |
| caattacagt | agaacgttta | cgtatgaaaa | aagaaaactt | tgcagattta | ggatatgctt | 90960 |
| cacttggtga | agaaattctt | aagaaagata | tcattgatat | tttagtggta | gataacttaa | 91020 |
| cgaaacaagt | tattatctca | tatcatggtt | gctctgcaaa | taactacaat | gaaacttggc | 91080 |
| agacaaatga | aattgtaaca | gaagaaatcg | agttcagtta | cctttaacta | atagaggcta | 91140 |
| tgtttggtga | caagcataga | aaacacttta | aattgcgtga | aagtcttaaa | gactagataa | 91200 |
| ctacaacgta | actcgaaagg | gtaagcgtga | atgttgagaa | atcagaaaaa | atatctagta | 91260 |
| tagtataagg | ttaaatccta | agtacagtaa | aatagatgat | acgcaggcaa | gcctacaaat | 91320 |
| gtgggaagct | tcaacgacta | taataggtga | gtcttagtta | cacattaaga | ttatggtata | 91380 |
| gtctactccc | tttaaaatat | atcgaaagat | agggtacaaa | ggacagcatc | agataaagct | 91440 |
| agaacttaaa | tttcttatta | agaccaacaa | taaaagttgg | tcttatattt | tatacttgct | 91500 |
| ttgtctgagg | cagtgtgcta | taattaaaat | acaaggaggt | aataatatgg | gaaaaaatca | 91560 |
| atatacattt | aatattaaag | aaaataaaaa | taaatggtat | gaatggtgta | aactacaaaa | 91620 |
| cgtaaaacct | ttagtagaat | atgaaaatgc | acaacaaata | ttttattttg | aatttcttga | 91680 |
| aggtaaattt | aaaggactaa | taggaaaaac | atattgggct | agtataaata | gaggttctaa | 91740 |
| tatgcgtatg | agttgtttaa | catcagaaag | taaagataaa | tatttaaaaa | atttaggaaa | 91800 |

FIG. 21XX sequence.txt

```
aagaaaaggt atagaggtag tagaagacta taagggtggc agaaaattaa aacataaatt    91860
tatagtttta gaaggtaagt accaaggatg tgaaggatat ataactttaa atgatttaga    91920
gaatttaggt agagtagata atagaagttt atctgaaaaa ggaaggaaac aatactttga    91980
taaacaggca agacttagag attgtattat tctagagtac cctaaagact atagaataaa    92040
aactaaagat aagatagtag taaaagataa agaagggcat gttcataata ttattgttca    92100
ggactttttt gagaaatcat ctttattgga gttatcttgt gctagtgaag gagagaaaat    92160
agttaaagaa atacttacta aaaattctat aaaatttgaa aagaaaaat catttagaaa     92220
caaagaaggt aaagtacaaa gatttgattt ttatattaat gaaaataata aagaatatgc    92280
aatagagtac aatggtgcac agcactacat agattctaca ggatatctta agatactttt    92340
ggaaacaacc cagaaaagag ataaactaaa aaaagaatac agtaaagata aaggtataaa    92400
tttattaatt attccttaca caataacaga taagaaagaa atggaaaaaa ttattttaaa    92460
tttttttaaac aaataaccct tgacactccc tcaagggata tgttattata ataacaggtt   92520
aggagtaata agtatgaata ataggcaagc taaaataaaa ggatataacc aatttcatta    92580
ttatgatttt ccaacaacta aaggtaagtt taaagatata atgaaaagaa aatctagaac    92640
agaacttaaa aaagatttac aaaaagaaag gaagtattat cttgacaaat aagagaaaaa    92700
cgataggtaa gatgagtaac acaagagcaa catggaatat taatccggta actaaagtta    92760
aaaagataa aacaaaatat tctagaaaaa ataaacataa aggtcttgac aattataatt      92820
aactaaggta tattattagt ataacaaaaa aggagatggg tatatgagta cattttggtc    92880
agaaagaaga acaactaata aagataggca agttaaaaaa cattatactc aaatgagtat    92940
gtatgaaaga aagaaatgtg tagagttatt acaagagaca attactgaaa atagaattat    93000
taatttttaca cgacatagtg caaagaaagt taaaggtaaa ccaacaacaa atatacctaa    93060
attaataggt tttatttta aaaataagtt tgcctacgaa aatatcatag aatacaataa      93120
cacagattat aatggtaata ttgagaggag aattgttgtt aaacatccta agttataac     93180
tgtagaagga aaacctagct atcagttttt gacaattagt cttgaagatg ctagagttat    93240
tacagtatgg tacaacagtg tagatgatac acatagaaca ctagatttaa attattatag    93300
taaagacttg acaattcaat aaggaggtat tataatgggt atcacaatag taaatagtta    93360
ttttattctg tctaacatct tcctcatcat attaaccata ttaaatggta agggtactgt    93420
tacaagggaa tcactaacta tgagtaaaat attagtagta ataacatcaa ttcaattttt    93480
agcatgttta attattaatg gtatttattg gtcactaaaa ttttagaata aaagtattga    93540
caaattaaaa ctaataaatt ataataaagg tataacaaat taaggagaa gatataaaat     93600
gtcacaagat aaattaagag caatttacac agaaatgaaa gtagaattac acaaatttcc    93660
taaagaggta gatataacaa gtaaatcaac tgcaattgca atcaatcaga ttttagataa    93720
```

FIG. 21YY sequence.txt

| | | | | | | |
|---|---|---|---|---|---|---|
| attcaaaaca | ttaacagaac | aagcaggaaa | gattactaga | aaatatttag | aaggtcaaga | 93780 |
| aatattaact | attgattatg | agtattatga | ttcattacaa | gaatactata | tttacctact | 93840 |
| tagaaatagt | gaaaagattg | aacaaagttt | acaagaaatt | actaagcgca | caggtgaata | 93900 |
| tgtaaagtaa | ttttgattta | aaaacaaaat | atgatatact | atgtttaaag | tagtaagcct | 93960 |
| acactagtcc | gtgttatatt | aatattgaat | cggataagcg | taggctttat | taatatttaa | 94020 |
| aaaaggaagg | tatatcatat | tatggcagaa | gaaattaaaa | aggaacaaga | tgtacaagaa | 94080 |
| acaactaaag | aagaaaaaaa | agatgttagt | aaaatgacac | cggaagaaat | agataaatta | 94140 |
| aaatatcaag | acaaacaaga | aaaagaacaa | gttattaaca | aagttattaa | aggtgttaat | 94200 |
| gatacttggg | aaaaagaata | taactttgaa | gaattagact | taagatttaa | agttaaaatt | 94260 |
| aaattaccta | atgcacgaga | acaaggtaat | atatttgcgt | tacgttctgc | ttacttaggt | 94320 |
| ggtatggata | tgtaccaaac | agaccaagta | attagagcat | atcaaatgtt | agctacatta | 94380 |
| caggaagtag | gtattgaagt | tcctaaggaa | ttccaagacc | ctgacgatat | ttataactta | 94440 |
| tatcctttaa | ctgttatgta | tgaagattgg | ttaggattct | taaactcctt | tcgttactaa | 94500 |
| tagtatagaa | acattagata | aagatataga | acgattgggc | ggtatggaat | caattgttaa | 94560 |
| acaaccttta | tctagaaatc | tatgggctat | tatgaaagag | tttaatgttt | tacctactga | 94620 |
| gcaaagattt | aaggacttag | atgattatca | gatagagttt | attattggga | atatgaacag | 94680 |
| agatgtttat | gaacataaca | acaacttaa | acaagctcaa | aaaggtggaa | aattcgatag | 94740 |
| tcaattcgaa | gatgatgata | gtagttggtg | gaatgaatct | catgaagact | ttgacccagt | 94800 |
| acctgatttc | ttagatgctg | atgatttagc | acaacaggtg | gaagctaaat | tatccgatag | 94860 |
| agataaggaa | gaaagagcta | agagaaacga | tgcggagtta | aatgatgaaa | cagaaggact | 94920 |
| tactacacaa | catctagcta | tgatggaata | catcagacag | aaacaacaag | aattagatga | 94980 |
| tgaagtagga | aatggtaaga | ctagtgaaga | ggatgctact | atatcacaag | atagcgttaa | 95040 |
| taaagcacta | gaagacctag | atgatgactg | gtatatgtaa | agggtggtag | gtgatactac | 95100 |
| catccttatt | tttttaaaat | ggatggtgaa | taatgatggc | aatgaatgac | gattatagat | 95160 |
| tggtcttgtc | cggtgatagt | tcggatttag | agaatagtct | gaaggcaata | gaactttata | 95220 |
| tggattcttt | agagtctaag | aatattgatg | ctcctttaga | taatttctta | aaaaaattaa | 95280 |
| aagtaattgc | taaagaagtt | aaaaatgtac | agaacgcaat | ggataaacaa | gatggtaaat | 95340 |
| ctgttatatc | ttctaaagac | atggatgaat | ctattaaatc | cactcaatct | gctacaaaga | 95400 |
| atataaatga | attaagaaa | gctttagatg | accttcaaaa | agagaatata | tctaaaggta | 95460 |
| ttgcacctga | ccctgaagtt | gaaaaagcat | atgctaagat | gggtaaagtt | gtagatgaaa | 95520 |
| ctcaagaaaa | acttgagaaa | atgtcttcac | aaaaaatagg | ttctgatgct | agtattcaaa | 95580 |

FIG. 21ZZ sequence.txt

```
atagaattaa ggaaatgaaa accttaaatc aagtaactga agaatacaat aaaataagta      95640
aagattctag cgcaactaaa gattatacaa aacgattaag agctaatcgt aatatgacta      95700
gaggttacat ggagcgttca gaaggaacag gacgtttgac atatgaccaa ggtgcacgag      95760
ttagaagtga actaggtaaa ataagttctt atgagagcca aagaaaacaa aaccaacgta      95820
atttaggaca agcaagagag caatatagca actatagaaa ccaacaacaa gacttgacta      95880
aacgtagagc tagcggtcaa attaataagg cacaatatga acaagaatta gcttctatta      95940
aacaggaaat gaaagctaga gaagaactta tatctaacta cgagaaacta ggagcagaac      96000
ttgataaaac agtccagtat tataagggtt cagttcaaaa ggatttccaa tctagagatg      96060
tagaccaaca acgaggaaca tttggtagaa tggttcaaga acgtttgcca tctattggtt      96120
ctcatgctat gatgggtact acagctatgg ctacaggttt atacatgaag ggtgcctcat      96180
taagtgaaac taatagaccg atggttacat cattaggtca aaattccgat aatatggata      96240
tagattctgt aagaaatgca tatggagact tgtcaattga caacaaatta ggttataata      96300
gtactgacat gttaaaaatg gctacttcat atgaagcatc agtagggcat aaaagtgacg      96360
aggacacaat ggcaggaact aaacaacttg ctattggagg acgttcttta ggtattagag      96420
accaagaagc ttatcaagag tctatgggtc aaatcatgca tactggtgga gtaaattctg      96480
ataacatgaa ggaaatgcaa gatgcattcc taggtggtat taaacaatca ggcatggttg      96540
gtcgtcaaga tgaacaactt aaagcactag gttctatagc ggaacaatca ggagaaggaa      96600
gaactctaac taaagaccaa atgagtaatc ttactgccat gcaatctact tttgcagagt      96660
caggaagtaa aggattacaa ggtgaacaag gtgccaatgc tattaacagt atagaccaag      96720
gacttaaaaa tggtatgaat agttcttatg ctcgtatagc aatgggatgg ggaacacaat      96780
accaaggtct tgaaggtgga tatgatttac aaaaacgtat ggatgaaggt atatctaatc      96840
ctgaaaactt gacagatatg gctgatatgg ctactcaaat gggtggcagt gaaaaagaac      96900
aaaaatacct atttaataga agtatgaaag aaataggcgc taacctaact atggagcaat      96960
ctgatgaaat atttaaagat gctcaatccg gaaaactatc taaagaagag ttagctaaga      97020
aagctaagaa aatggaaaaa gaaggtaaaa aagaaggaga agataacgcc actgattata      97080
aagaatctaa atcaggaaaa aatgaccaaa ataaatctaa gactgatgat aaagcagaag      97140
atacttatga tatggctcaa ccattaagag atgctcatag tgctttagca ggtcttcctg      97200
cccctatata tttagctata ggagctatag gagcatttac agcttcacta attgcatctg      97260
caagtcaatt tggagcaggt cacttaattg gtaaaggagc caaaggactt agaaataaat      97320
ttggtagaaa taagggtggt agctccggcg gtaatcctat ggcaggtgga atgcctagtg      97380
gtggtggttc acctaagggc ggaggctcac ctaaaggtgg aggcactcgt tctactggag      97440
gaaaaatact tgatagcgct aaaggtcttg gaggattcct agtaggtggc gcaggatgga      97500
```

FIG. 21AAA sequence.txt

| | | | | | |
|---|---|---|---|---|---|
| aaggtatgtt | tggtggggag | tctaaaggta | aaggctttaa | acaaacatct | aaagaagcct | 97560 |
| ggtcaggtac | tagaaaagta | tttaatagag | ataatggtag | aaaagccatg | gataaatcta | 97620 |
| aagacatagc | taaaggtact | ggtagtggtc | ttaaagatat | ctataatgat | agtatatttg | 97680 |
| gtaaagaaag | aagacaaaac | ctaggagaaa | aagctaaagg | ttttggtggc | aaagctaaag | 97740 |
| gtctttatgg | taaatttgct | gataagtttg | gtgacggagg | taaaaatggt | atcctttcac | 97800 |
| aatcaccaaa | agcaggtgga | agtggcatag | ggaaacttgg | aaaacttgca | ggtggacttg | 97860 |
| gaaaggagc | cggagtttta | ggtgttgcta | cgtctgcctt | atcattaata | cctgctttag | 97920 |
| cttccggaga | tagtaaagct | atcggcggtg | aataggctc | tatgggtgga | ggaatggcag | 97980 |
| gtgcatcagc | aggagcttct | ataggagctt | tatttggtgg | tgtaggtgca | atacctggag | 98040 |
| ctttaatagg | tggagctata | ggttccttcg | gaggaggagc | tgttggtgaa | aaagtcggag | 98100 |
| acatggctaa | aaaagctaac | actaaagaag | gatggaacct | aggatggact | aatggagata | 98160 |
| aagatggtaa | gaataaattc | caagattctt | tattaggaaa | acctatatct | aaagcatgga | 98220 |
| gcggtataac | aggtctcttt | gataatgacg | ctgaagcatc | cgaagaagat | agtaaagata | 98280 |
| agaaaaaagg | tgttaaaggc | gttaaaggag | atactaagaa | gaaagaaaaa | atgacagcag | 98340 |
| aacaacttag | agaaaagaat | aaccaatctg | aaactaagaa | tcttaaaatc | tatagtgatt | 98400 |
| tacttgacag | agctcagaaa | attattgaga | gtgctaaagg | tattaatata | gatggaggaa | 98460 |
| cttctgatag | tggttctgat | agtggaggct | ctgcatctga | tgtaggtgga | aaggtgcag | 98520 |
| agaagatgta | caagttcctt | aaaggaaaag | gactatctga | taatcaggta | ggagctgtta | 98580 |
| tggggaactt | acaacaagaa | tctaatcttg | accctaatgc | taagaatgct | tctagtggag | 98640 |
| catttggtat | tgctcagtgg | ttaggagcta | gaaaaacagg | attagaaaac | tttgctaaat | 98700 |
| ctaaaggtaa | aaaatctagt | gacatggatg | ttcaattaga | ttacctatgg | aaagaaatgc | 98760 |
| agtctgatta | tgaaagcaat | aatcttaaaa | atgcaggttg | gagcaaaggt | ggaagcttag | 98820 |
| aacagaatac | aaaagcattt | gctactggat | ttgaacgtat | gggagcaaac | gaggctatga | 98880 |
| tgggtactcg | tgttaacaat | gctaaggaat | tcaagaagaa | atatggaggc | tccggtggcg | 98940 |
| gaggtggtgg | aggagcttta | tcctctactt | atcaagaagc | tatgagtaat | cctgtattaa | 99000 |
| ctactggttc | taattataga | ggctctaatg | atgcttctaa | tgcttctaca | actaacagaa | 99060 |
| taacagtcaa | tgttaatgtt | caaggtggaa | ataatcctga | agaactgga | gacattatcg | 99120 |
| gaggaagaat | tagagaagtt | ctagatagta | atatggatat | ctttgcaaat | gaacataaga | 99180 |
| gaagttatta | gtaatttgt | attgacacaa | gagtagtatc | atagtatact | actcttatac | 99240 |
| atataaaaaa | taaaggaag | tatgtgtata | tgcgtagaat | aagaagacct | aaggtaagaa | 99300 |
| tagaaatcgt | tacagatgat | aatacattta | cattgagatt | tgaagataca | cgtgactata | 99360 |

FIG. 21BBB sequence.txt

| | | | | | |
|---|---|---|---|---|---|
| atggtgatga | gtttggagct | aaacttttag | gattccaaac | taaaaactct | atggaagatg | 99420 |
| atagttcagt | tttccaaata | aatatggcag | gagatactta | ttgggataag | ctagttatgg | 99480 |
| ctaatgatat | cataagaata | tttattacac | ctaatgatga | ccccaacgat | aaagaaggaa | 99540 |
| gacaagaacg | acttatccag | gtaggtatgg | tttctcaagt | atcaaaagta | ggtagttacg | 99600 |
| gtaatgacca | aactcaattt | agaataacag | gtcaatcttt | tgtaaaacct | tttatgaaat | 99660 |
| ttggattagg | cgttattcag | gaagttcaag | ctgtattgcc | tgaagtaggt | tggcttattg | 99720 |
| atggtgatgg | agataatgaa | gtaaaattta | ctggtagctc | agctcatgaa | gtaatgactg | 99780 |
| gcattatacg | tagatttata | ccttatatga | aatataacta | tactgaaaaa | acatataata | 99840 |
| caattgataa | ctatcttgat | tatgatgatt | taagtagttg | ggatgagttt | gaaaaactta | 99900 |
| cagaagtttc | agcctttact | aattttgacg | ggtcattaaa | acagttaatg | gatatggtaa | 99960 |
| cagctagacc | ttttaatgag | ttattcttca | aaaattcaga | aaaaacacct | ggaaaggctc | 100020 |
| aacttgtatt | aagaaagacc | cctttaatc | ctactgagtg | gagagcttta | gatatgatta | 100080 |
| aagtacctac | tgaggatttt | atagaagagg | atgtaggtaa | aagtgatgta | gagacatatt | 100140 |
| ctatatttac | agcaacacct | gcaggtatgt | tgaaagagct | taacggtgat | gtattttcca | 100200 |
| aaccacaatt | ccatcctgaa | ttaactgata | gatacggtta | taccaaattt | gaagtagaaa | 100260 |
| atatttatct | tagtacaaaa | tcaggttcag | ccactgagga | ttcagattct | tcaggtgatg | 100320 |
| ataatggtac | agaacgagga | acttactcta | aaattatgaa | agatttaagt | aactatggaa | 100380 |
| gagataatat | atctaaaggt | atagataagt | atacaagtaa | attatcttca | aaatataaaa | 100440 |
| acttaaaaaa | agcccaagct | aaaaaaatta | tagagaagtt | tgtcaaagaa | ggaaaagtaa | 100500 |
| cagaaaaaga | atatgaaaaa | ataacaggta | ataaggtaga | tgatgaatta | acatcagata | 100560 |
| acagaccgaa | gttgacaaaa | gataaattaa | agagtatact | aaaagagaag | tttaaaacac | 100620 |
| aagatgattt | taataattct | aagaaaaaga | aaaagctaa | gacagatgca | cttaaagaat | 100680 |
| tgacaactaa | atatcgtttt | ggtaataaaa | cacatgctac | aactttgtta | gatgaatata | 100740 |
| ttaaatacaa | aggagaaccg | cctaatgatg | aggcttttga | taaatatctt | aaagctattg | 100800 |
| aaggtgttag | taacgtagct | acagacacag | gttcagatgc | aagtgatagc | cctctagtta | 100860 |
| tgtttctag | aatgttattt | aattggtatc | atggtaaccc | taacttctat | gcaggagata | 100920 |
| ttattgtttt | aggagaccct | aagtatgacc | taggtaaaag | attatttatt | gaggataagc | 100980 |
| aacgaggaga | cacatgggag | ttctatattg | aatctgtaga | acataaattc | gattataaac | 101040 |
| aagggtatta | taactgta | ggagtaacta | gaggtttaaa | agacgctatt | ctagaagatg | 101100 |
| gtaaaggtag | tcctcataga | tttgcaggat | tatggaatca | atcatcagac | ttcatgggag | 101160 |
| gtcttatggg | tgaagatact | tctaaagaac | ttaaagaaaa | aggtgtagca | gagaaacaaa | 101220 |
| gtagtggagg | taaagatggt | ggttctgata | gtggcggagc | tcaagatggt | ggctctttag | 101280 |

FIG. 21CCC sequence.txt

| | | | | | |
|---|---|---|---|---|---|
| attcacttaa | aaaatataac | ggcaaacttc | ctaaacatga | cccaagtttt | gttcaacctg | 101340 |
| gtaaccgaca | ttataagtat | cagtgtacat | ggtatgctta | taatagaaga | ggtcaattag | 101400 |
| gcattcctgt | gcctttatgg | ggggacgccg | ccgactggat | aggcggtgct | aaaggagcag | 101460 |
| gttatggtgt | aggtagaaca | cctaaacaag | gtgcttgtgt | tatatggcaa | agaggagttc | 101520 |
| aaggaggtag | cccacaatat | ggtcacgtag | cttttgtaga | gaaagtatta | gatggaggta | 101580 |
| aaaaaatatt | tatctctgaa | cataactatg | ctacccctaa | tggatatggt | actagaacaa | 101640 |
| tagatatgag | ttcagccata | ggtaagaatg | ctcaattcat | ttacgataag | aaataaagga | 101700 |
| ggatagtcta | tggcaacaga | taaagaagct | aaagatgtta | ttgataaatt | tatagacaat | 101760 |
| gtatttaatt | ttgatgtact | tacaaaagaa | agaataaaag | aaaaagatga | agaaattaaa | 101820 |
| aaaataacta | cagatgatat | gtatgaaaag | gttgtgtata | tacgacccta | cgttggagta | 101880 |
| atacaaagtc | ttaaccctca | acatgtgcag | tatgaatcat | tttctaataa | tggttatgat | 101940 |
| atagaggcag | aattaagttt | caggaaagta | agttatttag | ttgataaagg | gtctatacct | 102000 |
| acagattctt | tatctacttt | aacagttcac | ttagtagaac | gaaatcaaga | actattaata | 102060 |
| gattactttg | atgagataca | agatgtgttg | tatggagaat | atatggaaga | agaatatgta | 102120 |
| tttgatgaag | atgtaccatt | aagtacgata | ctagcattag | acttaaatga | taatcttaaa | 102180 |
| tccttatcaa | atataaagta | tatgttcaaa | ggtgctccta | aagagaatcc | atttggaaca | 102240 |
| gataaagatg | tttatataga | tacttataac | ttattatact | ggttatattt | aggtgaagat | 102300 |
| gaagagttag | catccctat | gaatattaat | tacttcttta | cagagggaag | attctttact | 102360 |
| atattcggta | aaggacataa | gtataaggta | gatgttagta | aatttatagt | tggagatata | 102420 |
| ttattctttg | gtagaagtga | tactaatata | ggtatttatg | taggagatgg | ggagtttata | 102480 |
| tctatgatgg | gtaaattccc | taaagatgaa | acacctatag | gaaaatataa | acttgatgat | 102540 |
| tactggaatg | aatttaacgg | aagagttatg | agattcgatg | aagaggtgta | tatttaatgg | 102600 |
| tagtaagatt | ccaatcttcc | atggggagaa | gtttaaaaag | agtagattca | gatgatttaa | 102660 |
| atgtaaaagg | attagtttta | gctacagtta | gtaaaattaa | ttataaatat | caatcagtag | 102720 |
| aagttaaagt | taacaactta | actctaggaa | gccgtatagg | tgacgatggt | agcttagctg | 102780 |
| taccttatcc | taaatctttc | ataggaagaa | cacctgaagg | aagcgtattc | ggtacaaaac | 102840 |
| ctcttattac | tgaaggttct | gtagtattaa | taggatttct | aaatgatgat | ataaatagtc | 102900 |
| ctattatttt | aagtgtttat | ggtgataatg | aacaaaataa | aatgattaat | accaatcctt | 102960 |
| tagatggggg | taagtttgat | acagaaagtg | tctataaata | tagtagttca | ctatatgaaa | 103020 |
| ttttaccatc | tttaaattat | aaatatgatg | atggagaagg | aacaagtatt | aggacttata | 103080 |
| atggtaaatc | atttttctct | atgacatcag | gtgaagaaga | gaaacctcag | gcaacagatt | 103140 |

FIG. 21DDD sequence.txt

```
tttatactgg aactgagtat caagatttat ttacttctta ttatggtaat aagacattaa    103200
ttgagcctag aatacaaaag gctcctaata tgttatttaa acatcaaggc gtttttatg     103260
atgatggcac gccggataat catataacta ctttatttat atctgaaaga ggggatataa    103320
gagcctcagt tttaaataca gaaacacaga aaagaaccac acaggaaatg tcaagtgatg    103380
ggtcttatag ggttataaaa caagatgacg atttaatgtt ggatgaagct caagtttgga    103440
ttgagtatgg tattagtgaa gataataaat tctatattaa aaatgacaag cataaatttg    103500
aatttactga tgagggaatt tatatagatg ataagcctat gttagaaaac ttagatgaga    103560
gtatagcaga ggctatgaag aatttgaatg aaatacaaaa agaactcgat gatataaatt    103620
accttctcga gggtgtaggt aaggataact tagaagaatt aatagagtct acaaaagagt    103680
ctatagaagc ttctaaaaaa gcaacttcag atgtcaatag acttacaact cagatagcag    103740
aagttagtgg tagaactgaa ggtattataa cacagttcca aaaatttaga gatgagactt    103800
ttaaagattt ttatgaagat gcttctactg ttattaatga agtaaatcag aatttcccta    103860
ctatgaaaac agatgttaag accttaaaga ctaaagttga taacctagag aaaactgaaa    103920
taccaaatat taaaactaga ttaacagaac tagagaacaa taataacaat gctgataaaa    103980
taatatcaga tagaggagaa catataggtg ctatgataca gttagaggaa aatgtcactg    104040
tacctatgag aaaatatatg ccaataccat ggagcaaagt tacttataat aatgcagagt    104100
tttgggattc taataatcct actcgattag tagtacctaa aggaataaca aaagtaagag    104160
ttgcaggtaa tgttttgtgg gactctaacg ccacaggaca acgtatgttg agaatattga    104220
aaaatggtac ttatagtata ggattacctt atacaagaga tgtagctata tctacagcac    104280
ctcagaatgg tactagtgga gttattcctg ttaaagaagg agattacttt gagtttgaag    104340
ctttccaaga ctcagaaggt gacagacaat tcagagcaga cccttataca tggtttagta    104400
ttgaagctat agaattagaa actgaaacta tggagaaaga ctttatgctt ataggacata    104460
gaggagcaac cggatacaca gatgagcaca cgataaaagg atatcaaatg gctttagata    104520
aaggtgcaga ttatatagaa ttagatttac aattaacaaa agataataag ttattgtgta    104580
tgcatgattc tactatagac agaacaacaa caggaacagg taaggtagga gatatgacct    104640
tatcttatat acaaactaac tttacatccc tcaatggtga gccgatacca tctcttgatg    104700
atgtactaaa tcattttgga acaaagtta aatattatat agaaactaaa cgtccgtttg     104760
atgctaatat ggataaagaa ttattaactc aattaaaagc aaaaggatta ataggaatag    104820
gttcagagag attccaagta attattcaat catttgctag agaatcgtta attaatattc    104880
ataatcaatt ctctaatata cctttagctt acttaacaag tacattctct gaaagtgaaa    104940
tggatgattg tttaagttat ggttcttatg ctattgcgcc taaatataca actataacta    105000
aagaattagt agatttagct catagtaaag ggcttaaagt ccacgcatgg acggtaaata    105060
```

FIG. 21EEE sequence.txt

| | | | | | |
|---|---|---|---|---|---|
| caaaagaaga | aatgcaaagc | ttaatacaaa | tgggtgtaga | tggattctttt | acaaactacc | 105120 |
| tagatgaata | taaaaagatt | taatattaaa | gacctattaa | tttaggtctt | tttttagttg | 105180 |
| taatttaaac | tagttcgtga | tatattagta | gtatgagatt | tatatacata | ctgaaaagga | 105240 |
| gaggataaaa | tgccacaatc | agatggaata | agtaatcttc | atagaatagc | tttacgtttc | 105300 |
| cctaaagaag | gcggtggtta | tgatatgtat | agatttaaag | ttaaccctga | gaactacaca | 105360 |
| atagattcac | cacaacgtac | gacagcaatt | aaaacaaaat | cagatatcgt | aatagaagat | 105420 |
| tatggtaaag | atatagaagt | tattaacttc | acaggtacaa | ctggttttag | acctgttaga | 105480 |
| gaagcagatg | ggttaaaaac | aggtaagcag | aaaatggaag | agttacaaag | tagagttagt | 105540 |
| gaatatgcta | tgcaaggtgg | cagtggtaat | gtaagtggtt | cttacttaca | atttttttaac | 105600 |
| tttacagatg | atagttatta | taaagttcat | ttagctcctc | aggggttaaa | gataactagg | 105660 |
| tctaaagatg | aaccattact | ttttagatat | gaaataacat | tagtagttat | tggttcatta | 105720 |
| acagaagcag | atagaagtgc | tgtaactact | gaagagtttg | gtaatgttaa | acctaatgct | 105780 |
| tctcaaagag | tagatgaagg | tataaaagaa | ttagataaaa | atgctcgtaa | aacgagagat | 105840 |
| agaaacaatc | aagaaatatc | tagaagagaa | aatacaatac | ctaaatccac | aggagataat | 105900 |
| acgaacgagg | gtaatagact | taagcaaagc | ttccctagta | gttctatata | taatcctaga | 105960 |
| caatctacta | atggattaaa | aggtaatatt | gacaatatgg | ctctgataat | aggttacggt | 106020 |
| gatggaggtg | tatctagcta | atgaataatt | ttataccaca | acctcaaggt | ctacttagat | 106080 |
| tttaaatgc | cctagataca | gatttaactt | cttctcatat | gaatttactg | gatgaagagg | 106140 |
| tatcatttgt | atctaaattt | tatacaccac | agttacaatt | aagtgaatta | gcaaaaaaag | 106200 |
| tattgacaaa | tataaagaca | gatgatatac | ctgtattaga | aagggaattt | aatgataata | 106260 |
| caattatcca | taaagctaac | gatacattac | taaaagtaca | ggctccaaga | atgtatatga | 106320 |
| ttctacagtc | tattgtactt | gaagcatatg | ctattgttaa | ttgctttgta | gaaaatccaa | 106380 |
| gttcttttaaa | atacttaact | gaagaagatg | ttagtataac | acgagaaaac | ttaaattatg | 106440 |
| tagctgacta | cttaggtaac | tatgatgact | acaatagtgt | tgtattagac | ttaagagatt | 106500 |
| tagacttatg | ttttagtgct | atagaattac | aattacctct | aattaaaaag | gaggctaacg | 106560 |
| tataatgaga | tttaagaagc | acgtagttca | acatgaagaa | acgatgcaag | caatagcaca | 106620 |
| gagatactat | ggtgatgtta | gttattggat | agacctagta | gagcataata | atttaaagta | 106680 |
| tccctattta | gtagaaactg | atgaagaaaa | aatgaaagac | ccggaacgat | tagcttctac | 106740 |
| cggtgataca | ctgattatac | ctatagaatc | tgatttaaca | gatgtatcag | caaaagaaat | 106800 |
| taattctaga | gataaagatg | tactagttga | attagcttta | ggaagagatt | taaatattac | 106860 |
| tgcagatgaa | aagtatttta | atgaacatgg | tactagtgat | aatatactag | cattcagcac | 106920 |

FIG. 21FFF

```
                                  sequence.txt
aaatggtaat ggagatttag atactgtaaa aggcatagat aaatatgaaac agcaattaca    106980
ggcacgttta ttaactccta gaggttcctt aatgttacat cctaattacg gttcagattt    107040
gcataattta tttggtctta atatacctga acaagctacg cttatagaaa tggaagtatt    107100
gagaacatta acatcagata atagagtaaa atctgctaat ttaattgatt ggaaaataca    107160
aggtaatgtt tattcaggtc aattttcagt ggaaataaaa tctgttgaag aatcaataaa    107220
ttttgtctta ggacaagatg aggaaggaat ttttgcttta tttgaatagg aaaggattaa    107280
attatgaaaa ctagaaaatt aactaacata ctatcaaaat taatagataa gacaatggca    107340
ggtacaagca agataacaga ctttactcct ggttcagctt cccgttcatt attagaagct    107400
gtatcattag agatagagca attctatatt ctaacaaaag aaaatattga ttggggtata    107460
caagaaggta tcattgaagc ttttgatttt caaaaaagac aatctaaaag agcttatggt    107520
gatgttacta ttcaattcta ccaacccttta gatatgagaa tgtatatacc tgcaggaaca    107580
acttttactt caacacgaca agaatacccct cagcaatttg aaacattagt tgattattat    107640
gcagagcctg attctactga gattgttgtt gaagtttatt gtaaagaaac aggggttgca    107700
ggtaatgttc ctgaaggaac gattaatact atagcatcag gttctagttt gattagaagt    107760
gttaataatg agtattcttt taatacagga actaaagaag aaagtcagga agactttaaa    107820
cgtagattcc actcttttgt agaatctaga ggtagagcaa ctaataaatc agtaagatat    107880
ggtgcactgc agatacctga tgtagaaggt gtttatgttt atgaagaaac agggcatatt    107940
acagtatttg ctcatgatag aaacggtaat ttatcagata ccttaaaaga agatataatt    108000
gatgctttac aagactatag accaagtggt ataatgttag atgttacagg tgtagaaaaa    108060
gaagaagtta atgtttctgc tacagtaact atatctaata aatctagaat tggtgataca    108120
ttacaaaaac atatcgaaag tgttattaga agctatttaa ataatttaaa aacttctgat    108180
gacctaataa ttacagacct tattcaagct ataatgaata ttgatgacgt attaatatat    108240
gatgtgtcat ttgataactt agatgagaac attatagtac caccacaagg gattattaga    108300
gcgggagaaa taaaagtaga attaaagtaa agagaggtga aacttaagtc gtggctaatt    108360
ttttaaagaa tcttcatcca ttattaagaa gagatagaaa taaaaagat aatcaagacc    108420
ctaactttgc tctgatagat gcactcaatg aagagatgaa tcaagtggag aaagatgcta    108480
tagaaagtaa attacaatcc tctctaaaga catctacaag tgaatattta gataagtttg    108540
gggattggtt tggagtttat cgtaagaccg atgagaacga tgatgtttat agagcaagaa    108600
ttataaaata tttactcttg aaaagaggaa ctaataatgc tataatagat gctataaaag    108660
attatttagg tagagatgat attgatgtaa gtgtatatga gccctttaca aatattttttt  108720
atacgaacaa atcacattta aatggtgaag accatttaat gggatactat tatagatttg    108780
ctgttattaa tgtatctata ggtgattatt ttcctgtaga gattatagat gtaattaatg    108840
```

FIG. 21GGG sequence.txt

```
aattcaaacc tgcaggtgta actctatatg tcacttatga tggagcttct actattagag    108900
gtggagcaat tattaagtgg ttagatgggt tacctaaaat agaaacatac caagagtttg    108960
atagatttac aggttatgat gatacattct atggtcatat taatatgaat caaagtaaag    109020
atactgataa cagttcatca gatattttta aaacaaatca tagcttaatt aatagtttag    109080
atgttttaac aggttcatct agtgtaggta gacagtatat taactatgga tatgtaacat    109140
catatgttta taatccaggt atgacatcct ctgtaaacca aataagtgct agtacagaag    109200
gtagaggtca agaagtacct actgattact atatgtatac tagtactaag aataacaata    109260
cagtagaact tagtatgcaa actacttccg gtgtgtctta tttatataat aactttaatt    109320
ttagagatta tatgagtaaa tatagacctc aagtagattt acaatctgat gaggctagaa    109380
gaattgtatc tgattatata aaagaattaa gtattgatta ctatcttagt gctgtgatac    109440
ctcctgatga agtatagaa attaaactac aagtttatga ttttctatt aatagatggc    109500
ttacagtatc aattaataac ttatctttct atgaaaaaaa tattgggagt aatatagggt    109560
atataaaaga ctatctaaac agtgaattaa atatgtttac taggttagag ataaatgcag    109620
gtaaaagaga ttcagtagat attaaagtta attacttaga tttaatgttt tattactatg    109680
aacgaggtat ttatacaata aaaccttata aagcattaat agaaaattat ttagatatat    109740
ctagagagac ttatgtagaa gcatttaaaa tagcatcatt atctaatgga gatattataa    109800
ctaaaacagg ttttcagcct atagggtatt taaaactagt tggtaattat gaaaatacaa    109860
gacctagcac aataaatata gtagctaaag atacagataa taaccctata gaatctaatg    109920
aattagatgt atataataca gtagagaata gaaatctatt acaatcttat aaaggtgcaa    109980
atacgatagc tagagaaata acttctacaa aagagtttac tgtatcagga tgggctaaag    110040
agatatactc aactaattat cttctaaag tattaaaacc aggtaaagtg tatacgttat    110100
cttttgatat agaaataaca ggtaatgacc taactcttaa atcttattct gataatcatg    110160
gtatatattt atacagtaat actaagggaa ttgttgttaa tggtgttaaa tctatggaac    110220
gtactatagg taacaaagta tccgtaactc aaacttttac agcccctact attactgacc    110280
atagattatt aatatatact ggaagatata catctgatgg taaagcatca actcctccag    110340
tgttctttaa tacagttaaa attacggaat taaaattgtc tgagggtacc tctaatctag    110400
agtactcacc tgctccggaa gataaaccta acgtaataga aaaaggaatt aaatttaata    110460
atatcctaac taatatacag actttaagta ttaattcgga tactatctta aaaaatgtaa    110520
ctttatatta ttcttactat ggtgataatt gggtagaact aaagactcta ggaaatatta    110580
gtactggaga aacaacagaa accaataact taatagattt atatggatta cagacagtag    110640
attattctaa tataaatcca atgtctaaag tatcattacg ttccatttgg aatgttaaac    110700
```

FIG. 21HHH sequence.txt

```
taggtgaatt gaacaatcaa gaaggttctt tatctaatat gcctaatgat tactttaatg    110760
ctgtatggca ggatatagat aaattatcag atattgagat aggttctatg agaatggtta    110820
aagacactga gggtggagta ttcgatggag ctacaggtga aattattaag gctactctat    110880
ttaatgtcgg ttcttatact gatttagaca tgttagctta tactttgact aactatactg    110940
aaccgttaac tttaggctct agtcgattaa taagtgagtt aaaagaagaa cttctaacat    111000
cagaatcatt taatgttgat aatagaatta aagtaattga ctcaatatat gaggagttac    111060
caaatacaag cattattaaa aatggatttg ttgaaagaga ggttacaggc tctaaatatt    111120
tagattatgg tttatatgag cctatagaag atggtactag atataaactt attgtcgaag    111180
gagaattta a agataatata gaatttatat atttatacaa ttctaaccct aactttaatg    111240
aaacatttat atatccatca gagataatta atggagttgc tgaaaaagaa tttattgcaa    111300
aaccatccac cgaagacaaa ccaaggttaa atacagatgt tagaatatat atacgacctt    111360
atgattcaac tatctctaaa gtaagaagag tagaattaag gaaagtttaa taaataagtt    111420
gacagaaagt taataatatg gtatacttat aaagtaatat ttagtgggta taccatgtta    111480
tattaataaa gaaaacaaca gatgaaagga attaaaaaat atggcaattg caacgtataa    111540
ttctcatgtt gagttagcaa aatatctagt tagtaaagct gattcagttt acttaacaat    111600
tggaaagagc acaccgtggt ctaatgaaac aaacccaccg caacctgatg aaaatgcaac    111660
agtattacag gaggttattg gatacaaaaa agctactaaa gttactttag ttagaccttc    111720
taaatcacct gaagatgata ataagaattt aatttcttat ggtaataaat catgggtaga    111780
agtaacacct gaaaatgcta aagctgaagg agctaaatgg gtttacttag aaagtagtat    111840
tgttggtgac gaactgcctc ttggaacata tagacaggta ggatttgtta tggacttagt    111900
agcaaaaagt ggtattagta aatttaactt agtacctagt gaagtagaat caactggaac    111960
attattattc tttgataata acaattcca a aaatagaagt gagcagacaa ctgctaaaga    112020
aagatttatt gtagaagttt aaagaaaggg agataattct aaatggcaat taattttaaa    112080
ggttcacctt atttagatag atttgacccg tctaaagata gaacaaaagt attatttaat    112140
cctgatagac ctctacaaca ggcagaatta aatgaaatgc agtctataga ccaatattat    112200
ttaaaaaatc taggagacgc tatttttaaa gacggagata acagtcagg a cttggattc    112260
acattgtctg aagataatgt attgacagta aatcctggtt atgtatatat caacggtaaa    112320
ataagatatt acgataatga cgattcagtt aaaataactg gcgtaggtaa agaaactatc    112380
ggtattaagt taacagaacg tattgttaca cctgatgaag atgctagtct attagaccaa    112440
actagtggag taccaagtta cttctctaaa ggtgcagata gattagaaga aaagatgtca    112500
ttaacagtta atgaccctac atcagcaact atttatactt tcatggatgg agatttatat    112560
attcaatcaa ctaatgctga aatggataaa atcaataaag tattagctga acgtacttat    112620
```

FIG. 21III sequence.txt

| | | | | | |
|---|---|---|---|---|---|
| gatgagtcag | gttcatataa | agtaaatggt | tttgagttat | tctcagaagg | taatgctgaa | 112680 |
| gatgatgacc | acgtttctgt | agttgtagat | gcaggtaaag | cttatgtaaa | aggttttaaa | 112740 |
| gtagataaac | ctgtatcaac | aagaattagt | gtacctaaat | cttatgactt | aggaacagca | 112800 |
| gaaaatgaaa | gtactatctt | taataagtct | aataattcta | ttagtttagc | taatagccct | 112860 |
| gtaaaagaaa | ttagacgtgt | tacaggtcaa | gtacttattg | aaaaagaacg | agttacaaga | 112920 |
| ggagcccaag | gtgatgggca | agattttctt | tcaaataata | cagcatttga | aattgtaaaa | 112980 |
| gtttggactg | aaacaagccc | tggtgttact | acaaaagagt | ataaacaagg | agaagacttc | 113040 |
| agattaacag | acggtcaaac | gattgattgg | tcacctcaag | gtcaagaacc | ttcaggaggt | 113100 |
| acttcatact | acgtttctta | taaatataac | aaacgtatgg | aagccggtaa | agattatgaa | 113160 |
| gtaacaactc | aaggtgaagg | tttgagtaag | aaatggtaca | ttaacttcac | accttcaaat | 113220 |
| ggtgctaaac | ctattgacca | aacagtagta | ttagtagact | atacttacta | cttggctcgt | 113280 |
| aaagattcag | tgtttattaa | taaatatggt | gatattgcaa | tattacctgg | tgaacctaat | 113340 |
| attatgagat | tagttacacc | accattaaac | acagaccctg | agaatttaca | attaggtaca | 113400 |
| gttacagtat | tacctgattc | agatgaagca | gtatgtattt | catttgcaat | cactagattg | 113460 |
| tctatggaag | acttacagaa | agttaaaaca | agagtagata | acttagagta | taaccaagca | 113520 |
| gtaaatgctc | tagatgatgg | tgctatggaa | ggacagaacc | cactaacatt | acgttcagta | 113580 |
| tttagtgaag | ggttcattag | tcttgacaaa | gcagatatta | cacatcctga | cttcggaatt | 113640 |
| gtatttagtt | ttgaagatgc | agaagctact | ttggcttata | cagaagcagt | taaccaacct | 113700 |
| aagattattc | caggagatac | aacagctcat | atttggggta | gattaatttc | agcaccattt | 113760 |
| actgaggaac | gtacaatcta | tcaaggtcaa | gcatcagaaa | cattaaatgt | taaccettat | 113820 |
| aatattccta | caaacaagg | tgtgttaaag | ttaacaccta | gtgaggataa | ctggattgat | 113880 |
| actgaaaatg | ttacaatcac | tgaacaaaaa | actaaaaaag | taactatgaa | acgattttgg | 113940 |
| agacataatg | agagttacta | tggtgagact | gagcattact | tgtattctaa | cttacagtta | 114000 |
| gatgcaggac | aaaagtggaa | aggtgaaact | tacgcttatg | atagagagca | tggacgtact | 114060 |
| ggtactttat | tagaatcagg | aggacaacgt | actctagaag | aaatgattga | attcattaga | 114120 |
| atcagagatg | tatccttcga | agttaaagga | ctaaacccta | atgataataa | cttatattta | 114180 |
| ttatttgatg | gggtaagatg | cgctataaca | cctgcaactg | gttatagaaa | aggctctgaa | 114240 |
| gatggtacga | taatgacaga | tgctaaagga | acagctaaag | gtaaatttac | tattcctgca | 114300 |
| ggtattcgtt | gtggtaaccg | agaagttaca | cttaagaatg | ctaactctac | aagtgctaca | 114360 |
| acttacacag | cccaaggacg | taaaaaaacc | gttcaagata | ttattatcag | aactcgtgta | 114420 |
| acagtaaact | tagtagaccc | attagcacaa | tcattccaat | atgatgagaa | cagaactata | 114480 |

FIG. 21JJJ sequence.txt

```
tcatcattag gattatactt tgcttctaaa ggtgataaac aatctaatgt tgttatccaa    114540
attagaggta tgggtgacca aggttatcct aataaaacaa tctatgcaga aacagttatg    114600
aatgctgatg atattaaagt atctaataat gctagtgctg aaactagagt atactttgat    114660
gaccctatga tggctgaagg cggtaaggaa tacgctattg ttattattac tgagaacagt    114720
gattatacaa tgtgggtagg tactagaact aagcctaaga ttgataaacc taatgaggtt    114780
atctcaggta acccatacct tcaaggtgta ttattcagtt catcaaatgc atcaacatgg    114840
actcctcatc aaaactctga ccttaaattt ggtatttata cttctaaatt taatgagaca    114900
gcaacaattg aattcgaacc aattaaagat gtatcggcag atagaatagt tcttatgtct    114960
acgtacttaa ctcctgagag aacaggatgt acatgggaaa tgaaattaat tctagatgat    115020
atggcatctt ctacaacatt cgaccaatta aaatgggagc ctatcggtaa ctaccaagat    115080
ttagatgttt taggtctagc aagacaagtt aagttaagag caactttcga atctaataga    115140
tatatctcac cattaatgag ctctagtgat ttaacattca ctacattctt aacagagtta    115200
acaggttcat atgttggtag agctattgat atgacagagg ctccttacaa tacagtaaga    115260
tttagttatg aagctttctt acctaaaggt actaaagttg ttcctaagta ttctgcggat    115320
gatggaaaaa cttggaaaac atttactaaa tcccctacaa ctactagagc caataatgag    115380
tttacacgct atgtcattga cgagaaagta aaatcatcag gaacaaatac taaactacaa    115440
gttagattag atttatcaac tgaaaatagc tttttacgtc ctcgtgttcg tagacttatg    115500
gttactacta gggatgaata aactagaggg gttgattgac ccctctttat ttaataagga    115560
gagatttata tgcctagaga agttagagac ccttattctc aagctaaatt atttatacct    115620
acagttgaag aaaaatcaat taaggaatta gaaaaaacat acaaagaaaa aattgatgaa    115680
gctactaagt taatcaatga attaaagaaa gagagaggag aaaaatagat ggcatttaac    115740
tacacgcctc ttactgaaac acagaagtta aaagatatgt atcctaaagt taatgatata    115800
ggtaactttt taaaaacaga agttaacctt agtgatgtaa acaaatatc acaacccgac    115860
tttaataata ttttagcatc tataccttgat agtggtaact actatgtaac taattcaaaa    115920
ggtgctccta gtggagaagc tacggcagga tttgtaagat tggataaacg aaatgtaaat    115980
tattataaaa tttactattc accatatagt agtaataaaa tgtatatcaa gacttatgct    116040
aatggtactg tatatgattg gattagtttt aaattagatg aaggtaactt atacaatgaa    116100
ggtaatactt taaatgtaaa ggaacttact gaatctacaa ctcaatatgc aacactagtt    116160
aatcctccaa aagagaactt aaatacaggt tgggttaatt acaaagaaag taaaaatggt    116220
gtttcttctt tagtagaatt taacccggtt aactccactt caactttta gatgataaga    116280
aagttaccag tacaagaaca aaagcctaac ttattgaaag atagtttatt tgtttatcct    116340
gaaactagct attctaatat taaaacagat aactgggata cgcctccatt ttgggggata    116400
```

FIG. 21KKK sequence.txt

```
tcttctaata gtggtcgttc aggagttaga tttagaggag agaatacagt acagatagat    116460
gatgggtcta atacgtaccc tttagtagtt tctaataggt ttaaaatggg taaagaactt    116520
tctgtaggtg atactgtaac ggtatcagta tatgctaaaa ttaatgaccc tgctttactt    116580
aaagataact tagtttactt tgaattagca ggatacgata ctgtagatga tactagtaaa    116640
aatccttata caggaggacg tagagaaata acagcaagtg agataacaac tgagtggaaa    116700
aaatactctt tcacatttac gatacctgaa aatacaatcg gagcatcagg cgttaaagtt    116760
aattacgtat ctttactact aagaatgaat tgttcatcta gtaaaggtaa tggtgctgta    116820
gtatactatg ccttacctaa attagaaaaa tcacctaaag ttacaccatt tattacacat    116880
gaaaatgatg ttcgtaaata tgatgagatt tggtctaatt ggcaagaagt tattagtaaa    116940
gatgaattaa aaggtcactc tcctgtagat attgaatata atgattattt taaatatcag    117000
tggtggaaat ctgaagttaa tgaaaagagt ttaaaagatt tagctatgac agtacctcaa    117060
ggatatcata cattttattg tcaaggctct attgccggga cgcctaaggg acgttctatt    117120
agaggaacca ttcaggtaga ttatgacaaa ggtgacccct acagagctaa taagtttgtt    117180
aaattattgt ttactgacac agaaggtata ccttatacat tatactacgg agggtataat    117240
caaggttgga aactcttaaa gcaatcagaa acttctactt tactatggga aggtacttta    117300
gattttgggt ctacggaagc tgttaactta aatgactcat tagataatta tgatttaatt    117360
gaggtaactt attggactcg ttcagcagga cattttttcta caaaaagatt agatataaaa    117420
aatacatcaa atttactgta tattagagac tttaatattt caaatgatag tacaggttct    117480
agtgtagact tttttgaagg gtattgcact ttccctacta gagcatcagt acaacctggt    117540
atggtaaaat ctataacttt agacgggtct acaaatacaa caaaagtagc atcatggaat    117600
gaaaaggaac gtataaaggt atacaatatt atgggaatta atagaggata agaaaggtg    117660
gaataaaaaa ctatggctgt taaatatgat ataggtaata atgagatagt attcacactta    117720
agagaaggta aatatataac agggtttaca acagtaggag ggtatgacaa ggagttaggg    117780
caagtaaaag ttaatagaga aatcttacct gcttacttct ttgataattt tgcctatgaa    117840
agatatttgt attatagtaa acctgaagag gttatagaaa ataaaaacta tgtaccacca    117900
caaatcaatg atgatgagga atcccaacaa attactgtac ctaaagaaca atatgatagt    117960
ttaaagaag agctagagct tatgagaaaa caacaagaag ctatgatgga aatgcttcaa    118020
aagctcttag gtcaaaaggg gtaattataa atggcattaa attttactac aataacggaa    118080
aacaatgtta ttagagacct gactactcag gtcaataaca ttggagaaga attaacaaaa    118140
gaaagaaata tatttgacat taccgatgat ttagtttata atttttaataa atcacagaaa    118200
attaaactaa ctgatgataa aggattaact aaatcttatg gaaacataac agcccttaga    118260
```

FIG. 21LLL sequence.txt

| | | | | | | |
|---|---|---|---|---|---|---|
| gatataaaag | aacctggtta | ttactatata | ggtgctagaa | cattagcaac | attattagat | 118320 |
| agacctgata | tggaatctct | tgatgttgtt | ttacatgtag | tacctcttga | tacttctagt | 118380 |
| aaggtagttc | aacatttata | tacactatct | actaacaata | accaaattaa | aatgttatat | 118440 |
| agatttgtct | cagggaactc | tagttcagaa | tggcaattta | ttcaaggatt | acctagtaat | 118500 |
| aaaaatgctg | ttatatcggg | cactaatatt | ctagatatag | cttcaccagg | tgtttacttt | 118560 |
| gttatgggaa | tgacaggagg | aatgcctagt | ggagtaagct | ccggattttt | agacttaagt | 118620 |
| gtagatgcta | atgataatag | attagctaga | ctaactgatg | ctgaaactgg | taaagaatat | 118680 |
| actagcatta | agaaacctac | aggaacatac | acatcttgga | aaaagaatt | tgagccaaaa | 118740 |
| gatatggaga | aatatttact | aagtagtatc | agagacgatg | gtagtgcatc | attcccactc | 118800 |
| ctagtttata | ctagtgataa | taaaacgttt | caacaagcta | ttatagacca | tatagataga | 118860 |
| acaggtcaaa | caacctttac | tttctacgtt | caaggtggtg | tatcaggttc | ccctatgtct | 118920 |
| aatagttgtc | gaggtctatt | catgtcagat | acacctaaca | cttctagttt | acatggtgtc | 118980 |
| tataatgcta | taggtacaga | tggtagaaat | gtaacaggtt | cagtggtagg | aggtaattgg | 119040 |
| acttcaccaa | agacatcacc | ttcccataaa | gaattatgga | cgggagcaca | atcattccta | 119100 |
| tctgtaggta | ctactaagaa | tctagcagat | gatattagta | attactctta | tgtagaggtt | 119160 |
| tatactaaac | ataagacagt | agagaagact | aaaggtaatg | atgactcggg | tacaatttgc | 119220 |
| cacaagttct | acttagatgg | tagcggtact | tacgtttgct | caggaacttt | tgtttcagga | 119280 |
| gatagaacag | atacaaaacc | acctgttaca | gagttctata | gagtaggtgt | atctttcaaa | 119340 |
| ggttcaacat | ggacgcttgt | agatagtgca | gtacaaaata | gtaaaactca | atacgttaca | 119400 |
| agaattatag | gtattaatat | gccatagact | aggataagtt | tcctagtctt | tttttcttga | 119460 |
| cttgaaaagg | attctatggt | atactataac | tcgtgtaagg | atataaggag | attaaaatga | 119520 |
| gattaagaat | taagaactta | tatacctatg | tagaatttga | ggaggatgat | aaatacttaa | 119580 |
| aagatatatt | tttaaagaga | gtccatacta | ctataggagc | aaggcaagaa | ggttttcaat | 119640 |
| atagccctgc | gtacaaaaga | ggtagttggg | atggttatgt | agacttttat | gtttatgagg | 119700 |
| aagataaatt | ccctactgga | cttttattta | aaattgagtt | attattaggt | gagttacaat | 119760 |
| caaggtataa | cttccagttt | gaaacaattg | atgagcgtga | tgaaagtttc | ttatctgaag | 119820 |
| aagatattga | tgatgagata | acattgcttg | ataataatgt | cggtcaaatt | accttaagag | 119880 |
| attaccaata | tgaagcagtg | tacaatagct | taacatttta | caatggtatt | gctcacttag | 119940 |
| ctactaatgg | tggtaaaact | gaggttgcta | gtggtattat | agaccaacta | ttacctcaat | 120000 |
| tagaaaaagg | tgaaagagta | gcgttcttca | caggctctac | ggagatattt | catcagtctg | 120060 |
| cggatagact | acaagaacgt | ttaaatattc | ctattggtaa | agtaggtgca | ggtaaatttg | 120120 |
| atgttaaaca | ggttacagtt | gtaatgatac | ctactttaaa | tgcaaacctt | aaagacccaa | 120180 |

FIG. 21MMM sequence.txt

```
cacaaggggt aaaggttaca cctaaacaaa atattagtaa aaagattgct caagagatat    120240
tacctaaatt tgaaggtgga acaaatcaaa agaaattact aaaagtatta cttgataaca    120300
caacacctaa aacaaaagta gaacaaaacg tattaagtgc cttagagata atttaccaaa    120360
atagtaagac agatgcagaa gttttattaa acttaagaaa tcataatgca cattttcaaa    120420
aaattgttag agaaaagaac gaaaagaaat atgataaata tcaagatatg agagattttt    120480
tagactcagt tacagttatg atagttgatg aggcacacca ttctaaatct gattcttggt    120540
acaataatct aatgacatgt gaaaaagctt tatatcgaat tgcattaaca gggtctatag    120600
ataaaaaaga tgaattactt tggatgagat tacaggctct atttggtaat gttattgcac    120660
gaactactaa taagttttta attgatgaag gtcattctgc tagaccaaca ataaatatta    120720
tacctatagc taatcctaat gacatagata gaattgatga ttataggggaa gcttacgata    120780
gaggtataac aaataatgat tttagaaata aacttattgc aaaactaaca gaaaagtggt    120840
ataatcaaga taaaggtaca ttgattattg taaacttcat tgaacatgga gacacgatat    120900
cagaaatgtt aaatgattta gatgtagagc actacttctt acatggagaa atagactctg    120960
aaactaggag agaaaaatta aatgatatga gaagtggtaa gcttaaagta atgatagcta    121020
catcacttat tgatgagggt gtagatatat ccggtattaa tgcactaata ttaggtgcag    121080
gaggtaagtc attaagacaa acattacaac gtattggtcg tgctttacgt aagaaaaaag    121140
acgataatac aacacaaata tttgattta atgatatgac aaatagattt ttatatactc    121200
atgctaatga gcgtaggaaa atttatgaag aggaagattt tgaaataaaa gacttaggaa    121260
aataggaggg taagagatgg caacaaaaac acaaagaaag ctataccaat atctagagga    121320
aaatgctaca gaaaataaat ttcatatttc tactaagaaa gagctagcag attctctagg    121380
tgtttccatc tctgctttat ccaataaccT taaaaagtta gaagaagaaa ataaagtcgt    121440
tactgtttct aaaagaggaa aaaacggcgg agtaataata actttagtta gagagtatga    121500
tacagaagaa ttgaaagaat ttaataattc tacagataat attattactt ccgatttaca    121560
gtatgctaag gcattaagag aaaagcactt cccttcttat agatatgaga gaaaagaaca    121620
acgtagacgt actaaaatag aaatggcaca atacaatgcc attaaggatg agaagagaag    121680
aattatagca gatatgaact tctattcaga aggtcttcct tatccttcta agatattttt    121740
taatatgtct tatgacccgg aagggtttta taaagcatac atcttatgta agttatacga    121800
ccaatatgct atttctcata tggatgctaa acatacaagt catcttaaag caatgagtaa    121860
ggcaacaact aaagatgaat atgactatca tcaacatatg tctgaatact atagaaataa    121920
aatgattcaa aatttaccta gaaatagcgt tagtgataat ttctttggta gtaaaatgtt    121980
taatacccttt tataatttt atttaaaaat aaaagataaa aatattaatg tatttaaata    122040
```

FIG. 21NNN sequence.txt

```
tatgcaaaac gtatttaaaa atgtaacatt ttattatgag aatggtatgc aacctaatcc    122100
aataccttct cctaacttct ttagttcaga taagtatttt aaaaactata ataattatat    122160
taaaggaata aaaaaaggtg ttaacagtac gaatagacac ctaggtgata cagacagcat    122220
cattaattca tcagactacg tgaaaaaccc tgctgtatta catctacacc aactatatac    122280
tacaggatta aattctactt tacatgatat tgatactatg tttgaacaag ccttagacct    122340
tgaaaatgcc tcctatggac tatttggaga tatgaaacat attattttac tacagtataa    122400
ttctatgatt gaagaagaaa ttaagaattt acctagagaa gaaaaggata ttattaataa    122460
atatgtaaaa caatgcataa ttaatgatta ttcaccaaca agtatttcac catctgcaag    122520
gttatcaatg tttactatgc agaaagagca tatagtttac aataagcagt taaataaggg    122580
aatcaagaga gaggatttat taccattaag tctaggaggt atagtgaata aagattcatt    122640
gagtggtatg gatatacaaa acttagaaca gaatggtaat gaatacctgt atatgagaca    122700
acatacttca acttattata tattaagaat gtttggtgac tatttaggat atgaggtaaa    122760
cttaagagaa gtaaaatata ttgtagagaa atataattta attgataaaa taccattgac    122820
aaaagagggt atgttggatt ataataaact tatacattta gtagaggaag aggttaataa    122880
ctatgagtaa gaagataaag gagcttatcc ttcataaatc aatgaaggat atacattttg    122940
caagagaagt attagataac ttacctaaga atctattttc agcagagtct gaggacatgg    123000
gttacttatt tacagctata aagagaacag cacatatttc cgataagatg tcaaatgaag    123060
cattagcaat taaagtagaa cagcttatgg gtaataataa ggaagatgaa gagaaagtaa    123120
ccaagacatt aacttactta gaagatttat ataaagtaga cgttaatgaa aaagatgaat    123180
ctgttaatta tgaaatagag aagtatatta aaacagaaat gtcaaaagaa gttttagtta    123240
aatttattgc agaaaataaa caagaagact ctgataatct acatgaactt gtagacaaac    123300
taaagcaaat agaagtaagt gacatctcag gaggtaatgg agagtttatt gacttctttg    123360
aagatacaga aaagaaacaa gaactattga gtaatttagc tacaaataaa ttctctactg    123420
gatttacttc tattgacaac catattgaag gtggtatagc aagaggagaa gttggattaa    123480
ttatagctcc tactggtaga ggtaaatcat taatggcttc aaacttagct aagaattatg    123540
ttaaaagtgg attaagtgtt ttatatattg ccttagagga aaaaatggat agaatggttt    123600
tgcgtgctga gcaacaaatg gcaggagcag aaaagagtca aattgtaaat caggatatgt    123660
ctttaaataa taaagtttat gatgcaatac aaaatcatta tcagaagaat agaaagttat    123720
taggtgactt ttatatttct aaacatatgc caggtgaagt tacaccaaac caattagagc    123780
aaattattgt taatacaaca attaagaagg ataaaaatat tgatgttgtt attattgact    123840
atcctcactt aatgagaaat ccttatgcta aatatcattc agaatcagat gcaggaggaa    123900
aattgtttga agatattcgt agattatcac agcaatatgg atttgtttgt tggacgttag    123960
```

FIG. 21OOO sequence.txt

```
ctcaaactaa ccgtggtgct tatggttcag atgttattac aagtgagcat gtagaaggtt    124020
ctcgtaagat tgtcaatgct gttgaggtgt ctttagcagt aaaccaaaaa gatgaagaat    124080
tcaagagtgg tttcttaaga ttatatttag ataaaattcg taatagctcc aacacaggag    124140
aacgatttgt taatcttaaa gtagaaccaa ctaagatgat tgtaagagat gaaacacctg    124200
aagaaaaaca agagcatata caattgctat cagataatgg aaaagaagac acaagtaaat    124260
ttcaaaataa agataataaa atagaagcta taaataacac attcggagga ttaccgggag    124320
tttaatttt taaaatatac cacttgacat tttatatgtt aggtggtata attattttat    124380
aaagaataaa ggagagatta ataatgaaat ttgtattctt tacagatagt cattttcacc    124440
tatttactaa ctacgctaaa cctgataatg aatttgtgaa tgatagattt aaagaacaga    124500
tagaagcatt acagaaagtt tttgatattg ctaaaaaaga agaagcaaca gttatatttg    124560
gtggagattt atttcataaa cgtaactcgg tagatactag agtatacaac aaagtattta    124620
gtacatttgc caaaaatgat gaggttcctg tattattact tagaggtaat catgatgcta    124680
caactaattc attatatact gattcaagta tagatacatt tgagtatcta cctaatgtaa    124740
gtgtaataaa atcattaaat acaattttaa aagataatgt taatattgtg tttactgctt    124800
atggggatga gacgaaggaa ataaagacat acattaatag taattacgat aaagatatgg    124860
tcaatatact agtaggtcac ttaggtgtag aaggttcatt aactggaaaa ggctctcata    124920
gattagaagg ggcatttgga taccaggatt tattacctga taaatatgat ttcattttac    124980
taggtcatta tcaccgtaga cagtatttcc aaaatccgaa tcattttat ggtggctcat    125040
taatgcaaca atcattttct gatgaacaag aagctaatgg tgttcattta atagatacag    125100
aaaaaatgac tacagaattc atcccaattc atacacgtag atttattact attcaaggag    125160
aagatattcc tgagaacttt gaacagttaa tcgaggaagg taatttttatt agggttatcg    125220
gtacagcaaa tcatgctaag gttttagaaa tggatgacag tatgaaagat aagaatgttg    125280
aagttcaaat taaaaagaa tatactgtag agaaacgtat tgatagtgat gtatctgatg    125340
acccttaac aattgctagt acctatgcta aacaatactc acctgaatca gaacaagaaa    125400
tacttgagtg tttgaaggag gttttataat gaaaaatat agagaatacc taaataagac    125460
agatgcagaa aatttagcag aggattggga gaaagtaacc gaagatttat ggaaagtgtt    125520
taaagatatg aaacctaaaa ttaatacatt agatattagt aatgtagaaa gtaaaaactt    125580
agataaaagt aaacctatac tacaattcca agattcagat ggagtaatag agaatatttg    125640
taatgttgag ggtttagaag atggtttaag taaaatgaaa aaggttttg atgatagtaa    125700
ctttgaaaag cattattata gtagagtcgt agaccatgat gagtattact ggattgatta    125760
tggttctcat cattgtttct ttagagttac gaaaggggat aagtaatggt tgtatttaaa    125820
```

FIG. 21PPP

```
                         sequence.txt
caagtagaag ttaataattt tttagcaatt aaagaagcta cgctagagtt agacaataga    125880
ggattaattc taattgaagg tgagaataaa tccaatgagt catttcattc aaacggttca    125940
ggaaaatcaa ctttaatatc tgccattact tacgctttat atggtaaaac tgaaaaagga    126000
ctaaaagcag acgatgtagt aaataatatt gagaagaaaa atacatctgt taaacttaag    126060
tttgatattg gggaagatag ctatttaatt gaacgttatc gtaaggacaa agagaataag    126120
aataaagtaa aattatttgt taatgaaaaa gagattacag gttcaacaaa tgacgttact    126180
gataaacaaa tacaagactt atttggtatt gagtttaata cttacgttaa tgctatcatg    126240
tatggtcaag gagatatccc tatgttctcc caagcaacag ataaaggtaa gaaagaaatt    126300
cttgaatcta ttactaagac agatgtatat aaacaagcgc aagatgtagc aaaagagaaa    126360
gttaaagaag tagaagaaca acaaaataac ataagacagg aaatctataa actaggttat    126420
cagttatcta caaaagatga gtacttccaa agagaaatag aacagtacaa ccagtataaa    126480
gaacaattgg ttcagataga aaacagtaat aaggaaaaag atagattaag agaacaagag    126540
gagaagcaaa tagaagctca aatagagcaa ttagcttcac agataccaac aatacctgaa    126600
gatgaattta agcactcaga ggagtataat aaagcttctc aaagcctaga tttactttct    126660
aataaattaa cggagctaaa tcaagtatac tcagaatata ataccaaaga acaagtacta    126720
aaatctgaaa tagctacatt aagcaatagt ctaaataagt tagatacaaa tgaccattgt    126780
cctgtttgtg gctcccctat agataattct cataaattaa aagaacagga aaatattaat    126840
aatcagattg agaataagaa acaagagatt actagtgtat tagaaatgaa agatacgtat    126900
aaagaagcta ttgataaagt aaaagataaa tcacaagaaa ttaaagataa aatgtcacag    126960
gaagaccaac aagaacggga gcacaataat aagattaaca gtataattca agaggcttct    127020
aggattaaat cagacattag ctcattagag aataataaaa cttatttaaa agtgaaatac    127080
caacatcaat ctgttcaagg attagagaga gaagaaccaa gtaaagaaaa acatgaggaa    127140
gataaaaaag aattacaaga atctattgac aaacatgaag agaatatagt acaattagaa    127200
actaagaaag gtaaatatca acaagctgta gatgctttta gtaataaagg tatacgttca    127260
gtagtgttag actttattac accattctta aatgagaaag caaatgagta ccttcaaact    127320
ttatcaggtt cagatattga aatagagttc caaactcaag tgaagaatgc taaaggagaa    127380
ctaaaagata agtttgatgt tattgttaag aatagcaagg gtggaggctc atacaaatct    127440
aattcagcag gagaacaaaa acgtattgat ttagcaatta gttttgcaat tcaggattta    127500
attatgagta aagatgagat atctacgaac attgcacttt acgatgagtg ttttgatggg    127560
ttagatacta tcggttgtga aaacgtgatt aaattattaa agatagact taatacagta    127620
ggaacgatat ttgtaattac tcataatacc gaacttaaac cactatttga acaaacaatt    127680
aaaatagtaa aagaaaatgg agtatcaaaa ctggaggaaa aataatgaaa ttaaagattt    127740
```

FIG. 21QQQ sequence.txt

| | | | | | | |
|---|---|---|---|---|---|---|
| tagataaaga | taatgcaaca | cttaatgtgt | ttcatcgtaa | taaggagcac | aaaacgatag | 127800 |
| ataatgtacc | aactgctaac | ttagttgatt | ggtaccctct | aagtaatgct | tatgaataca | 127860 |
| agttaagtag | aaatggagaa | tatttagaat | taaaaagatt | acgttctact | ttaccttcat | 127920 |
| cttatggttt | agatgataat | aaccaagata | ttattagaga | taataaccat | agatgtaaaa | 127980 |
| taggttattg | gtacaaccct | gcagtacgca | aagataattt | aaagattata | gagaaagcta | 128040 |
| aacaatatgg | attacctgtt | ataacagaag | aatatgatgc | taatactgta | gagcaaggat | 128100 |
| ttagagatat | tggagttata | ttccaaagtc | ttaaaactat | tgttgttact | agatatctag | 128160 |
| aaggtaaaac | agaggaagaa | ttaagaatat | ttaacatgaa | atcagaggaa | tcacaattga | 128220 |
| atgaagcact | taaagagagt | gatttttctg | tagacttaac | ttatagtgat | ttaggacaaa | 128280 |
| tttataatat | gttgttatta | atgaaaaaaa | ttagtaaata | gtaaggaagg | atattatgag | 128340 |
| gtttgaagac | tttttaaccc | aagaattagg | agaaccaaaa | gaaaatacta | taggtgagct | 128400 |
| aagatactgt | tgtccgtttt | gtggagaaaa | aagttataag | ttctatgtta | agcaagccct | 128460 |
| agactctagt | aatggtcagt | atcattgtaa | aaaatgtgat | gaatcaggta | atcctattac | 128520 |
| atttatgaag | acttattata | acattacagg | taagcaagct | tttgatttat | tagagtctaa | 128580 |
| gaatatagat | atagagagag | cccctttact | tacaaccaat | aataaggatt | taacagaatc | 128640 |
| agagaaactt | atattaatgc | ttagaggtgt | gcatcaagat | aagggaacta | ctagtattaa | 128700 |
| acctcctcga | ttacctgaag | gatataaatt | attaaaagat | aacttaaata | taaagagat | 128760 |
| tataccttt | ttaaaatact | taaaaggtag | aggtataact | ttagaacaaa | tcattaataa | 128820 |
| caatataggt | tatgttatta | atgggagctt | ttataaagtt | gacggggaat | ccaaagtatc | 128880 |
| attaaggaat | agtattatat | tttttactta | tgataatgat | ggaaactacc | agtactggaa | 128940 |
| tacaagaagt | atagagaaga | acccttatat | taaatctatt | aatgctcctg | ctaaacaaga | 129000 |
| tgaagtaggt | agaaaagatg | tcatatttaa | tttgaatata | gcaagaaaga | aaaagttctt | 129060 |
| agttataact | gagggtgtat | ttgatgcttt | aacctttcat | gagtatggag | tagcaacatt | 129120 |
| aggtaaacaa | gtaactgaga | atcaaataaa | aaaaataatt | gattatgtta | gtatagatac | 129180 |
| atcaatatat | attatgttag | acactgatgc | attagataat | aatatagact | tagcttataa | 129240 |
| gttaaaaaca | cattttaaca | aagtttactt | tgtaccacat | ggtgatgaag | atgcaaatga | 129300 |
| tatgggaaca | aggaaagctt | ttgagttatt | aaaacagaac | cgggtgttag | taacacctga | 129360 |
| aagtatacag | agttacaaaa | tacaacaaaa | acttaaactt | taggcttgac | cttagagaag | 129420 |
| ttttatgtta | tactagtaat | taagtaatta | ataaaggaga | aaaaaataat | gtcaaataat | 129480 |
| aaaaaagata | ttttagaatt | tgtagatgaa | tacattacag | ctttaagagt | tggtaatgag | 129540 |
| caacgacaac | atcaattaga | agaaatgggt | aaagaagaaa | cagcaacatt | aacagatgta | 129600 |

FIG. 21RRR sequence.txt

| | | | | | | |
|---|---|---|---|---|---|---|
| gctaaagcta | ttactaacct | tatgttaggt | gttaatgagc | agatgacaga | cttagaatat | 129660 |
| aataacgagt | taaacttaaa | tattttaatt | gatgctttat | ataaagcaga | gcttattaat | 129720 |
| gaagatgtat | tagactacat | tcaagaatca | attgataaat | cacaagaaga | acctaaaaat | 129780 |
| gaagaagaaa | aaggagaaca | agaataatgg | aaaaaaatat | tagcacacac | acaaaaggta | 129840 |
| ttagtcaagc | agacatggag | aaatggattg | aagctgtagt | acaaggaact | gttgatggta | 129900 |
| aacaagttga | tgagaaaaca | gctaaacaat | tagatagaat | tggttcacga | agtgtttctt | 129960 |
| tagaagaagc | aactcgtatt | gctaaagtcc | ttaatgctgt | aacagctcaa | gaggttacag | 130020 |
| gagactttaa | tgatgcattt | aatgcaattg | acttaatgat | gattatcatg | gaagatgagt | 130080 |
| taggagtaac | tcaagaaaaa | gtaggtaaag | ctaaagataa | actaaatgaa | aaacgagaag | 130140 |
| cttacctaaa | agagaaacaa | gaagaattac | gtcaaaaaca | acaagaagag | gcacaaaaag | 130200 |
| aaactgaatc | tgacagcaat | gaaaaagtaa | ttcagttgaa | gaaaaatgac | gaacagtaag | 130260 |
| aaaaaagggg | atacattcga | acgtaaaata | gctaaagaat | taactgcttg | gtggggatac | 130320 |
| caattcaata | ggtctcctca | atcaggtggt | gcttcatggg | gtaaagataa | taatgctgtc | 130380 |
| ggagatatag | tagtaccccca | ggaagctaat | tttcctttag | tagtagaatg | taaacataga | 130440 |
| gaagaatgga | ctatagataa | cgttctttta | aacaacagag | agccacacac | atggtgggag | 130500 |
| caagtcatta | atgatagtag | taaggtgaat | aagacacctt | gcttaatatt | tactagaaat | 130560 |
| agagctcaga | gttatgttgc | tttaccttat | aatgaaaaag | tatatgaaga | tttaagaaat | 130620 |
| aatgaatacc | ctgtcatgag | aacagatttt | attattgata | atattagaaa | agataaattt | 130680 |
| ttttatgatg | tccttataac | taccatgaat | gggttgacct | catttacacc | ttcttatatt | 130740 |
| atatcttgct | acgacaaaaa | agatataaaa | ccatacaaga | aggtcgagtc | taatttatct | 130800 |
| gaggtaagta | agcatgaaga | tgaattgatt | aatgaccttc | ttagtgatat | ataaggaagg | 130860 |
| taagataagt | atgacaagca | agaaagacc | attaatcgta | tatttttcag | gtacaggaca | 130920 |
| aacagaaaga | ttagtaaaca | aaattaatat | taataattca | tttgaaacat | ttagggttaa | 130980 |
| gagtggaaaa | gaaaaagtaa | ataaacctttt | tatactaata | acacctactt | ataagaaagg | 131040 |
| tgcaatacct | aaacaaatag | aaagattcct | agaaattaat | gggagcccta | aagaagttat | 131100 |
| tggcacagga | aataaacaat | ggggctctaa | tttctgtgga | gcaagtaaaa | agatttcaga | 131160 |
| gatgtttaag | attcctttaa | ttgctaaagt | agagcaatca | ggacacttta | acgagataca | 131220 |
| accaatatta | gaacacttta | gtaataaata | taaagtagcg | taaaggatga | gagatatatg | 131280 |
| gcaacatatg | gaaaatggat | tgagttaaat | aatgaaataa | ctcaattaga | tgacaatgga | 131340 |
| aaaaataaac | tctataaaga | ccaagaagct | ttagatgagt | atttaaaata | tattgaagac | 131400 |
| aatacaagaa | agtttaatag | tgaagtagaa | agaattagag | tattgacaaa | agaaggaaca | 131460 |
| tatgataaaa | tatttgacaa | ggttcctgac | actattattg | atgagatgac | taagttagct | 131520 |

FIG. 21SSS sequence.txt

| | | | | | | |
|---|---|---|---|---|---|---|
| tacagtttta | attttaaatt | ccctagtttc | atggcaggac | aaaagtttta | tgaatcttac | 131580 |
| gcatcaaaac | agtatgatga | aaacaaaaaa | cctattttg | ttgaagacta | tgaacaacat | 131640 |
| aatgttcgag | tagctttata | tttatttcaa | aatgactatg | taaaggctag | agaattacta | 131700 |
| gtacaactta | tggagcaaac | attccaacca | tctacaccta | cgtataataa | ctcaggtcaa | 131760 |
| gctaatagag | gtgaactaag | ctcatgttat | ctatttgtag | tagatgattc | aattgagtct | 131820 |
| ttaaactttg | ttgaggatag | cgtagctaat | gctagttcta | atggtggcgg | agttgcaatt | 131880 |
| gatttaacta | gaattagacc | taaaggagct | ccagtacgta | atagacctaa | ttcaagtaaa | 131940 |
| ggtgttattg | cttttgctaa | agctattgaa | cataaagtta | gtatttatga | ccagggcggt | 132000 |
| gtaagacaag | gtagtggtgc | tgtttaccta | aatatattcc | acaatgatat | cttggattta | 132060 |
| ttaagctcta | agaaaatcaa | tgccagtgaa | tctgttagac | tagataaatt | atctattggt | 132120 |
| gttacaatcc | ctaacaaatt | tatggagtta | gttaaagaag | gtagacctt | ctatactttt | 132180 |
| gatacttacg | acattaataa | agtgtatggt | aagtatttag | atgagctaaa | cattgatgaa | 132240 |
| tggtatgata | agttactaga | taatgatagt | atcggtaaag | taaaacatga | tgctagagaa | 132300 |
| gttatgacag | atattgctaa | aacgcaatta | gaatcaggat | acccttatgt | attctatatt | 132360 |
| gataatgcta | atgataatca | tccattgaaa | aacctaggta | aagttaaaat | gagtaactta | 132420 |
| tgtacagaaa | tttcacaatt | acaagaggta | tcagaaattt | atccgtactc | ttacagtaat | 132480 |
| aagaatgtta | ttaatagaga | tgttgtttgt | acattaggtt | ctcttaacctt | ggttaatgtg | 132540 |
| gttgaaaaag | gtttattgaa | tgaatctgta | gatattggta | caagagcatt | aacaaaagtt | 132600 |
| actgatatta | tggatttacc | ttacttacct | agtgttcaaa | aagcaaatga | tgatattaga | 132660 |
| gctatcggtt | taggttcaat | gaatttacat | ggactttag | ctaagaatat | gattagttat | 132720 |
| ggttctagag | aagcattaga | cctagtaaac | agtttatata | gtgctattaa | cttccagtct | 132780 |
| attaagacat | ctatgttaat | ggctaaagaa | acaggaaaac | catttaaagg | atttgagaag | 132840 |
| tccgattacg | ctacaggtga | atactttgta | agatatatta | gagaatccaa | tcaacctaag | 132900 |
| acagataaag | ctaagaaagt | cctagataag | gtttatattc | caacacaaga | tgattgggat | 132960 |
| gaattagcta | aagcagtaaa | agtacatggc | ttgtataatg | gttatagaaa | agcagaagca | 133020 |
| cctactcaat | ctatatctta | tgtacagaat | gctacaagtt | ctattatgcc | agttcctagt | 133080 |
| gctatagaga | atagacaata | tggagatatg | gagacatatt | acccaatgcc | ttacctaagt | 133140 |
| cctataactc | agttcttcta | tgaaggagaa | acagcttata | agattgacaa | taaacgtatt | 133200 |
| attaatacaa | gcgcagttgt | tcagaaacat | acagaccaag | cagtatctac | aatcctttat | 133260 |
| gtagagtcag | aaatacctac | taataaacta | gtatcattat | actattatgc | ttgggaacaa | 133320 |
| ggattaaaat | cattatacta | tacacgttca | cgtaaacttt | ctgttattga | atgtgaaaca | 133380 |

FIG. 21TTT sequence.txt

```
tgttcggttt agaaaggaaa tagatatgga tattacacaa aaagtaaaac aacataataa    133440
aaatgctgta ttaaaagcaa caaactggaa tattgaagat gacgggatgt ctgatattta    133500
ttgggagcaa ggaatttccc aattttggac tcctgaagag tttgatgtat caagagattt    133560
aagttcttgg aatagtttaa ctgaaagtga aagaacact tataagaaag tccttgcagg     133620
gctcacaggg ctcgatacca agcaaggagg agaaggtatg aacttagtat cctaccacga    133680
accaagacct aaataccaag ctgtatttgc gtttatgggt ggtatggaag agatacatgc    133740
taaatcctat agtcatatct ttacaacatt actaagtaat aaagaaacaa gctatctatt    133800
agatacttgg gtcgaagaaa acgactttt aaaagtaaaa gctcagttta tcggatatta    133860
ctatgaccaa ctattaaaac ctaaccctac tgtatttgat agatacatgg ctaaagtagc    133920
tagtgccttt ttagaaagtg cactattcta ctcaggattt tattatcctt tacttcttgc    133980
agggagagga cagatgacac aatcaggagc tattatttat aaaattactc aagatgaagc    134040
ttaccatggt tcagcagtag gattaacagc tcaatatgat tataatcttc taacagaaga    134100
agagaaaaaa caagcagata aagaaactta tgaattatta gatattcttt acactaatga    134160
agtagcgtat acacatagtc tatatgaccc attagaatta agtgaagacg taattaacta    134220
cgttcagtat aattttaata gagctcttca aaaccttgga agagaggact attttaatcc    134280
tgaaccttat aaccctattg tagaaaatca aactaatgta gacagattac gaaatgttga    134340
tttctttagt ggtaaagcag actatgaaaa atctacaaat attaaagata ttaaagatga    134400
agatttttca ttcttagata gtaaagaata cagtactgcc aaggaattcc tataaaaagg    134460
agaaaagata ttatggatag aaaagaagca atggatttac taagtaaagc agaaatatta    134520
tttaaaaaac atgatgagtt ttcatgtgta agtgatatca atgaccctat gaagttattc    134580
agtaactcta aggatgctaa agctgatgat acgtctaagt cttttcagtt agagtttatg    134640
catgatatga ccatgtatac tttatcttat ggctcaggac agttaaaact tattgattta    134700
gcagaaggtt atgaagcaca aaaagctaca gtagttaact catttcccga aattattaaa    134760
acattagaaa aggatgattc agaagatgga aaaatgaat agtttagtag atttaaatac    134820
agcaattaga caaaagaaag atgttattgt catgattaca caagataatt gtggtaagtg    134880
tgagatttta aaaagtgtaa tccctatgtt tcaagagtca ggtgacatta aaaaacctat    134940
cttaacatta aatctagatg ctgaagatgt agatagagaa aaagctgtta agttattcga    135000
tatcatgagt acaccagtat taattggata taagatggt cagttagtta aaaagtatga    135060
agaccaagtt acacctatgc aattacaaga attagagtca ctttaatttg gaatttccta    135120
ctatctgtgc tatactataa tagtacaagg tagtaggatt ttttaatgga aggaagatga    135180
catatcgcaa agaataaaac attaacgata tataatagtg atagatattt taatatacac    135240
acaaaagata aagataaaat taatgaggct attaaagtca cacatggtaa tgaagaagaa    135300
```

FIG. 21UUU sequence.txt

```
attgaaaaga atatggatga attaatatct aagtctagac gatatatcat gagagatgaa    135360
aatcattaca tgttatttaa tgaaaagtac aataatgata gacttataga aaaagtatgt    135420
aaacacggtg gcaaagttac atactatact gattcagtat taccctatta tgttttaaaa    135480
gacttatcta gtcaccctga ctcagaagtc gtttatcgta tgcgcaatgg ttttactgca    135540
aaagaagtag ataatatagc tttgtcattt atgggtacaa aagttattat tgatatttct    135600
gtagtatttc cttatgtaaa cccttatgat attattagaa gtttacatga tattaaaaca    135660
aatgtagatg aagttcattt atcatttcca cgaatattag aagtagatga aaaacaagaa    135720
aaattttatt tctttgatgg tgaagcttat gatttaaaac ctgagtataa agtagatttt    135780
gcggataaaa ttagagtatc tttatcagta tggaaaatgt atatctatat cttaacaagt    135840
agtcgtgatt ttgaggatgt agacaatgta attacgaaac taaaacaaca acgaaagatt    135900
aagatataag gtgattatat gagtacagca aatagaagag atatagcaag aaagatatca    135960
gagaatacag gttactatat ccaggatgta gaggaaatac taagtgcaga gacagatgct    136020
atttctgact tactagaaga aggatatact aaagtaaaga atcataaatt tatgcaaata    136080
gaagttattg aaagaaaagg taaaaaagcg tgggatggtc tgaataaaga atacttccat    136140
ttacctaata gaaaagctat aaaattcaaa ccactaaaag aactagaaga ggttattgat    136200
agacttaatg aagaagagaa ataattctct tctttttta ttgacaaggt ttaaaatata    136260
tggtatagta ttattaagtt aaaaaaggag aggaattaaa tgaaagtatt aatcttattt    136320
gaccacatta gagaagagca tttttctgta agtaaagatg ggagtgtgaa atctaatgta    136380
ctaaatacac ctaatggaaa aacacttaag aaattacttg agaagtgttc taatttaaag    136440
agagataaaa caaacagaga ttatgatatt gattttctct acaatgcagt acctacacct    136500
atcagaaatg actatggtaa aattattaaa tatcaagatg ttaaacaagc agaagtaaag    136560
ccatactatg agagaatgaa taatattatt attgataatt cttatgatat gataattcct    136620
gtaggtaaac taggcgttaa atacttatta aatgttacag ctattggtaa agtaagaggt    136680
gtaccaagta aagtaactat tgaaaatgga acatcttctc atgacgtgtg ggtattacct    136740
acttacagta ttgaatatac taatgtaaat aaaaatagtg aacgtcatgt agtatcagat    136800
ttacaaacag ttggtaagtt tgtagagcaa ggagaagagg catttaaacc taaggaagta    136860
tcttacgagt tggtagataa cattgaaaga gtaagagaaa tattcaataa ggaagtaaag    136920
aatgataatt atgatggcgt agatattacc gcatgggact tagagactaa ctcattaaaa    136980
cctgataaag aaggaagtaa acctttagta ctatctctat catggagaaa tggtcaaggt    137040
gtaactatac ctttatacaa atcagacttt aactgggaaa acggtcaaga tgatattgat    137100
gaagtcttag aattacttaa gaactggtta gctagtaaag aagatattaa agtagcacat    137160
```

FIG. 21VVV

```
                                  sequence.txt
aatggtaagt acgatattaa attcttgatg agtactgaga actttaaaga ttttgagagt    137220
attcaagata ctaaagtagg ttggtaccta gctgttaccc aagaagttaa agaatcttta    137280
agattatctg atttagctta tgaggttaca gatgtcggag gttatgataa accattagaa    137340
gattttaaat tatggtttgt tactaagtta ttaagattct tctcagataa aattaaagag    137400
atacagaaag aaaataaaaa gattgctaag aaggagtatg atgttaaagc tcccgaatat    137460
aaagaatggc tagagaataa actaaatgaa acagtagtag aactagatga tactgagaag    137520
aaatttagag ttagtgaatt agagaaaaag tatattcaac taggtctttc acctgaaatt    137580
gtaaatatga atttagttat gaataacgat gagttcataa gtattgcaga acaatcacct    137640
gagtacatgg ggttatctga ctatgctaag tcttacacat taaatactgc aattaattta    137700
attaatgagt atagagatgt aaaagatgta gttaatgata ttgatggagg taactttaat    137760
tatgattggt tccctattga attaatgcat ccatacgcat caggagatac tgatgtatgt    137820
agaagaattc attgtgatgt agttaagaaa cttaaagaac aagatagacc taaatcaatg    137880
catttattag aagttaatta cccaagactt actaagtctt tagctagaat tgaatcaaat    137940
ggtttatatt gtgacttaga ttatatgaaa gaaaatgatg agtcatacga gtctgagatg    138000
gctaaaaatc atgctacaat gagagagcac tgggctgtta aagaatttga agaataccaa    138060
tacaatcttt accaaatggc gttagaagaa catgagaaaa agccaaaaga tagagataaa    138120
gatatccatc agtatagaga taaatttaaa gatggtaaat ggatgttttc cccaagttcc    138180
ggagaccata aaggtagagt aatttatgat attttaggaa ttcaattacc ttatgataaa    138240
gaatatgtta aggaaaaacc atttaatgct aatgttaaag aagcagacct tacttggcag    138300
gactataaaa cagacaagaa agctattggt tatgcgttag ataatttaga attaaaagat    138360
gatgttagag aacttcttga gttacttaaa tatcatgcta gtatgcagac aaaacgtaat    138420
tcatttacta agaaattacc taatatgatt aataaacaaa acgaacatt acatggttct    138480
tttttctgaga caggtacaga gacatcaaga ctaagtagta gtaaccctaa cttgcaaaac    138540
ttaccggcac acacatcaga tgtaaacaag tttgattaca acatccaat taaacgttca    138600
tttgtttcta gatttgaaaa tggagtacta ctgggagccg actatagcgc cctagagatg    138660
cgtattattg gattatttac taaagaccct gatatgctac aatcattctt aaatggggaa    138720
gatattcata aggctactgc aagtattgtt tataataaac cagtagaaga ggtaactaag    138780
gaagaacgac aagcaactaa agcagttaac ttcgggttag ccttcggtga atcacccttc    138840
tcatttgcag gtaaaaataa tatggaagta agtgaagcag aagaaatatt tgaaaagtac    138900
ttccaaacaa aaccaagtgt aaaaacttct attgacaatg tacatgagtt tgtgcaacaa    138960
tatggttatg ttgatacaat gcacggacat agaagattta ccgttcagc ccaatcaaca    139020
gataaaaaga taaaaaatga aggtctaaga cagtcattta acactattat ccaaggttca    139080
```

FIG. 21WWWW sequence.txt

```
ggcagtttct taacaaacat gtctttaact tacttagatg attttatcca atctcgtaac    139140
ttaaaatcaa aagttattgc cacagtacat gatagtatct taattgattg tcctcctgaa    139200
gaagctaaaa ttatggctaa agtgacaatt catattatgg aaaacttacc atttgatttc    139260
ttaaaagcag aaattgatgg aaaagaagta caatatccta ttgaagctga tatggaaatt    139320
gggttaaact ataatgatat ggttgaatat gatgaggaag aaatagatac atttaattct    139380
taccaaggtt atattaagta tatgatgaat ttacagacct tagaagatta taaagagtca    139440
ggtaaactaa cagatgaaca atttgaaaag gctactaatg ttgttaaaag tgaaaaacat    139500
atttaccaag aaatttaata aaagtattga caatacattt aacttatgtt atactatata    139560
ggtaataaat ataaggagga aaacagagtg aatacaggag agattagatt taatcgttct    139620
atggatgaat ggattataac aagtatgtac caggatgagc taggtgagat gaatattgtt    139680
gttacattct ataatagaga agaaaataaa catggttcta cagttttacc aacagagtca    139740
tctactggag aagtagcaga ggaattggca agtcttgaag aagaatatcc tctagcttta    139800
cctttaagta gtatctcagt taatatttaa aaggaggaac tgataaatgg aaatacacat    139860
tgattcccta gattttacaa actttactat taaagataga aatgggaact cacaagagtt    139920
tgatattaca gatgagttaa gaattacaga gtatacaata caagaggact ttatgcaaca    139980
atcagctaaa tatgcttttt gggcttctat attagagaag gtaagagcat attctgaaat    140040
ggaacaaaga aatctagaaa caattggtag taagctaaac cttacaatta gacaagagta    140100
cgaacaacaa ggtaaaaagc ctactaaaga tatgattgaa tctagtgttt atattcatga    140160
ttcttaccaa caacaactta agttgttga ggcttggaat tataaagtta acaacttca     140220
atatgttgta aaagcttttg agacaagaag agatatgatg attcaattag gtgcagaatt    140280
acgacaaaca aataaaaatg gtggaattac taatccattt tcacattaaa aaataaagta    140340
aagaatataa ttgacaaata taaaaaacta tgttataata aataagtaaa ttaattaaaa    140400
ggagaaaaga taattatgga tttcaatcaa tttattaaca atgaggcaag caaattagaa    140460
agcaataaca gttcttttaa caataatgta gagagctaca aacctaaaaa ccctgtacta    140520
cgtttaggta atattaaaga tgcaaacgga aataaggttg ttaaagaaaa tgcttttgta    140580
cgagtattac ctcctgcaca aggaacaaat gttttcttta aagaatttag aacaacaggt    140640
attaactatt ctaagaaaga tggttctcaa ggattcacag gattaacatt acctgcagaa    140700
gaaggttcat ctgtccttga cccgtacatt caggactgga taacaaatgg tgttcaattt    140760
agtagattcc ctaataaacc aggagtacgc tattcacttc atgtgattga atactttaat    140820
aacaatggtc aaattcaacc aaaaacggat gctcaaggaa atgtaatgat tcaacctatg    140880
gaattatcta acacaggata taagaattta ttagctaact aaaagatac tatgttaaaa    140940
```

FIG. 21XXX

```
                              sequence.txt
ccatcaccta atgcacctca tagctttatc tcagcaaatg aagcattctt agttaatatt    141000
gttaaagcta agaaaggtga aatgtcatgg aaagtaagtg tttatcctaa tgctccttta    141060
ggtgcgttac cgcaaggttg ggaacaacaa ttatctgacc tagaccaatt agcaaaacca    141120
acagaagaac aaaatcctaa ttttgttaac ttcttaatca ataatgttaa taacacagag    141180
ttaagtcatg ataactttaa atttaaccgt gaaacaaatg tcttaggtga agaaccttca    141240
gagcctaaac aagcacctac gcaacaagat gtagatagtc aaatgccaag taatatggga    141300
ggacaaccta atcagcctca gcaaggtcaa gtaggtcagt atgcacaaca aggtcaaagt    141360
aatggtcaag gacagcagtt acaaggtaca caacaaccta tcaataacac gcaatttggt    141420
caaggaactc cttcaggaca acaaccaagt aacacaggtt ctgttgattg ggataactta    141480
gcgcaacaac aatcacaacc tgattcaaac ccattcaatg attttgatgt tagcagtgtt    141540
gatgattcac aggtaccttt tgagacacaa cctcaaaata cacaacaagc acctgaacca    141600
caccaaacta cacaagagcc tccaaaacaa aaacaaacac aaagtattga cgatgtatta    141660
ggtggtctag acttagataa cctataagat atagagtgcc ttagagcact ctttttattta    141720
agatatataa ttactaggag gatattaaat ggcaagagca aaaaaaggta agaagtagaa    141780
tttaacagat ttaaatacaa ttgatttagg taaagaatta ggattaacat tattatcgga    141840
tagcaataga gcagacatta aaaatattgt acctactatg gttcctcagt atgatagaat    141900
tctaggagga ggcatcccat taggtagatt gacagaggtt tacggattaa caggttcagg    141960
taaatcaagt tttgcagtcc atctctctag aatttcaaca cagttaggtg ttataactat    142020
ttggattgat attgaaggta ctgcggacaa taatcgtatg gaacagcttg gcgtagatgt    142080
ttcaaaacta ttctctattc aggcaggtga aggtagactt aaaaatacag tagagttatc    142140
tgtagagact gtaggtaagg aattagatta ctggatagat actttcaacg agaaagcccc    142200
tggagtacct atttttattta tttgggattc attaggagca acaagaactc aagcggagat    142260
tgaagaagga gtagaccata ggaaattagg gacaaaagcc acagctactc aaaaagttat    142320
caacgcagta tctcctaaat taaatgatac aaatacagga ttaattgtta ttaatcaagc    142380
tagagataac ttgaatatgt ctaacccctta tgatgaccct attaagtcca caggagggcg    142440
tgcgttcgag catggagcca gtctaagact taaaattact aaaggtaaag agtccgacct    142500
taaacaatct gattcaatga caggtaaacc tacctataaa ggtcatgtga tgagagtaga    142560
gactaaaaaa tctaaactat ctagaccagg acaaaaagca gaagcagact tactatcagg    142620
atatgaggta ggttctggtt cggatattac ccaactaaat ggaattgacc cttaccatac    142680
tatctataag gaagcagttg aaagaggtct aattacgaaa gggacttgga gaaattatat    142740
cacacttaat ggggaggaaa ttaaacttta tgataaagat tgggttcctc gtttaataga    142800
tgaccatgag ttatacttgg aattatttag tagagtctat ggagaacatt tccctaatgg    142860
```

FIG. 21YYY sequence.txt

| | | | | | | |
|---|---|---|---|---|---|---|
| ttattcacca | ttacttaata | ctaaagtaat | tgtaactcag | ttagaagaat | atcaagcatt | 142920 |
| agagaattac | tatgaagagt | gggctaaaga | taataaacaa | gaagaacaag | aggaagaatc | 142980 |
| aaaaggagaa | tctcaagaaa | aggattctga | ataatagatg | tataatttaa | tagataaaaa | 143040 |
| catgagacag | gtaaaagaat | ctttggggaa | tgcaaattcc | tcagatgttc | ttcctttacc | 143100 |
| ttataaagac | atagcaaaga | aatttgaaga | agtaaaagaa | aaaggtgaat | caattatcat | 143160 |
| tgaagagggt | ggattcccctt | acacagattc | tacagtgatg | tatatagaac | atgtaacaga | 143220 |
| tagatgggca | ggaggatact | ccctaattag | gcatgaaggt | gaagaggtta | aagtacctaa | 143280 |
| aactatccat | ttctctgata | tatatgttaa | ggataaatca | cataaagtaa | gaataatctt | 143340 |
| cgagggggct | aatccttatg | aagaaggcta | aaaatggtaa | tagatatgta | atagatatag | 143400 |
| atggtattcc | tgttgatttt | gaaagagact | tggatagttt | acttaacagg | tataaaaacc | 143460 |
| ttaggtggtc | attatatcat | aagtacgcag | ggattttatc | taatgatttt | gaaagacaag | 143520 |
| aactaagaga | atatattgat | gagcaattta | ttaaattagt | taaagaatat | aatattagaa | 143580 |
| gtaaagtgga | ttttcctgga | tatattaaag | ctaaactaac | tttaagagtt | caaaatagtt | 143640 |
| atgttaagaa | gaatgaaaaa | tataaacgta | ctgaaattat | tggtaaaaaa | gattatacag | 143700 |
| tagagtccctt | aacagaagat | ttaaatgaag | acttcgagga | taatcaaatt | atgagttacg | 143760 |
| tatttgatga | tatagaattt | acagaagttc | aaagtgagtt | acttaaagaa | ttacttatta | 143820 |
| atcctgaaag | agaagatgat | gcctttatcg | tttctcaagt | agcggaaaag | tttgatatga | 143880 |
| aaagaaaaga | agtagcaagt | gagttgacag | aactcagaga | ctatgttaga | tttaaaataa | 143940 |
| atgcatacca | tgagtactat | gctaagaaag | aattaaataa | ccatagagtt | aatactgaaa | 144000 |
| atcatatttg | ggaaaactag | ttacagtgcc | ttccttgtgt | tatataagta | ctactaataa | 144060 |
| tattattagt | agtactttg | atatattatt | tatgtagaag | agaagtgaaa | atagtgagaa | 144120 |
| tagaaaagca | taaaataaag | aataataaag | taattaatga | aatgtctata | acagcaaata | 144180 |
| acctctataa | tcatgctaat | tttattttaa | gacaaaattt | ctttaataat | aagactaata | 144240 |
| aaggatacag | aaagttttta | aattataata | ctattcatag | aatattaaaa | aatatgaatg | 144300 |
| aagagaatta | tattaaactc | ccaagacaaa | catctcaaca | agtattaagg | gatttaatta | 144360 |
| ataactggtc | tagttttaga | aaatcagaaa | aagattattt | taaaaacccct | aataaataca | 144420 |
| gaaatagacc | aaaaccacct | aaatataaag | ctaaaggcgg | taaaggaaca | attaagttta | 144480 |
| ctaatcaaca | atgtagaatt | cataaaaaag | atggtttaat | acatttacct | acacctttac | 144540 |
| aagatataac | tataaaacct | tataaagcta | agaatataag | agaacttgtt | tgtattccta | 144600 |
| aaagtgatta | ttttgaagtt | ttagtatgtt | ataaagaaga | aaatagtaat | aaaacactaa | 144660 |
| atgataacga | aaacatagca | agtattgatt | taggtttaga | taacttgata | accatggttt | 144720 |

FIG. 21ZZZ sequence.txt

```
ctattgtaga taaaccaata attataaatg gtaaaggtct aaaatctaaa aataaatatt    144780
ttaataaaaa aataaggtat tatcaaagtc tattacaaaa caatagttac tcttcgaaaa    144840
gaatattaaa atattgggaa aaaagacaca atattatact agattacttt cataaagcaa    144900
caaacgaagt tgttaaatac tgcgtaaaaa atgatattag taaagtagtt atagggtata    144960
ataaacagca aaagtataaa tctaaattaa aaaa                                144994
```

ANTIBACTERIAL PHAGE, PHAGE PEPTIDES AND METHODS OF USE THEREOF

1. RELATED APPLICATION

This application claims priority from U.S. Provisional Application No. 61/384,015, filed on Sep. 17, 2010, the contents of which are hereby incorporated by reference in their entirety.

2. SEQUENCE LISTING

The instant application contains a Sequence Listing which has been submitted in ASCII format via EFS-Web and is hereby incorporated by reference in its entirety. Said ASCII copy, created on Sep. 14, 2011, is named 16395US1.txt and is 3,295,858 bytes in size.

3. FIELD OF THE INVENTION

The present invention is directed to the field of phage therapy for the treatment and control of bacterial infections. In particular, the present invention is directed to the novel bacteriophage F387/08, F391/08, F394/08, F488/08, F510/08, F44/10, F125/10, isolated polypeptides thereof, compositions comprising one or more of the novel bacteriophage and/or isolated polypeptides; and methods for the treatment and prevention of bacterial infections caused by, e.g., *Staphylococcus aureus, Klebsiella pneumoniae, Acinetobacter baumannii, Escherichia coli*, and/or *Pseudomonas aeruginosa*, either alone or in combination with other therapies, e.g., antibiotics or other phage therapies.

4. BACKGROUND

Bacteriophage (phage) are viruses that specifically infect and lyse bacteria. Phage therapy, a method of using whole phage viruses for the treatment of bacterial infectious diseases, was introduced in the 1920s by Felix d'Herelle. Initially, phage therapy was vigorously investigated and numerous studies were undertaken to assess the potential of phage therapy for the treatment of bacterial infection in humans and animals. Early success prompted the development of multiple commercial phage preparations. For example, in 1940 Eli Lilly Company produced 7 phage products for human use, including phage preparations for treating different sicknesses caused by *Staphylococcus* sp., *E. coli* and other pathogenic bacteria. These preparations were used, for example, to treat infections that cause abscesses, purulent wounds, vaginitis, acute chronic upper-respiratory tract infections, and mastoid infections.

With the development of antibiotics in the 1940s, however, interest in phage-based therapeutics declined in the Western world. One of the most important factors that contributed to this decline was the lack of standardized testing protocols and methods of production. The failure to develop industry wide standards for the testing of phage therapies interfered with the documentation of study results, leading to a perceived lack of efficacy as well as problems of credibility regarding the value of phage therapy. Further, problems related to the production of phage samples/specimens complicated initial study and research. Diverse stabilizers and preservatives were initially used in attempts to increase the viability of the phage therapeutics. However, because the biology of both the phage and the various stabilizers were poorly understood, many of the ingredients added in an attempt to prolong the viability of phage preparations proved to be either toxic to humans or to negatively impact long term storage. Another problem in phage production related to the purity grade of the commercial preparations of the phage. At the time, phage therapy preparations generally consisted of raw lysates of host bacteria that had been treated with the phage of interest. Thus, many preparations contained what are now recognized to be undesired bacterial components, e.g., endotoxins. Accordingly, adverse events were often associated with the preparations, particularly in patients receiving them intravenously. Nevertheless, in Eastern Europe and the former Soviet Union, where access to antibiotics was limited, the development and use of phage therapy continued jointly with, or in place of, antibiotics.

With the rise of antibiotic resistant strains of many bacteria, however, interest in phage-based therapeutics has returned in the Western world. Even though novel classes of antibiotics may be developed, the prospect that bacteria will eventually develop resistance to the new drugs has intensified the search for non-chemotherapeutic means for controlling, preventing, and treating bacterial infections. There are three main phage-based strategies for using phage therapy in a clinical environment: 1) administering virulent phage; 2) using endolysins or purified lysins encoded by bacteriophage 3) using structural proteins of phage as metabolic inhibitors of key bacterial enzymes, such as enzymes that synthesize peptidoglycan.

There is therefore a need to develop novel bacteriophage and phage products as potential therapeutic and/or prophylactic agents for use in vivo against pathogenic bacteria. In particular, there is a need for bacteriophage capable of lysing nosocomial bacteria, including *Styphylococcus aureus, Klebsiella pneumoniae, Acinetobacter baumannii, Escherichia coli*, and/or *Pseudomonas aeruginosa*. Because most phage and phage peptides studied to date exhibit activity directed specifically against the species (or subspecies) of bacteria from which they are isolated, the novel phage-based therapies may find particular use in the hospital setting, selectively targeting nosocomial pathogens without affecting the normal surrounding flora.

5. SUMMARY OF THE INVENTION

The present invention is directed to isolated bacteriophage and to isolated antibacterial polypeptides of bacteriophage origin for the treatment, prevention, or management of conditions associated with infection by Gram-positive or Gram-negative bacteria. In particular, the isolated bacteriophage or polypeptides of the invention may be used in pharmaceutical compositions for the treatment, prophylaxis, or management of infection by nosocomial pathogens, e.g., Gram-negative bacteria including but not limited to *Klebsiella pneumoniae, Acinetobacter baumannii, Escherichia coli*, and *Pseudomonas aeruginosa*; and Gram-positive bacteria including but not limited to *Staphylococcus aureus*. In certain embodiments, the pharmaceutical compositions of the invention are of use in the treatment of conditions associated with infection by antibiotic resistant strains of bacteria, e.g., methicillin resistant strains of *Staphylococcus aureus* (MRSA). In particular embodiments, the isolated bacteriophage or polypeptides of the invention are used for the topical treatment of infection by nosocomial pathogens in a subject in need thereof. In other embodiments, the isolated bacteriophage or polypeptides of the invention are used for the diagnosis of the infective agent in a sample (e.g., tissue, blood, urine, sputum sample) derived from a patient. In other embodiments, the isolated bacteriophage or polypeptides of the invention are used as a prophylactic disinfectant or anti-infective for the preparation of solid surfaces, including skin or other epidermal surfaces.

In certain embodiments, the invention provides an isolated bacteriophage, F391/08, having a genome comprising the nucleic acid sequence of SEQ ID NO:1 (FIGS. 15A-15III) and exhibiting antibacterial activity against one or more strains of *Klebsiella pneumoniae*. In other embodiments, the invention provides an isolated bacteriophage, F394/08, having a genome comprising the nucleic acid sequence of SEQ ID NO:2 (FIGS. 16A-16Q) and exhibiting antibacterial activity against one or more strains of *Acinetobacter baumannii*. In yet other embodiments, the invention provides an isolated bacteriophage, F488/08, having a genome comprising the nucleic acid sequence of SEQ ID NO:3 (FIGS. 17A-17KKKK) and exhibiting antibacterial activity against one or more strains of *Escherichia coli*. In still yet other embodiments, the invention provides an isolated bacteriophage, F510/08, having a genome comprising the nucleic acid sequence of SEQ ID NO:4 (FIGS. 18A-18X) and exhibiting antibacterial activity against one or more strains of *Pseudomonas aeruginosa*. In still yet further embodiments, the invention provides an isolated bacteriophage, F44/10, having a genome comprising the nucleic acid sequence of SEQ ID NO:560 (FIGS. 19A-19UUU) and exhibiting antibacterial activity against one or more strains of *Staphylococcus aureus*. In still yet further embodiments, the invention provides an isolated bacteriophage, F387/08, having a genome comprising the nucleic acid sequence of SEQ ID NO:781 (FIGS. 20A-20KKKK) and exhibiting antibacterial activity against one or more strains of *Klebsiella pneumoniae*. In still yet further embodiments, the invention provides an isolated bacteriophage, F125/10, having a genome comprising the nucleic acid sequence of SEQ ID NO:1074 (FIGS. 21A-21ZZZ) and exhibiting antibacterial activity against one or more strains of *Staphylococcus aureus*.

The invention also encompasses isolated bacteria infected with one or more bacteriophage of the invention. In specific embodiments, the invention provides an isolated *K. pneumoniae* infected with a bacteriophage having a genome comprising or consisting of the nucleic acid sequence of SEQ ID NO:1. In other embodiments, the invention provides an isolated *A. baumannii* infected with a bacteriophage having a genome comprising or consisting of the nucleic acid sequence of SEQ ID NO:2. In still other embodiments, the invention provides an isolated *E. coli* infected with a bacteriophage having a genome comprising or consisting of the nucleic acid sequence of SEQ ID NO:3. In yet other embodiments, the invention provides an isolated *P. aeruginosa* infected with one or more bacteriophage having a genome comprising or consisting of the nucleic acid sequence of SEQ ID NO:4. In still yet other embodiments, the invention provides an isolated *S. aureus* infected with one or more bacteriophage having a genome comprising or consisting of the nucleic acid sequence of SEQ ID NO:560. In still yet further embodiments, the invention provides an isolated *K. pneumoniae* infected with one or more bacteriophage having a genome comprising or consisting of the nucleic acid sequence of SEQ ID NO: 781. In still yet further embodiments, the invention provides an isolated *S. aureus* infected with one or more bacteriophage having a genome comprising or consisting of the nucleic acid sequence of SEQ ID NO: 1074.

The present invention encompasses polypeptides isolated from bacteriophage F387/08, F391/08, F394/08, F488/08, F510/08, F44/10, and/or F125/10, which polypeptides exhibit antibacterial activity against one or more species or strains of Gram-positive or Gram-negative bacterium, e.g., *K. pneumoniae*, *A. baumannii*, *E. coli*, *P. aeruginosa*, and/or *S. aureus*. In specific embodiments, the polypeptides of the invention isolated or derived from F387/08 and F3910/08 exhibit antibacterial or antimicrobial activity, e.g., lytic killing activity, against at least *K. pneumoniae*; those isolated or derived from F394/08, against at least *A. baumannii*; those isolated or derived from F488/08, against at least *E. coli*; those isolated or derived from F510/08 against at least *P. aeruginosa*; and those isolated or derived from F44/10 and F125/10 against at least *S. aureus*.

In certain embodiments, a polypeptide of the invention comprises or consists of an isolated lysin, or fragment thereof (e.g., a CHAP domain) that exhibits antibacterial activity against one or more species or strains of bacteria, e.g., Gram-positive bacteria, such as *S. aureus*; and/or Gram-negative bacteria, such as *K. pneumoniae A. baumannii*, *E. coli*, and/or *P. aeruginosa*. In specific embodiments, the polypeptide of the invention is an isolated lysin protein, e.g., an endolysin or tail lysin, comprising or consisting of the amino acid sequence SEQ ID NO: 20, SEQ ID NO: 80, SEQ ID NO: 192, SEQ ID NO: 282, SEQ ID NO: 547, SEQ ID NO: 556, SEQ ID NO: 557, SEQ ID NO: 598, SEQ ID NO: 1216, or SEQ ID NO: 1261. Predicted functions of said lysin proteins include, for example an Ig-like virion protein (SEQ ID NO: 20), cell wall hydrolase (SEQ ID NO: 80), N-acetylmuramoyl-L-alanine amidase (SEQ ID NO: 192), soluble lysozyme (SEQ ID NO: 282), T4-like lysozyme (SEQ ID NO: 547), endolysin (SEQ ID NO: 556), lambda Rz1-like protein (SEQ ID NO: 557), endolysin (SEQ ID NO: 598), endolysin (SEQ ID NO: 1216), and tail lysin (SEQ ID NO: 1261).

In other embodiments, a polypeptide of the invention comprises a fragment, variant or derivative of SEQ ID NO: 20, SEQ ID NO: 80, SEQ ID NO: 192, SEQ ID NO: 282, SEQ ID NO: 547, SEQ ID NO: 556, SEQ ID NO: 557, SEQ ID NO: 598, SEQ ID NO: 1216, or SEQ ID NO: 1261, wherein said fragment, variant or derivative has antibacterial activity or antimicrobial activity, e.g., lytic killing activity, against one or more strains of *K. pneumoniae A. baumannii*, *E. coli*, *P. aeruginosa*, and/or *S. aureus*. In specific examples in accordance with this embodiment, the variant, fragment or derivative of the amino acid sequence of SEQ ID NO: 20 and/or SEQ ID NO: 80 exhibits antibacterial or antimicrobial activity (e.g., lytic killing activity) against one or more strains of *K. pneumoniae*, for example, against the bacteriophage having a genome comprising or consisting of the nucleic acid sequence SEQ ID NO: 1. In other examples in accordance with this embodiment, the variant, fragment or derivative of the amino acid sequence of SEQ ID NO: 192 exhibits antibacterial or antimicrobial activity (e.g., lytic killing activity) against one or more strains of *A. baumannii*, for example, against the bacteriophage having a genome comprising or consisting of the nucleic acid sequence SEQ ID NO: 2. In other examples in accordance with this embodiment, the variant, fragment or derivative of the amino acid sequence of SEQ ID NO: 282 exhibits antibacterial or antimicrobial activity (e.g., lytic killing activity) against one or more strains of *E. coli*, for example, against the bacteriophage having a genome comprising or consisting of the nucleic acid sequence SEQ ID NO: 3. In other examples in accordance with this embodiment, the variant, fragment or derivative of the amino acid sequence of SEQ ID NO: 547, SEQ ID NO: 556, and/or SEQ ID NO: 557 exhibits antibacterial or antimicrobial activity (e.g., lytic killing activity) against one or more strains of *P. aeruginosa*, for example, against the bacteriophage having a genome comprising or consisting of the nucleic acid sequence SEQ ID NO: 4. In other examples in accordance with this embodiment, the variant, fragment or derivative of the amino acid sequence of SEQ ID NO: 598, SEQ ID NO: 1216, and/or SEQ ID NO: 1261 exhibits antibacterial or antimicrobial activity (e.g., lytic killing activity) against one or more strains of *S. aureus*, for example, against the bacteriophage having a genome comprising or consisting of the nucleic acid sequence SEQ ID NO: 560 or SEQ ID NO: 1074.

In specific embodiments, the isolated polypeptide of the invention comprises or consists of the CHAP domain of SEQ ID NO: 20, SEQ ID NO: 80, SEQ ID NO: 192, SEQ ID NO: 282, SEQ ID NO: 547, SEQ ID NO: 556, SEQ ID NO: 557, or SEQ ID NO: 598. In yet still other embodiments, a polypeptide of the invention comprises a fragment, variant or derivative of the CHAP domain of SEQ ID NO: 20, SEQ ID NO: 80, SEQ ID NO: 192, SEQ ID NO: 282, SEQ ID NO: 547, SEQ ID NO: 556, SEQ ID NO: 557, or SEQ ID NO: 598, wherein said fragment, variant or derivative has antibacterial activity or antimicrobial activity, e.g., lytic killing activity, against at least one or more strains of *K. pneumoniae A. baumannii, E. coli, P. aeruginosa*, and/or *S. aureus*.

In other embodiments, a polypeptide of the invention comprises or consists of an isolated tail protein (e.g., tail component, tail fiber protein, tail length tape measure protein, adsorption associated tail protein, major tail protein, major tail sheath protein, baseplate wedge subunit), or fragment thereof, having a biological function associated with the bacteriophage from which it is derived, e.g., antimicrobial or antibacterial activity (e.g., lytic killing activity), which function is directed against at least one or more species or strains of *K. pneumoniae, A. baumannii, E. coli, P. aeruginosa*, and/or *S. aureus*.

In specific embodiments, the polypeptide of the invention is an isolated tail protein comprising or consisting of the amino acid sequence SEQ ID NO: 15, SEQ ID NO: 26, SEQ ID NO: 27, SEQ ID NO: 30, SEQ ID NOs: 32-35, SEQ ID NO: 180, SEQ ID NO: 183, SEQ ID NO: 185, SEQ ID NO: 190, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-496, SEQ ID NO: 544, SEQ ID NO: 545, SEQ ID NO: 549, SEQ ID NO: 551, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1217, SEQ ID NO: 1250, or SEQ ID NO: 1266. In other embodiments, a polypeptide of the invention comprises a fragment, variant or derivative of SEQ ID NO: 15, SEQ ID NO: 26, SEQ ID NO: 27, SEQ ID NO: 30, SEQ ID NOs: 32-35, SEQ ID NO: 180, SEQ ID NO: 183, SEQ ID NO: 185, SEQ ID NO: 190, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-496, SEQ ID NO: 544, SEQ ID NO: 545, SEQ ID NO: 549, SEQ ID NO: 551, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1217, SEQ ID NO: 1250, or SEQ ID NO: 1266, wherein said fragment, variant or derivative exhibits a biological function associated with the bacteriophage from which it is derived, e.g., antimicrobial or antibacterial activity (e.g., lytic killing activity), which function is directed against one or more strains of *K. pneumoniae, A. baumannii, E. coli, P. aeruginosa*, and/or *S. aureus*.

Predicted functions of said tail proteins include, for example, a receptor-binding tail protein (SEQ ID NO: 15), major tail protein (SEQ ID NO: 26 and SEQ ID NO: 1077), minor tail protein (SEQ ID NO: 27), pore-forming tail tip protein (SEQ ID NO: 30), tail protein (SEQ ID NOs: 32-33), minor tail protein (SEQ ID NO: 34), phage tail protein (SEQ ID NO: 35), tail sheath protein (SEQ ID NO: 180), tail tape measure protein (SEQ ID NO: 183), tail protein (SEQ ID NO: 185), tail-fiber protein (SEQ ID NO: 190), tail tube protein (SEQ ID NO: 231), tail sheath monomer (SEQ ID NO: 232), tail sheath stabilizer and completion protein (SEQ ID NO:235), short tail fibers (SEQ ID NO: 239), base plate wedge completion tail pin (SEQ ID NOs: 240-241), base plate wedge completion tail fiber socket (SEQ ID NO: 242), base plate wedge subunit (SEQ ID NO: 243), base plate wedge initiator (SEQ ID NO: 244), base plate wedge (SEQ ID NO: 245), base plate hub subunit and tail lysozyme, cell-puncturing device (SEQ ID NO: 248), base plate wedge completion (SEQ ID NO: 249), tail completion and sheath stabilizer protein (SEQ ID NO: 252), chaperone long and short tail fiber assembly (SEQ ID NO: 254), tail fiber protein (SEQ ID NO: 433), tail fiber protein (SEQ ID NO: 434), hinge connector long tail fiber (SEQ ID NO: 435), tail fiber hinge (SEQ ID NO: 436), proximal tail fiber subunit (SEQ ID NO: 437), base plate-tail tube initiatior (SEQ ID NO: 489), base plate (SEQ ID NO: 490), baseplate hub subunit, tail length determinator (SEQ ID NO: 491), base plate distal hub subunit (SEQ ID NO: 492), base plate hub subunit (SEQ ID NO: 493), base plate hub assembly catalyst (SEQ ID NO: 494), base-plate hub subunit (SEQ ID NO: 495), baseplate wedge subunit (SEQ ID NO: 496), tail tubular protein (SEQ ID NOs: 544-545), tail fiber protein (SEQ ID NO: 549 and SEQ ID NO: 551), major tail sheath protein (SEQ ID NO: 629 and SEQ ID NO: 1250), major tail protein (SEQ ID NO: 686), tail tube protein (SEQ ID NO: 789), fibritin (SEQ ID NO: 796), short tail fibers (SEQ ID NO: 797), base plate wedge completion tail pin (SEQ ID NO: 798), base plate wedge subunit and tail pin (SEQ ID NO: 799), baseplate wedge tail fiber connector (SEQ ID NO: 800), baseplate hub subunit and lysozyme (SEQ ID NO: 806), lysozyme (SEQ ID NO: 854), holin (SEQ ID NO: 999 and SEQ ID NO: 1217), distal long tail fiber assembly catalyst (SEQ ID NO: 1000), L-shaped tail fiber protein (SEQ ID NO: 1001), hinge connector of long tail fiber distal connector (SEQ ID NO: 1002), hinge connector of long tail fiber proximal connector (SEQ ID NO: 1003), long tail fiber proximal subunit (SEQ ID NO: 1004), baseplate tail tube initiator (SEQ ID NO: 1053), baseplate tail tube cap (SEQ ID NO: 1054), baseplate hub subunit, tail length determinator (SEQ ID NO: 1055), baseplate distal hub subunit (SEQ ID NO: 1056), baseplate hub subunit (SEQ ID NOs: 1057 and 1059), baseplate hub assembly catalyst (SEQ ID NO: 1058), baseplate wedge subunit (SEQ ID NO: 1060), and baseplate protein (SEQ ID NO: 1266).

In certain embodiments, the invention encompasses a variant, fragment or derivative of the amino acid sequence of SEQ ID NO: 15, SEQ ID NO: 26, SEQ ID NO: 27, SEQ ID NO: 30, or SEQ ID NOs: 32-35, which exhibits a biological function associated with the bacteriophage having a genome comprising or consisting of the nucleic acid sequence SEQ ID NO: 1, e.g., antimicrobial or antibacterial activity (e.g., lytic killing activity), which function is directed against one or more strains of *K. pneumoniae*. In other embodiments, the invention encompasses a variant, fragment or derivative of the amino acid sequence of SEQ ID NO: 180, SEQ ID NO: 183, SEQ ID NO: 185, or SEQ ID NO: 190, which exhibits a biological function associated with the bacteriophage having a genome comprising or consisting of the nucleic acid sequence SEQ ID NO: 2, e.g., antimicrobial or antibacterial activity (e.g., lytic killing activity), which function is directed against one or more strains of *A. baumannii*.

In certain embodiments, the invention encompasses a variant, fragment or derivative of the amino acid sequence of SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-495, or SEQ ID NO: 496, which exhibits a biological function associated with the bacteriophage having a genome comprising or consisting of the nucleic acid sequence SEQ ID NO: 3, e.g., antimicrobial or antibacterial activity (e.g., lytic killing activity), which function is directed against one or more strains of E. coli. In certain embodiments, the invention encompasses a variant, fragment or derivative of the amino acid sequence of SEQ ID NO: 544, SEQ ID NO: 545, SEQ ID NO: 549, or SEQ ID NO: 551, which exhibits a biological function associated with the bacteriophage having a genome comprising or consisting of the nucleic acid sequence SEQ ID NO: 4, e.g., antimicrobial or antibacterial activity (e.g., lytic killing activity), which function is directed against one or more strains of P. aeruginosa. In still other embodiments, the invention encompasses a variant, fragment or derivative of the amino acid sequence of SEQ ID NO: 629 or SEQ ID NO: 686, which exhibits a biological function associated with the bacteriophage having a genome comprising or consisting of the nucleic acid sequence SEQ ID NO: 560, e.g., antimicrobial or antibacterial activity (e.g., lytic killing activity), which function is directed against one or more strains of S. aureus. In still other embodiments, the invention encompasses a variant, fragment or derivative of the amino acid sequence of SEQ ID NO: 789, SEQ ID NOs: 796-800, SEQ ID NO: 806, SEQ ID NO: 854, SEQ ID NOs: 999-1004, or SEQ ID NOs: 1053-1060, which exhibits a biological function associated with the bacteriophage having a genome comprising or consisting of the nucleic acid sequence SEQ ID NO: 781, e.g., antimicrobial or antibacterial activity (e.g., lytic killing activity), which function is directed against one or more strains of K. pneumoniae. In still other embodiments, the invention encompasses a variant, fragment or derivative of the amino acid sequence of SEQ ID NO: 1077, SEQ ID NO: 1217, SEQ ID NO: 1250, or SEQ ID NO: 1266, which exhibits a biological function associated with the bacteriophage having a genome comprising or consisting of the nucleic acid sequence SEQ ID NO: 1074, e.g., antimicrobial or antibacterial activity (e.g., lytic killing activity), which function is directed against one or more strains of S. aureus.

In certain embodiments, the invention provides for isolated polypeptides that exhibit antimicrobial or antibacterial activity (e.g., lytic killing activity) against one or more strains of bacteria, e.g., Gram-positive bacteria (e.g., S. aureus), Gram-negative bacteria (e.g., K. pneumoniae, A. baumannii, E. coli, and P. aeruginosa) or bacteria not classified as either Gram-positive or Gram-negative, wherein the isolated polypeptides have an amino acid sequence with at least 60%, 65%, 70%, 75%, 80%, 85%, 86%, 87%, 88%, 89%, 90%, 91%, 92%, 93%, 94%, 95%, 96%, 97%, 98%, 99%, or greater sequence identity to a second amino acid sequence of the same length (i.e., consisting of the same number of residues), which second amino acid sequence is of SEQ ID NO: 15, SEQ ID NO: 20, SEQ ID NO: 26, SEQ ID NO: 27, SEQ ID NO: 30, SEQ ID NOs: 32-35, SEQ ID NO: 80, SEQ ID NO: 180, SEQ ID NO: 183, SEQ ID NO: 185, SEQ ID NO: 190, SEQ ID NO: 192, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NO: 282, SEQ ID NOs: 433-437, SEQ ID NOs: 489-496, SEQ ID NO: 544, SEQ ID NO: 545, SEQ ID NO: 547, SEQ ID NO: 549, SEQ ID NO: 551, SEQ ID NO: 556, SEQ ID NO: 557, SEQ ID NO: 598, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1216, SEQ ID NO: 1217, SEQ ID NO: 1250, SEQ ID NO: 1261, SEQ ID NO: 1266, and/or a fragment thereof.

The invention further provides isolated polypeptides comprising or consisting of the amino acid sequence of any of SEQ ID NOs: 5-176, SEQ ID NOs: 177-223, SEQ ID NOs: 224-506, SEQ ID NOs: 507-559, SEQ ID NOs: 561-780, SEQ ID NOs: 782-1073, and SEQ ID NOs: 1075-1300. In other embodiments, isolated polypeptides of the invention recombinantly fused or chemically conjugated (e.g., covalent or non-covalent conjugation) to therapeutic agents (e.g., heterologous polypeptides or small molecules) are provided.

The invention also encompasses polynucleotides that encode the polypeptides of the invention. In a specific embodiment, the invention provides an isolated nucleic acid comprising a nucleic acid sequence encoding the polypeptide of any of SEQ ID NOs: 5-176, SEQ ID NOs: 177-223, SEQ ID NOs: 224-506, SEQ ID NOs: 507-559, SEQ ID NOs: 561-780, SEQ ID NOs: 782-1073, and SEQ ID NOs: 1075-1300. In other embodiments, the invention provides an isolated nucleic acid comprising a nucleic acid sequence encoding the polypeptide of any of SEQ ID NO: 15, SEQ ID NO: 20, SEQ ID NO: 26, SEQ ID NO: 27, SEQ ID NO: 30, SEQ ID NOs: 32-35, SEQ ID NO: 80, SEQ ID NO: 180, SEQ ID NO: 183, SEQ ID NO: 185, SEQ ID NO: 190, SEQ ID NO: 192, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NO: 282, SEQ ID NOs: 433-437, SEQ ID NOs: 489-496, SEQ ID NO: 544, SEQ ID NO: 545, SEQ ID NO: 547, SEQ ID NO: 549, SEQ ID NO: 551, SEQ ID NO: 556, SEQ ID NO: 557, SEQ ID NO: 598, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1216, SEQ ID NO: 1217, SEQ ID NO: 1250, SEQ ID NO: 1261, or SEQ ID NO: 1266, or active fragment, variant or derivative thereof, which polypeptide or active fragment, variant or derivative exhibits a biological function associated with the bacteriophage from which it is isolated and/or derived, e.g., antimicrobial or antibacterial activity (e.g., lytic killing activity). The invention also relates to a vector comprising one or more of said nucleic acids. In one specific embodiment, said vector is an expression vector. The invention further provides host cells containing a vector comprising one or more polynucleotides one or more encoding the polypeptides of the invention.

The present invention encompasses methods for the production of polypeptides of the invention or active fragments thereof, in particular for use in pharmaceutical compositions, i.e., antimicrobial compositions. For example, the polypeptides of the invention may be isolated directly from cell cultures (e.g., bacterial cell cultures) infected with bacteriophage F387/08, F391/08, F394/08, F488/08, F510/08, F44/10, and/or F125/10. Alternatively, the polypeptides of the present invention may be derived by recombinant means using expression vectors comprising nucleic acid sequence encoding polypeptides of the invention, e.g., SEQ ID NO: 15, SEQ ID NO: 20, SEQ ID NO: 26, SEQ ID NO: 27, SEQ ID NO: 30, SEQ ID NOs: 32-35, SEQ ID NO: 80, SEQ ID NO: 180, SEQ ID NO: 183, SEQ ID NO: 185, SEQ ID NO: 190, SEQ ID NO: 192, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NO: 282, SEQ ID NOs: 433-437, SEQ ID NOs: 489-496, SEQ ID NO: 544, SEQ ID NO: 545, SEQ ID NO: 547, SEQ ID NO: 549, SEQ ID NO: 551, SEQ ID NO: 556, SEQ ID NO: 557, SEQ ID NO: 598, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1216, SEQ ID NO: 1217, SEQ ID NO: 1250, SEQ ID NO: 1261, or SEQ ID NO: 1266, or active fragments, derivatives or variants thereof. The polypeptides of the invention or fragments thereof can be produced by any method known in the art for the production of a polypeptide, in particular, by chemical synthesis or by recombinant expression techniques.

In specific embodiments, the invention relates to a method for recombinantly producing a phage protein, e.g., a lysin protein, tail protein, or active fragment, variant or derivative thereof, said method comprising: (i) culturing under conditions suitable for the expression of said protein in a medium, a host cell containing a vector comprising a nucleic acid sequence encoding the amino acid sequence SEQ ID NO: 15, SEQ ID NO: 20, SEQ ID NO: 26, SEQ ID NO: 27, SEQ ID NO: 30, SEQ ID NOs: 32-35, SEQ ID NO: 80, SEQ ID NO: 180, SEQ ID NO: 183, SEQ ID NO: 185, SEQ ID NO: 190, SEQ ID NO: 192, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NO: 282, SEQ ID NOs: 433-437, SEQ ID NOs: 489-496, SEQ ID NO: 544, SEQ ID NO: 545, SEQ ID NO: 547, SEQ ID NO: 549, SEQ ID NO: 551, SEQ ID NO: 556, SEQ ID NO: 557, SEQ ID NO: 598, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, or SEQ ID NOs: 1053-1060, SEQ ID NO: 1077, SEQ ID NO: 1216, SEQ ID NO: 1217, SEQ ID NO: 1250, SEQ ID NO: 1261, or SEQ ID NO: 1266, or fragment thereof; and (ii) recovery of said protein from said medium. In certain embodiments, the nucleic acid sequence encoding the polypeptide of the invention is operably linked to a heterologous promoter.

The invention also encompasses methods for the diagnosis of the causative agent in a clinical presentation of bacterial infection. The isolated bacteriophage or polypeptides of the invention may be used to aid in the determination of species of bacteria in a patient sample by establishing susceptibility of the bacteria in the sample to the bacteriophage and/or polypeptides of the invention. Such methods further encompass methods of evaluation of antibacterial activity of the isolated bacteriophage and/or polypeptides of the invention. Antibacterial activity of the bacteriophage or the polypeptides of the invention, or susceptibility of an unknown sample to such activity, may be assessed by any method known in the art and/or described herein. In certain embodiments, antibacterial activity and/or susceptibility is assessed by culturing known bacteria and/or patient tissue, blood, fluid or swab samples according to standard techniques (e.g., in liquid culture or on agar plates), contacting the culture with bacteriophage and/or polypeptides of the invention and monitoring cell growth after said contacting. For example, in a liquid culture, the bacteria (e.g., *K. pneumoniae, A. baumannii, E. coli, P. aeruginosa*, and/or *S. aureus*) may be grown to a optical density ("OD") representative of a mid-point in exponential growth of the culture; the culture is exposed to one or more concentrations of one or more bacteriophage and/or polypeptides of the invention and the OD is monitored relative to a control culture. Decreased OD relative to a control culture is representative of a bacteriophage and/or polypeptide exhibiting antibacterial activity (e.g., exhibiting lytic killing activity) against the tested sample or bacterial species and/or strain in the culture. Similarly, bacterial colonies can be allowed to form on an agar plate, the plate exposed to a bacteriophage or polypeptide of the invention, and subsequent growth of the colonies evaluated relative to control plates. Decreased size of colonies, or decreased total numbers of colonies, indicates a bacteriophage and/or polypeptide with antibacterial activity against the tested sample and/or cultured species or strain.

The present invention is also directed to pharmaceutical compositions comprising or consisting of a bacteriophage having a genome comprising or consisting of the nucleic acid sequence SEQ ID NO: 1, SEQ ID NO: 2, SEQ ID NO: 3, SEQ ID NO: 4, SEQ ID NO: 560, SEQ ID NO: 781, or SEQ ID NO: 1074. In certain embodiments, the pharmaceutical composition of the invention comprises a bacteriophage having the genome comprising or consisting of the nucleic acid sequence SEQ ID NO: 1, SEQ ID NO: 2, SEQ ID NO: 3, SEQ ID NO: 4, SEQ ID NO: 560, SEQ ID NO: 781, or SEQ ID NO: 1074, in addition to one or more other bacteriophage. The one or more other bacteriophage may be one or more bacteriophage of the invention (e.g., having a genome comprising or consisting of a nucleic acid sequence of SEQ ID NO: 1, SEQ ID NO: 2, SEQ ID NO: 3, SEQ ID NO: 4, SEQ ID NO: 560, SEQ ID NO: 781, or SEQ ID NO: 1074), one or more strains thereof, or may be one or more bacteriophage known in the art other than a bacteriophage having a genome according to SEQ ID NO: 1, SEQ ID NO: 2, SEQ ID NO: 3, SEQ ID NO: 4, SEQ ID NO: 560, SEQ ID NO: 781, or SEQ ID NO: 1074. Further, the one or more bacteriophage in the pharmaceutical composition of the invention may target the same or different species or strains of bacteria. In certain embodiments, the pharmaceutical compositions comprising one or more bacteriophage of the invention further comprise one or more polypeptides of the invention and/or other phage products as described herein or known in the art.

In certain embodiments, the invention provides pharmaceutical compositions comprising polypeptides, or active fragments thereof, in particular those having anti-microbial and/or antibacterial activity, isolated from bacteriophage having a genome comprising or consisting of the nucleic acid sequence SEQ ID NO: 1, SEQ ID NO: 2, SEQ ID NO: 3, SEQ ID NO: 4, SEQ ID NO: 560, SEQ ID NO: 781, and/or SEQ ID NO: 1074. In specific embodiments, the pharmaceutical compositions of the invention comprise one or more polypeptides having an amino acid sequence of SEQ ID NO: 15, SEQ ID NO: 20, SEQ ID NO: 26, SEQ ID NO: 27, SEQ ID NO: 30, SEQ ID NOs: 32-35, SEQ ID NO: 80, SEQ ID NO: 180, SEQ ID NO: 183, SEQ ID NO: 185, SEQ ID NO: 190, SEQ ID NO: 192, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NO: 282, SEQ ID NOs: 433-437, SEQ ID NOs: 489-496, SEQ ID NO: 544, SEQ ID NO: 545, SEQ ID NO: 547, SEQ ID NO: 549, SEQ ID NO: 551, SEQ ID NO: 556, SEQ ID NO: 557, SEQ ID NO: 598, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1216, SEQ ID NO: 1217, SEQ ID NO: 1250, SEQ ID NO: 1261, or SEQ ID NO: 1266. In other embodiments, the pharmaceutical compositions of the invention comprise a polypeptide that is a variant, derivative or fragment of SEQ ID NO: 15, SEQ ID NO: 20, SEQ ID NO: 26, SEQ ID NO: 27, SEQ ID NO: 30, SEQ ID NOs: 32-35, SEQ ID NO: 80, SEQ ID NO: 180, SEQ ID NO: 183, SEQ ID NO: 185, SEQ ID NO: 190, SEQ ID NO: 192, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NO: 282, SEQ ID NOs: 433-437, SEQ ID NOs: 489-496, SEQ ID NO: 544, SEQ ID NO: 545, SEQ ID NO: 547, SEQ ID NO: 549, SEQ ID NO: 551, SEQ ID NO: 556, SEQ ID NO: 557, SEQ ID NO: 598, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1216, SEQ ID NO: 1217, SEQ ID NO: 1250, SEQ ID NO: 1261, or SEQ ID NO: 1266, wherein the variant, derivative or fragment retains a biological function of the polypeptide from which it is derived, e.g., antimicrobial or antibacterial activity (e.g., lytic killing activity), preferably against one or more strains of *K. pneumoniae, A. baumannii, E. coli, P. aeruginosa,* and/or *S. aureus.*

The pharmaceutical compositions of the invention may additionally comprise a pharmaceutically acceptable carrier, excipient, or stabilizer. In certain embodiments, the pharmaceutical compositions of the invention are antibiotic compositions (in that they exhibit antibacterial activity) or therapeutic compositions for the treatment, prevention, and/or amelioration of symptoms of a disease or disorder associated with infection by bacteria in a subject in need thereof. In specific embodiments, the pharmaceutical compositions of the invention are antibacterial compositions or therapeutic compositions for the treatment, prevention, and/or amelioration of symptoms of a disease or disorder associated with infection by *K. pneumoniae, A. baumannii, E. coli, P. aeruginosa,* and/or *S. aureus.* In certain embodiments, the subject receiving a pharmaceutical composition of the invention is a mammal (e.g., bovine, ovine, caprine, equid, primate (e.g., human), rodent, lagomorph or avian (e.g., chicken, duck, goose)).

The present invention provides for methods for the treatment or prevention of bacterial infection comprising administering to a subject in need thereof a pharmaceutical composition comprising one or more bacteriophage or phage products (e.g., an isolated bacteriophage polypeptide or active fragment, variant or derivative thereof), optionally in addition to one or more other bacteriophage or other phage products, as described herein. In the context of the present invention, "treatment" refers to both therapeutic treatment and prophylactic or preventative measures, wherein the object is to eliminate, lessen, decrease the severity of, slow the progression of or delay or prevent the symptoms or underlying cause (e.g., bacterial infection) associated with the pathological condition or disorder. The pharmaceutical compositions of the present invention may be used in the treatment or management of infections associated with any bacterial infection, including, but not limited to *K. pneumoniae, A. baumannii, E. coli, P. aeruginosa,* and/or *S. aureus,* as well as, in certain embodiments, *S. epidermidis, S. auricularis, S. capitis, S. haemolyticus, S. hominis, S. saprophyticus, S. simulans, S. xylosis, M. luteus, B. subtilis, B. pumilus, E. faecalis, E. hirae, E. faecium, E. avium,* and combinations thereof. In certain embodiments, the pharmaceutical compositions may be used to treat conditions or disorders associated with bacterial infections including, but not limited to, postoperative endophtalmitis, endocarditis, infections of the central nervous system, pneumonia, osteomyelitis, wound infections (e.g., diabetic foot ulcers), mastitis, septicemia, food poisoning, meningitis, skin infections, abscesses, toxic shock syndrome, bacteremia, and/or other conditions associated with nosocomial bacterial infections.

In certain embodiments, the invention provides for the use of a bacteriophage or an isolated phage product (e.g., an isolated phage polypeptide or active fragment, variant or derivative thereof) as a single agent therapy. In other embodiments, the invention provides for the use of a bacteriophage, or phage product (e.g., an isolated phage polypeptide or active fragment, variant or derivative thereof), in combination with a standard or experimental treatment for bacterial infection. Such combination therapy may enhance the efficacy of the standard or experimental treatment. Examples of therapeutic agents that are particularly useful in combination with a bacteriophage and/or polypeptide of the invention are anti-inflammatory agents, standard chemotherapeutic antibiotic agents (e.g., penicillin, synthetic penicillins, bacitracin, methicillin, nafcillin, oxacilin, cloxacillin, vancomycin, teicoplanin, clindamycin, co-trimoxazole, cephalosporin, polymyxin, cefaclor. Cefadroxil, cefamandole nafate, cefazolin, cefixime, cefmetazole, cefonioid, cefoperazone, ceforanide, cefotanme, cefotaxime, cefotetan, cefoxitin, cefpodoxime proxetil, ceftazidime, ceftizoxime, ceftriaxone, cefriaxone moxalactam, cefuroxime, cephalexin, cephalosporin C, cephalosporin C sodium salt, cephalothin, cephalothin sodium salt, cephapirin, cephradine, cefuroximeaxetil, dihydratecephalothin, moxalactam, loracarbef mafate and chelating agents), local anesthetic agents, and/or corticosteroids. In yet another embodiment, the compositions of the present invention may be combined with one or more bacteriophage or phage products known in the art. The combination therapies encompassed by the invention may be formulated into a single pharmaceutical composition or may be administered in separate compositions, but as part of an overall treatment regimen.

The pharmaceutical compositions of the invention may be administered by any method known in the art suitable for administration of an antibacterial compound, e.g., via oral or parenteral (e.g., inhalation, intramuscular, intravenous, or epidermal) delivery. In preferred embodiments, the pharmaceutical compositions of the invention are administered topically, e.g., in a topical formulation. The compositions of the invention may be used topically to treat and/or prevent common nosocomial infections, such as infections at surgical incision sites or associated with catheters or drains. In other embodiments, the compositions of the invention are use to treat bacterial infections of the skin or upper dermal layers (e.g., infections of diabetic ulcers of the foot or carbuncles).

The pharmaceutical compositions of the present invention may also be used for traditionally non-therapeutic uses such as antibacterial agents in cosmetics, or in sprays or solutions for use on solid surfaces to prevent the colonization of bacteria (i.e., as disinfectants).

The present invention is also directed to methods for screening peptides for antibacterial activity. In one embodiment the method comprises screening contiguous amino acid sequences of at least 6, 10, 15, 20 or 25 residues in length that are encoded by the open reading frames of the nucleic acid sequence SEQ ID NO: 1, SEQ ID NO: 2, SEQ ID NO: 3, SEQ ID NO: 4, SEQ ID NO: 560, SEQ ID NO: 781, or SEQ ID NO: 1074, for antibacterial activity, said antibacterial activity measured by the peptides ability to inhibit bacterial growth, e.g., in agar or liquid culture.

5.1 DEFINITIONS

As used herein, the term "fragment" refers to a peptide or polypeptide comprising an amino acid sequence of at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least 80 contiguous amino acid residues, at least 90 contiguous amino acid residues, at least 100 contiguous amino acid residues, at least 125 contiguous amino acid residues, at least 150 contiguous amino acid residues, at least 175 contiguous amino acid residues, at least 200 contiguous amino acid residues, or at least 250 contiguous amino acid residues of the amino acid sequence of a protein. In a specific embodiment, the fragment is a functional fragment in that it retains at least one function of the protein from which it is isolated (e.g., antimicrobial or antibacterial activity (e.g., lytic cell killing)).

As used herein the terms "active bacteriophage products" and "bacteriophage products" refer to polypeptides, or fragments, variants or derivatives thereof, isolated from a bacteriophage of the invention, which polypeptide, or fragment, variant or derivative thereof, exhibits a biological function or activity associated with the bacteriophage from which it was isolated or derived (e.g., antimicrobial or antibacterial activity (e.g., lytic cell killing)).

As used herein, the term "isolated" in the context of a peptide, polypeptide, or fusion protein or refers to a peptide, polypeptide or fusion protein that is substantially free of cellular material or contaminating proteins from the cell or tissue source from which it is derived, or substantially free of chemical precursors or other chemicals when chemically synthesized. The language "substantially free of cellular material" includes preparations of a peptide, polypeptide or fusion protein in which the peptide, polypeptide or fusion protein is separated from cellular components of the cells from which it is isolated or recombinantly produced. Thus, a peptide, polypeptide or fusion protein that is substantially free of cellular material includes preparations of a peptide, polypeptide or fusion protein having less than about 30%, 20%, 10%, or 5% (by dry weight) of heterologous protein (also referred to herein as a "contaminating protein"). When the peptide, polypeptide or fusion protein is recombinantly produced, it is also preferably substantially free of culture medium, i.e., culture medium represents less than about 20%, 10%, or 5% of the volume of the protein preparation. When the peptide, polypeptide or fusion protein is produced by chemical synthesis, it is preferably substantially free of chemical precursors or other chemicals, i.e., it is separated from chemical precursors or other chemicals which are involved in the synthesis of the peptide, polypeptide, or fusion protein. Accordingly, such preparations of a peptide, polypeptide, fusion protein, or antibody have less than about 30%, 20%, 10%, 5% (by dry weight) of chemical precursors or compounds other than the peptide, polypeptide, or fusion protein of interest.

As used herein, the term "isolated" in the context of nucleic acid molecules refers to a first nucleic acid molecule which is separated from other nucleic acid molecules which are present in the natural source of the first nucleic acid molecule. Moreover, an "isolated" nucleic acid molecule, such as a cDNA molecule, is substantially free of other cellular material, or culture medium when produced by recombinant techniques, or substantially free of chemical precursors or other chemicals when chemically synthesized and may be free of other cDNA or other genomic DNA molecules, e.g., where it has been isolated from other clones in a nucleic acid library.

The term "purified" means that the peptide, polypeptide, fusion protein, or nucleic acid molecule has been measurably increased in concentration by any purification process, including but not limited to, column chromatography, HPLC, precipitation, electrophoresis, etc., thereby partially, substantially, nearly completely, or completely removing impurities, such as precursors or other chemicals involved in preparing the peptide, polypeptide, fusion protein, or nucleic acid molecule. One of skill in the art will appreciate the amount of purification necessary for a given use. For example, isolated protein meant for use in therapeutic compositions intended for administration to humans ordinarily must be of high purity in accordance with regulatory standards and good manufacturing processes.

As used herein, the term "derivative" in the context of polypeptides refers to a polypeptide that comprises an amino acid sequence which has been altered by the introduction of amino acid residue substitutions, deletions or additions. The term "derivative" as used herein also refers to a polypeptide that has been modified, i.e., by the covalent attachment of any type of molecule to the polypeptide. For example, but not by way of limitation, a polypeptide may be modified, e.g., by glycosylation, acetylation, pegylation, phosphorylation, amidation, derivatization by known protecting/blocking groups, proteolytic cleavage, linkage to a cellular ligand or other protein, etc. A derivative polypeptide may be produced by chemical modifications using techniques known to those of skill in the art, including, but not limited to specific chemical cleavage, acetylation, formylation, metabolic synthesis of tunicamycin, etc. Further, a derivative polypeptide may contain one or more non-classical amino acids. A polypeptide derivative possesses a similar or identical function as the polypeptide from which it was derived. The term "derived" as used in reference to a polypeptide "derived" from an organism may also refer to isolation of a polypeptide directly from said organism (e.g. bacterial cells or phage).

As used herein, the term "host cell" refers to the particular subject cell transfected with a nucleic acid molecule and the progeny or potential progeny of such a cell that contain the nucleic acid molecule or chromosomally integrated version thereof. Progeny of such a cell may not be identical to the parent cell transfected with the nucleic acid molecule due to mutations or environmental influences that may occur in succeeding generations or integration of the nucleic acid molecule into the host cell genome. For the expression of bacteriophage proteins and polypeptides, the host cell is preferably not of the same species or strain from which the bacteriophage was isolated or cultured.

As used herein, the term "in combination" refers to the use of more than one prophylactic and/or therapeutic agent. The use of the term "in combination" does not restrict the order in which prophylactic and/or therapeutic agents are administered to a subject with a disease or disorder. A first prophylactic or therapeutic agent can be administered prior to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second prophylactic or therapeutic agent (different from the first prophylactic or therapeutic agent) to a subject in need thereof, e.g., a subject with a disease or disorder.

As used herein, the terms "nucleic acids" and "nucleotide sequences" include single-stranded and double-stranded DNA and/or RNA molecules, or combinations thereof. As used herein, the term "encoded by the nucleic acid" refers to an amino acid sequence that results from the translation of the forward, reverse, complementary or reverse-complementary sequence of the referenced nucleic acid sequence using the standard genetic code (i.e., standard codon triplets) as well known in the art.

As used herein, the terms "prophylactic agent" and "prophylactic agents" refer to bacteriophage and/or polypeptides of the invention, which can be used in the prevention, treatment, management or amelioration of one or more symptoms of a disease or disorder, in particular, a disease or disorder associated with a bacterial infection.

As used herein, the terms "therapeutic agent" and "therapeutic agents" refer to bacteriophage and/or polypeptides of the invention that can be used in the prevention, treatment, management or amelioration of one or more symptoms of a disease or disorder, in particular, a disease or disorder associated with a bacterial infection.

As used herein, the term "therapeutically effective amount" refers to that amount of a therapeutic agent sufficient to result in amelioration of one or more symptoms of a disease or disorder, in particular, a disease or disorder associated with a bacterial infection.

As used herein, the terms "treat", "treatment" and "treating" refer to the amelioration of one or more symptoms of a disease or disorder, in particular, a disease or disorder associated with a bacterial infection, which results from the administration of one or more bacteriophage and/or polypeptides of the invention. As noted above, "treatment" and related terms refer to both therapeutic treatment and prophylactic or preventative measures, wherein the object is to eliminate, lessen, decrease the severity of, slow the progression of, or delay or prevent the symptoms or underlying cause (e.g., bacterial infection) associated with the pathological condition or disorder.

As used herein, the terms "antibacterial activity" and "antimicrobial activity" with reference to a bacteriophage, isolated bacteriophage protein (or variant, derivative or fragment thereof), or bacteriophage product, are used interchangeably to refer to the ability to kill and/or inhibit the growth or reproduction of a microorganism, in particular, the bacteria of the species or strain that the bacteriophage infects. In certain embodiments, antibacterial or antimicrobial activity is assessed by culturing bacteria, e.g., Gram-positive bacteria (e.g., *S. aureus*), Gram-negative bacteria (e.g., *K. pneumoniae, A. baumannii, E. coli*, and/or *P. aeruginosa*) or bacteria not classified as either Gram-positive or Gram-negative, according to standard techniques (e.g., in liquid culture or on agar plates), contacting the culture with a bacteriophage or polypeptide of the invention and monitoring cell growth after said contacting. For example, in a liquid culture, the bacteria may be grown to an optical density ("OD") representative of a mid-point in exponential growth of the culture; the culture is exposed to one or more concentrations of one or more bacteriophage or polypeptides of the invention, and the OD is monitored relative to a control culture. Decreased OD relative to a control culture is representative of a bacteriophage or polypeptide exhibiting antibacterial activity (e.g., exhibits lytic killing activity). Similarly, bacterial colonies can be allowed to form on an agar plate, the plate exposed to a bacteriophage or polypeptide of the invention, and subsequent growth of the colonies evaluated related to control plates. Decreased size of colonies, or decreased total numbers of colonies, indicate a bacteriophage or polypeptide with antibacterial activity.

As used herein, a "CHAP domain" refers to a conserved amidase domain found in several phage-encoded peptidoglycan hydrolases and stands for "cysteine, histidine-dependent amidohydrolases/peptidases." See, e.g., Rigden D, et. al., Trends Biochem Sci. 2003 May 28(5): 230-4. It is found in a superfamily of amidases, including GSP amidase and peptidoglycan hydrolases. The family includes at least two different types of peptidoglycan cleavage activities: L-muramoyl-L-alanine amidase and D-alanyl-glycyl endopeptidase activity. CHAP domains generally contain conserved cysteine and histidine residues and hydrolyze γ-glutamyl-containing substrates. These cysteine residues are believed to be essential for the activity of several of these amidases, and their thiol groups appear to function as the nucleophiles in the catalytic mechanisms of all enzymes containing this domain. CHAP domains are often found in association with other domains that cleave peptidoglycan, e.g., acting in a cooperative manner to cleave specialized substrates. See also, Bateman A, et al., Trends Biochem Sci. 2003 May 28(5): 234-7.

6. BRIEF DESCRIPTION OF THE FIGURES

FIGS. 1A-1B: Schematic of the organization of the F391/08 genome, comprising the nucleic acid sequence of SEQ ID NO:1. The open reading frames ("ORFs") predicted in the approximately 113 kb genome are represented by arrows and numbered in black. The direction of an arrow indicates the direction of transcription. Color coding: Black—ORFs for which products a functional assignment could be made based on the known functions of homologous proteins; Gray—ORFs coding for products that are similar to proteins of unknown function; Empty—ORFs coding for proteins that share no significant homology with proteins in available databases. Functionally assigned ORFs are also listed in the figure. The information in the figure is also included in tabular form in FIG. 2.

FIGS. 2A-2II: Features of the bacteriophage F391/08 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-172 listed in FIG. 2 encode the amino acid sequences of SEQ ID NO:5-176, respectively.

Figure 3:
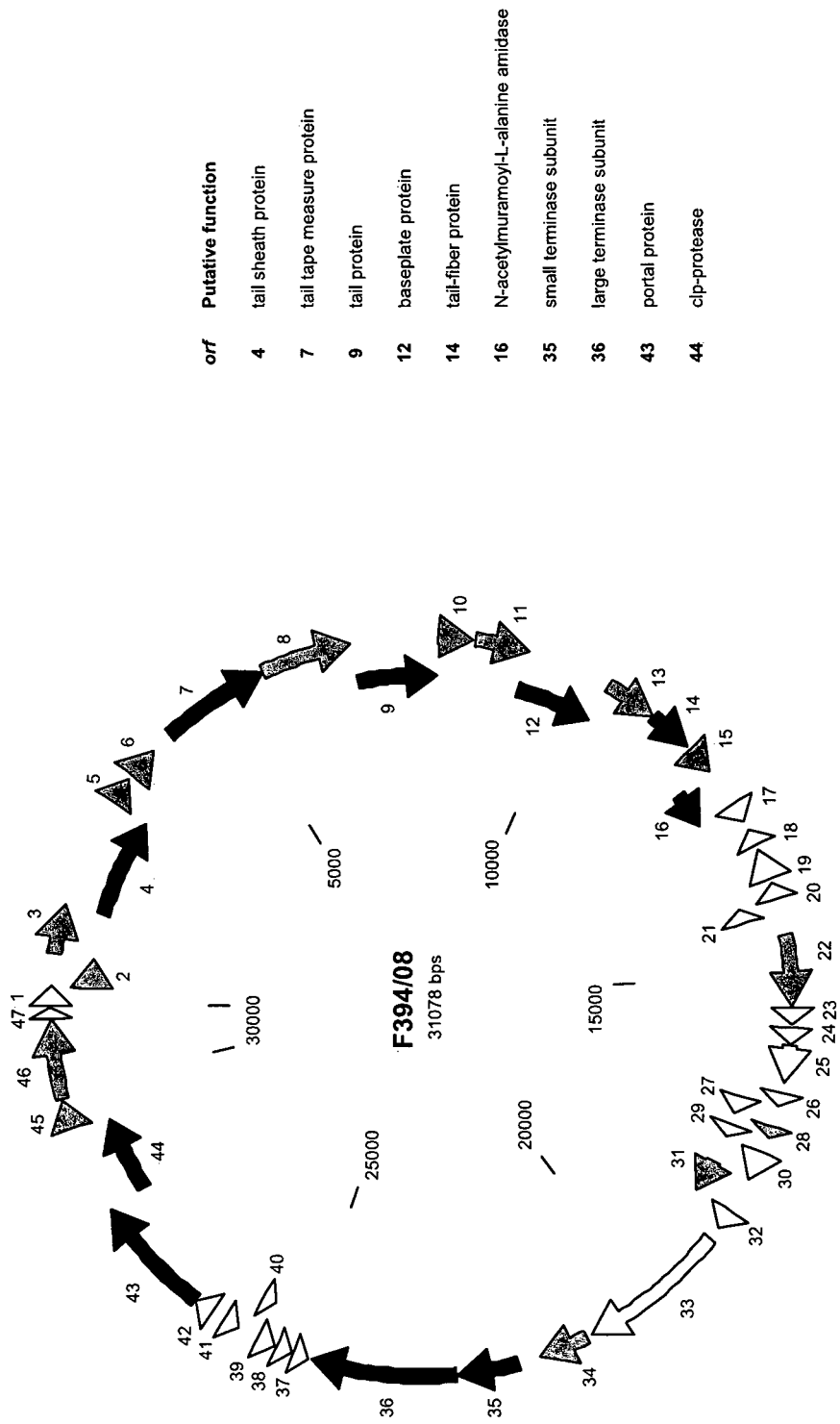

FIG. 3: Schematic of the organization of the F394/08 genome, comprising the nucleic acid sequence of SEQ ID NO:2. The open reading frames ("ORFs") predicted in the approximately 31 kb genome are represented by arrows and numbered in black. The direction of an arrow indicates the direction of transcription. Color coding: Black—ORFs for which products a functional assignment could be made based on the known functions of homologous proteins; Gray—ORFs coding for products that are similar to proteins of unknown function; Empty—ORFs coding for proteins that share no significant homology with proteins in available databases. Functionally assigned ORFs are also listed in the figure. The information in the figure is also included in tabular form in FIG. 4.

FIGS. 4A-4K: Features of the bacteriophage F394/08 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-47 listed in FIG. 4 encode the amino acid sequences of SEQ ID NO:177-223, respectively.

Figure 5A:
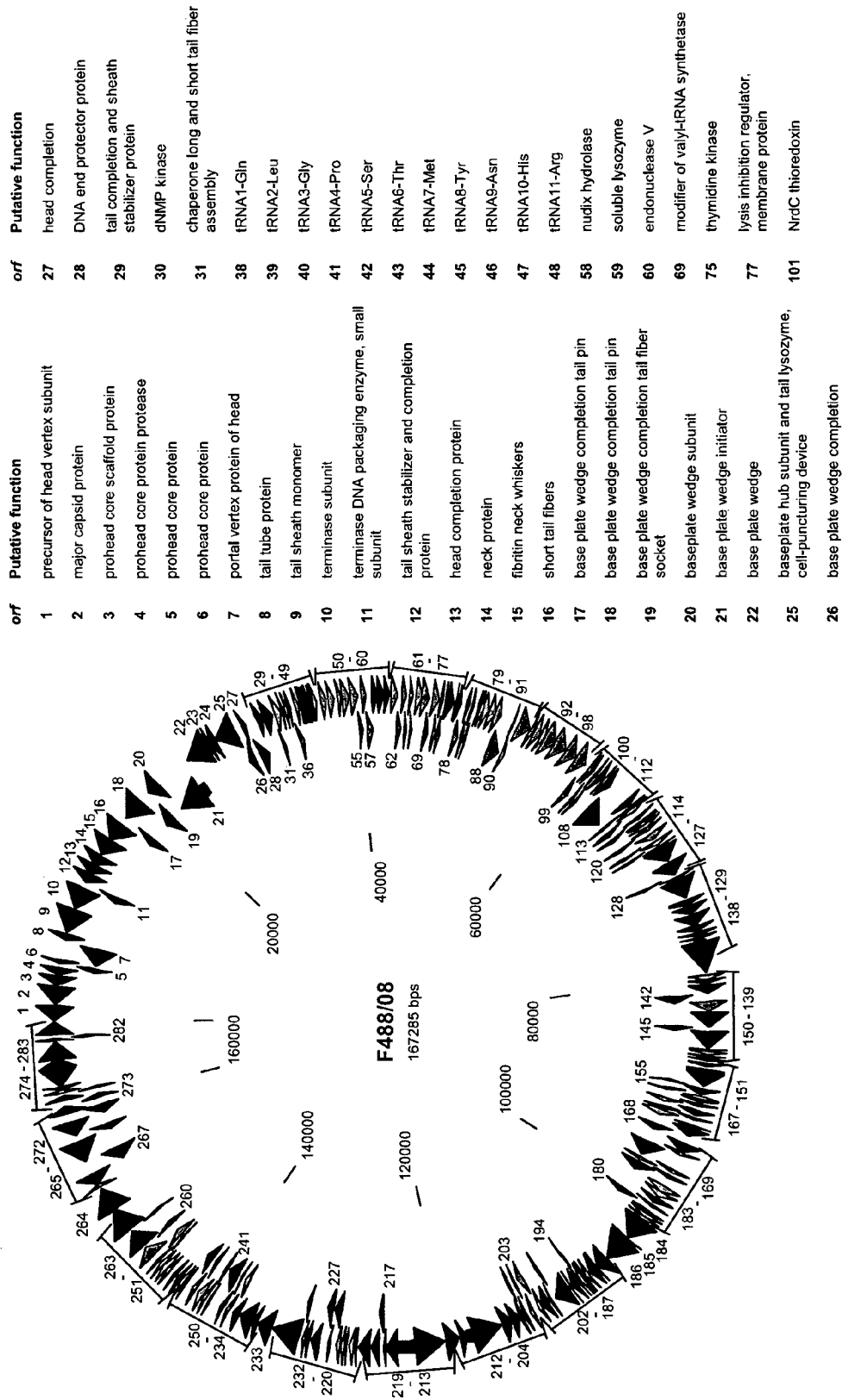

FIGS. 5A-5B: Schematic of the organization of the F488/08 genome, comprising the nucleic acid sequence of SEQ ID NO:3. The open reading frames ("ORFs") predicted in the approximately 167 kb genome are represented by arrows and numbered in black. The direction of an arrow indicates the direction of transcription. Color coding: Black—ORFs for which products a functional assignment could be made based on the known functions of homologous proteins; Gray—ORFs coding for products that are similar to proteins of unknown function; Empty—ORFs coding for proteins that share no significant homology with proteins in available databases. Functionally assigned ORFs are also listed in the figure. The information in the figure is also included in tabular form in FIG. 6.

FIGS. 6A-6DDD: Features of the bacteriophage F488/08 genome, including gene products and assignment of putative functions. The figure includes a listing of the ORFs of the genome and provides for each ORF (i) its position within the genome, (ii) the encoded amino acid sequence, (iii) a listing of homologous proteins, and conserved domains within its encoded polypeptide, and (iv) an assignment of putative function. ORFs 1-283 listed in FIG. 6 encode the amino acid sequences of SEQ ID NO:224-506, respectively.

Figure 7:
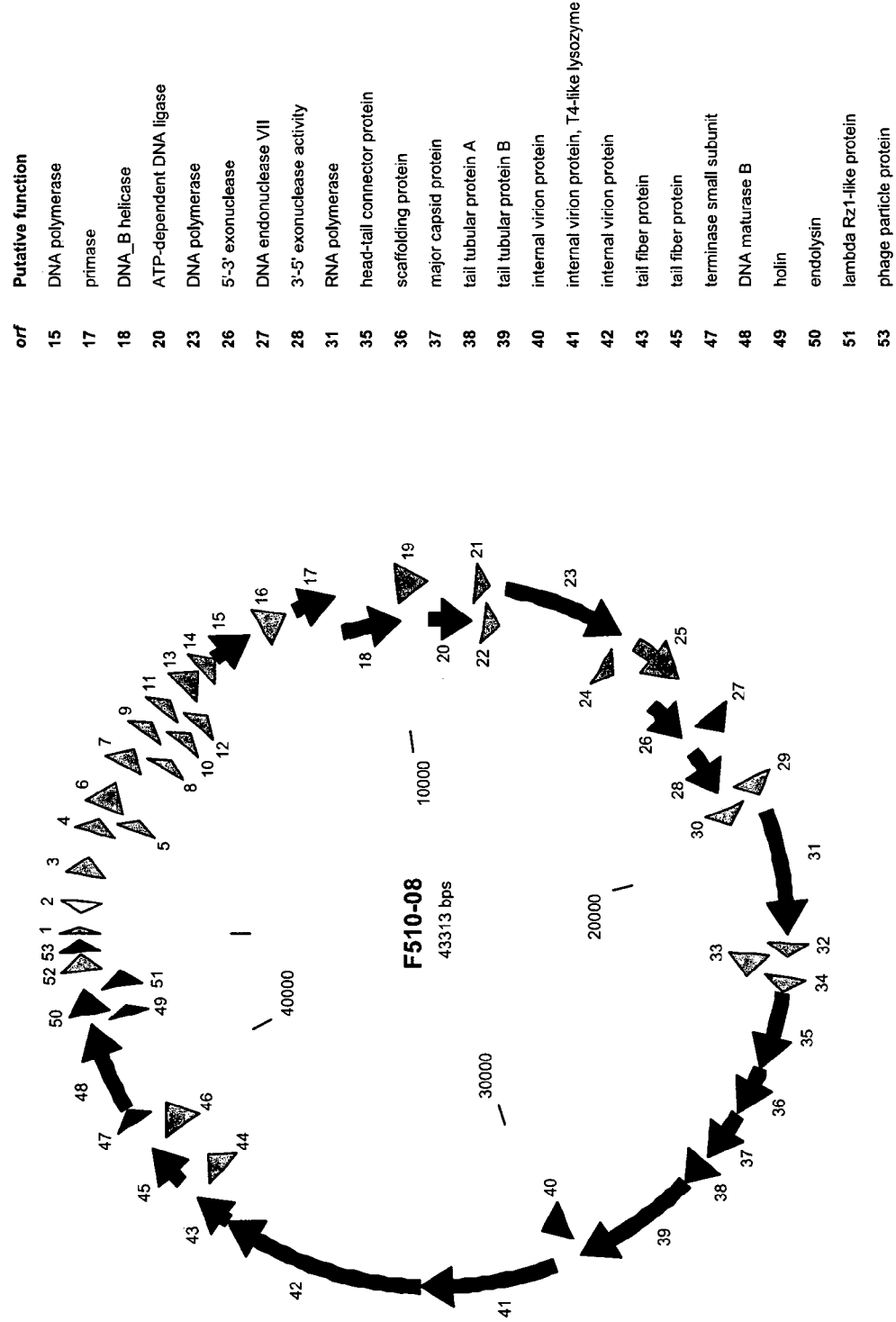

FIG. 7: Schematic of the organization of the F510/08 genome, comprising the nucleic acid sequence of SEQ ID NO:4. The open reading frames ("ORFs") predicted in the approximately 43 kb genome are represented by arrows and numbered in black. The direction of an arrow indicates the direction of transcription. Color coding: Black—ORFs for which products a functional assignment could be made based on the known functions of homologous proteins; Gray—ORFs coding for products that are similar to proteins of unknown function; Empty—ORFs coding for proteins that share no significant homology with proteins in available databases. Functionally assigned ORFs are also listed in the figure. The information in the figure is also included in tabular form in FIG. 8.

FIGS. 8 A-8S: Features of the bacteriophage F510/08 genome, including gene products and assignment of putative functions. The figure includes a listing of the ORFs of the genome and provides for each ORF (i) its position within the genome, (ii) the encoded amino acid sequence, (iii) a listing of homologous proteins, and conserved domains within its encoded polypeptide, and (iv) an assignment of putative function. ORFs 1-53 listed in FIG. 8 encode the amino acid sequences of SEQ ID NO:507-559, respectively.

Figure 9:
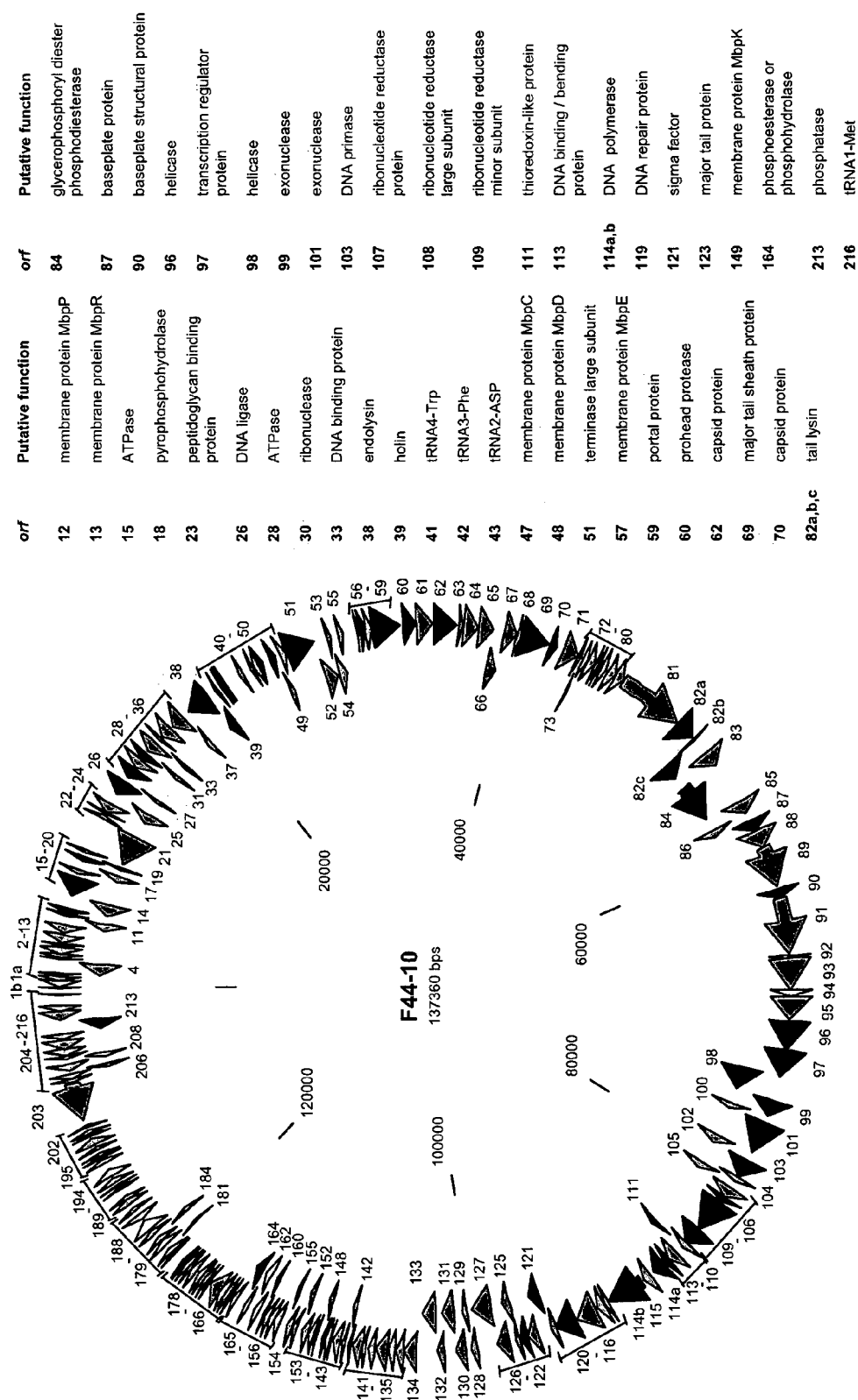

FIG. 9: Schematic of the organization of the F44/10 genome, comprising the nucleic acid sequence of SEQ ID NO:560. The open reading frames ("ORFs") predicted in the approximately 137 kb genome are represented by arrows and numbered in black. The direction of an arrow indicates the direction of transcription. Color coding: Black—ORFs for which products a functional assignment could be made based on the known functions of homologous proteins; Gray—ORFs coding for products that are similar to proteins of unknown function; Empty—ORFs coding for proteins that share no significant homology with proteins in available databases. Functionally assigned ORFs are also listed in the figure. The information in the figure is also included in tabular form in FIG. 10.

FIGS. 10A-10QQ: Features of the bacteriophage F44/10 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-216, including ORFs 1a, 1b, 82a, 82b, 82c, 114a, and 114b, listed in FIG. 10 encode the amino acid sequences of SEQ ID NO:561-780, respectively.

Figure 11A:
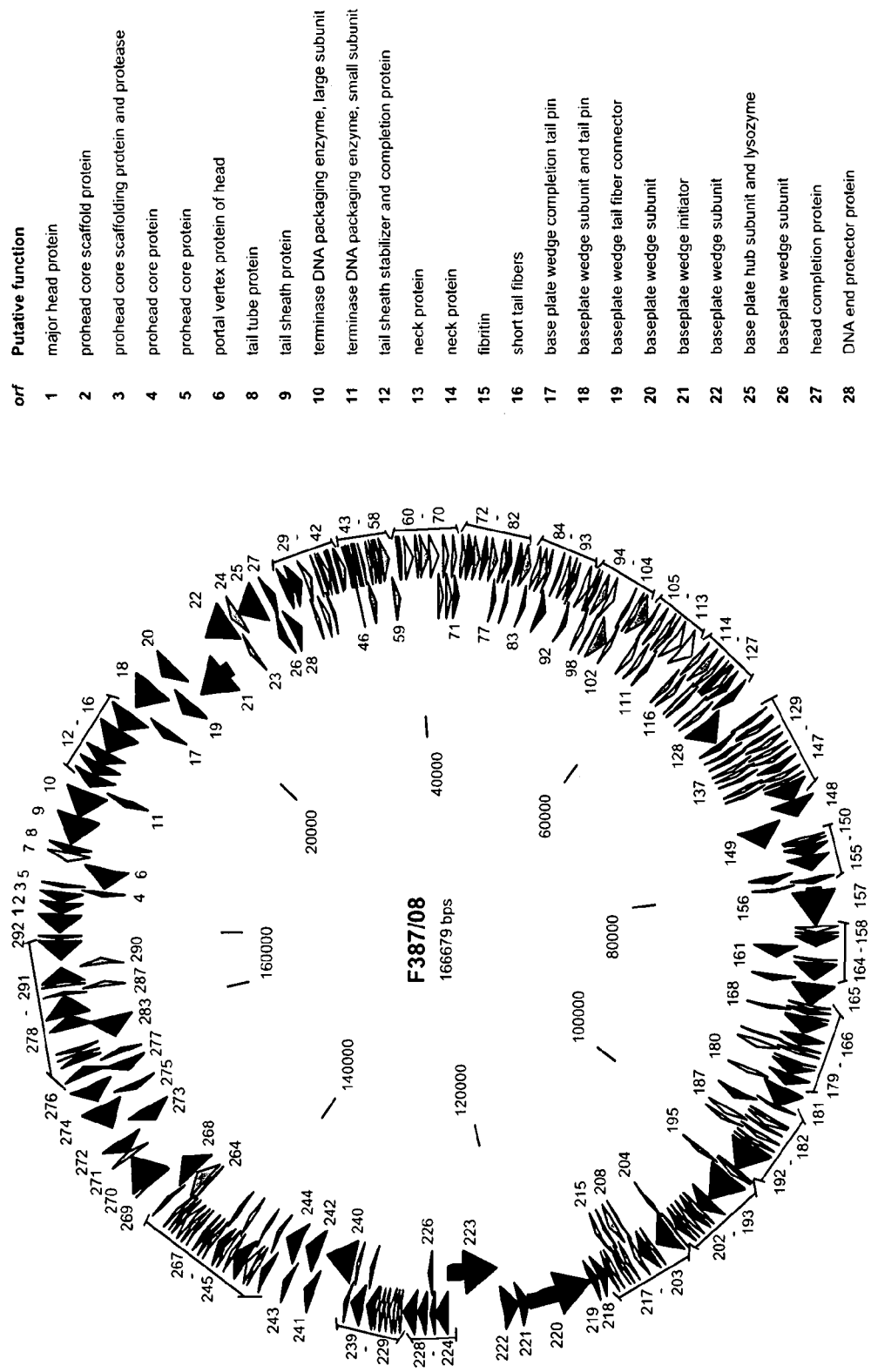

FIG. 11: Schematic of the organization of the F387/08 genome, comprising the nucleic acid sequence of SEQ ID NO:781. The open reading frames ("ORFs") predicted in the approximately 167 kb genome are represented by arrows and numbered in black. The direction of an arrow indicates the direction of transcription. Color coding: Black—ORFs for which products a functional assignment could be made based on the known functions of homologous proteins; Gray—ORFs coding for products that are similar to proteins of unknown function; Empty—ORFs coding for proteins that share no significant homology with proteins in available databases. Functionally assigned ORFs are also listed in the figure. The information in the figure is also included in tabular form in FIG. 12.

FIGS. 12A-12UUU: Features of the bacteriophage F387/08 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-292 listed in FIG. 12 encode the amino acid sequences of SEQ ID NOs: 782-1073, respectively.

Figure 13A:
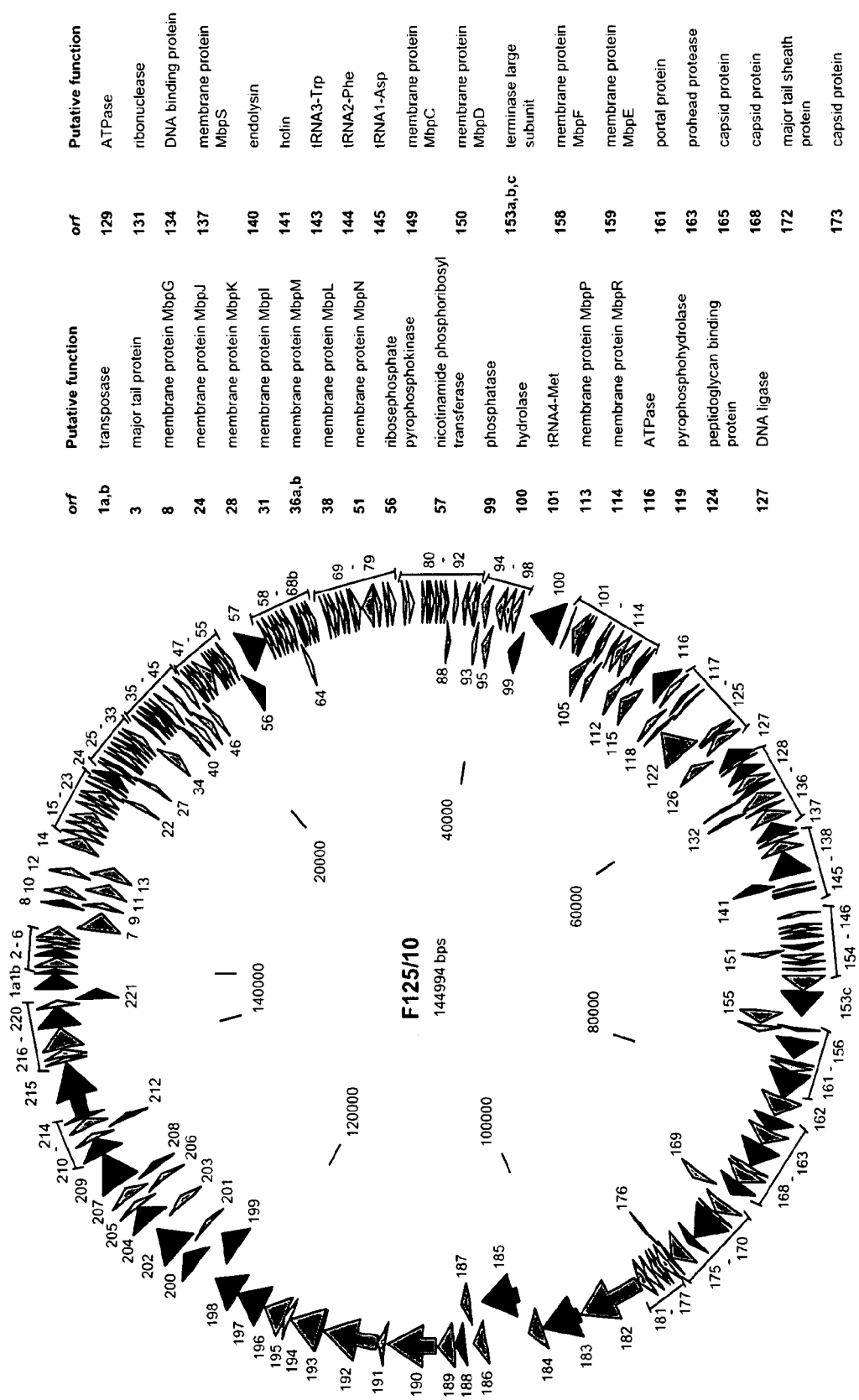

FIGS. 13A-13B: Schematic of the organization of the F125/10 genome, comprising the nucleic acid sequence of SEQ ID NO:1074. The open reading frames ("ORFs") predicted in the approximately 145 kb genome are represented by arrows and numbered in black. The direction of an arrow indicates the direction of transcription. Color coding: Black—ORFs for which products a functional assignment could be made based on the known functions of homologous proteins; Gray—ORFs coding for products that are similar to proteins of unknown function; Empty—ORFs coding for proteins that share no significant homology with proteins in available databases. Functionally assigned ORFs are also listed in the figure. The information in the figure is also included in tabular form in FIGS. 14A-14ZZZ FIGS. 14A-14ZZZ: Features of the bacteriophage F125/10 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1b-221, 1a listed in this Figure encode the amino acid sequences of SEQ ID NO:1075-1300, respectively, including 36a and 36b, 68a and 68b, and 153a and 153b.

FIGS. 15A-15III: The nucleotide sequence of the genome of bacteriophage F391/08 (SEQ ID NO:1).

FIGS. 16A-16Q: The nucleotide sequence of the genome of bacteriophage F394/08 (SEQ ID NO:2).

FIGS. 17A-17KKKK: The nucleotide sequence of the genome of bacteriophage F488/08 (SEQ ID NO:3).

FIGS. 18A-18X: The nucleotide sequence of the genome of bacteriophage F510/08 (SEQ ID NO:4).

FIGS. 19A-19UUU: The nucleotide sequence of the genome of bacteriophage F44/10 (SEQ ID NO:560).

FIGS. 20A-20KKKK: The nucleotide sequence of the genome of bacteriophage F387/08 (SEQ ID NO:781).

FIGS. 21A-21ZZZ: The nucleotide sequence of the genome of bacteriophage F125/10 (SEQ ID NO:1074).

6.1 DETAILED DESCRIPTION

The present invention is directed to isolated bacteriophage, and their isolated polypeptide products, having antibacterial activity against one or more species or strains of the nosocomial pathogens *Klebsiella pneumoniae, Acinetobacter baumannii, Escherichia coli, Pseudomonas aeruginosa*, and *S. aureus*. In one embodiment, isolated bacteriophage or polypeptides are provided that exhibit antimicrobial and/or antibacterial activity against methicillin-resistant strains of *S. aureus* (MRSA). In addition, the bacteriophage and polypeptides of the invention may exhibit antibacterial or antimicrobial activity against one or more species or strains of pathogenic bacteria including, but not limited to, *S. epidermidis, S. auricularis, S. capitis, S. haemolyticus, S. hominis, S. saprophyticus, S. simulans, S. xylosis, Micrococcus luteus, Bacillus subtilis, B. pumilus, E. hirae* and *E. avium*.

In some embodiments, the invention provides a bacteriophage having a genome comprising or consisting of the nucleic acid sequence of SEQ ID NO: 1. A specific example in accordance with this embodiment is the isolated bacteriophage F391/08, which targets a number of strains of *Klebsiella* species, including *K. pneumoniae* and *K. oxytoca*. A schematic organization of the F391/08 genome, comprising the nucleic acid sequence of SEQ ID NO: 1, is provided in FIG. 1. Open reading frames (ORFs) in the F391/08 genome are provided in FIG. 2. Also provided are the positions of the ORFs within the genome, the amino acid sequences encoded by the ORFs, homologous or similar proteins and conserved domains within the encoded polypeptide, and the assignment of putative functions. ORFs 1-172 listed in FIG. 2 encode the amino acid sequences of SEQ ID NOs: 5-176, respectively.

In some embodiments, the invention provides a bacteriophage having a genome comprising or consisting of the nucleic acid sequence of SEQ ID NO: 781. A specific example in accordance with this embodiment is the isolated bacteriophage F387/08, which targets a number of strains of *Klebsiella* species, including *K. pneumoniae* and *K. oxytoca*. A schematic organization of the F387/08 genome, comprising the nucleic acid sequence of SEQ ID NO: 781, is provided in FIG. 11. Open reading frames (ORFs) in the F387/08 genome are provided in FIG. 12. Also provided are the positions of the ORFs within the genome, the amino acid sequences encoded by the ORFs, homologous or similar proteins and conserved domains within the encoded polypeptide, and the assignment of putative functions. ORFs 1-292 listed in FIG. 12 encode the amino acid sequences of SEQ ID NOs: 782-1073, respectively.

*Klebsiella pneumoniae* is a Gram-negative, non-motile, rod-shaped bacterium, found in the normal flora of the mouth, skin, and intestines. As an encapsulated, facultative anaerobe, the bacterium also naturally occurs in the soil and about 30% of strains can fix nitrogen in anaerobic conditions. Clinically, it is the most important member of the *Klebsiella* genus of Enterobacteriaceae, and also is closely related to *K. oxytoca*. *Klebsiella* infections tend to occur in people with a weakened immune system from improper diet, e.g. in alcoholics and diabetics. *Klebsiella* is also an opportunistic pathogen for patients with chronic pulmonary disease, enteric pathogenicity, nasal mucosa atrophy, and rhinoscleroma. New antibiotic resistant strains of *K. pneumoniae* are appearing, and it is increasingly found as a nosocomial infection, for example, due to contact with contaminated instruments.

In some embodiments, the invention provides a bacteriophage having a genome comprising or consisting of the nucleic acid sequence of SEQ ID NO: 2. A specific example in accordance with this embodiment is the isolated bacteriophage F394/08, which targets a number of strains of *Acinetobacter* species, including *A. baumanni, A. calcoaceticus*, and *A. Iwoffi*. A schematic organization of the F394/08 genome, comprising the nucleic acid sequence of SEQ ID NO: 2, is provided in FIG. 3. Open reading frames (ORFs) in the F394/08 genome are provided in FIG. 4. Also provided are the positions of the ORFs within the genome, the amino acid sequences encoded by the ORFs, homologous or similar proteins and conserved domains within the encoded polypeptide, and the assignment of putative functions. ORFs 1-47 listed in FIG. 4 encode the amino acid sequences of SEQ ID NOs: 177-223, respectively.

*Acinetobacter baumannii* is a species of bacteria that causes a number of severe clinical infections, particularly in individuals with compromised immune systems. *A. baumannii* is a pleomorphic aerobic gram-negative *bacillus* that is commonly isolated from the hospital environment and from hospitalized patients. The bacterium often enters the body open wounds, catheters, or breathing tubes. *A. baumannii* usually colonizes aquatic environments and is often cultured from hospitalized patients' sputum or respiratory secretions, wounds, and urine. In a hospital setting, *A. baumannii* commonly colonizes irrigating solutions and intravenous solutions. It is also known to be resistant to multiple antibiotics and the number of nosocomial infections caused by *A. baumanni* has increased in recent years.

In some embodiments, the invention provides a bacteriophage having a genome comprising or consisting of the nucleic acid sequence of SEQ ID NO: 3. A specific example in accordance with this embodiment is the isolated bacteriophage F488/08, which targets a number of strains of *Escherichia* species, including *E. coli*. A schematic organization of the F488/08 genome, comprising the nucleic acid sequence of SEQ ID NO: 3, is provided in FIG. 5. Open reading frames (ORFs) in the F488/08 genome are provided in FIG. 6. Also provided are the positions of the ORFs within the genome, the amino acid sequences encoded by the ORFs, homologous or similar proteins and conserved domains within the encoded polypeptide, and the assignment of putative functions. ORFs 1-283 listed in FIG. 6 encode the amino acid sequences of SEQ ID NOs: 224-506, respectively.

*Escherichia coli* is a Gram negative rod-shaped bacterium that is commonly found in the lower intestine of mammals, comprising the primaru facultative anaerobic of the human gastrointestinal tract. Most *E. coli* strains are harmless and may form part of the normal flora of the gut, where they may benefit their hosts, e.g., by producing vitamin K2 and/or by preventing the establishment of pathogenic bacteria within the intestines. Certain virulent strains of *E. coli*, however, may cause food poisoning, typically manifesting as a bout of diarrhea. More virulent strains, such as O157:H7, can cause serious illness and even death in the elderly, the very young, or the immunocompromised. Strains such as O157:H7, as well as O121 and O104:H21, produce potentially lethal toxins. Virulent strains of *E. coli* also can cause gastroenteritis, urinary tract infections, and neonatal meningitis, as well as, in rarer cases, haemolytic-uremic syndrome (HUS), peritonitis, mastitis, septicemia, and Gram-negative pneumonia. Further, if *E. coli* bacteria escape the intestinal tract through a perforation (for example from a ruptured appendix, and ulcer, or a surgical error) and enter the abdomen, they usually cause peritonitis that can be fatal without prompt treatment. Intestinal mucosa-associated *E. coli* also are observed in increased numbers in the inflammatory bowel diseases, Crohn's disease and ulcerative colitis.

Antibiotics that may be used to treat *E. coli* infection include amoxicillin as well as other semi-synthetic penicillins, many cephalosporins, carbapenems, aztreonam, trimethoprim-sulfamethoxazole, ciprofloxacin, nitrofurantoin, and the aminoglycosides. Nonetheless, as Gram-negative organisms, *E. coli* are resistant to many antibiotics that are effective against Gram-positive organisms and antibiotic resistance is a growing problem. Resistance to beta-lactam antibiotics, for example, has become a particular problem in recent decades, as strains of bacteria that produce extended-spectrum beta-lactamases become more common. These beta-lactamase enzymes can render many, if not all, penicillins and/or cephalosporins therapeutically ineffective. Extended-spectrum beta-lactamase producing *E. coli* strains that are resistant to an array of antibiotics result in infections that are particularly difficult to treat.

In some embodiments, the invention provides a bacteriophage having a genome comprising or consisting of the nucleic acid sequence of SEQ ID NO: 4. A specific example in accordance with this embodiment is the isolated bacteriophage F510/08, which targets a number of strains of *Pseudomonas* species, including *P. aeruginosa*. A schematic organization of the F510/08 genome, comprising the nucleic acid sequence of SEQ ID NO: 4, is provided in FIG. 7. Open reading frames (ORFs) in the F510/08 genome are provided in FIG. 8. Also provided are the positions of the ORFs within the genome, the amino acid sequences encoded by the ORFs, homologous or similar proteins and conserved domains within the encoded polypeptide, and the assignment of putative functions. ORFs 1-53 listed in FIG. 8 encode the amino acid sequences of SEQ ID NOs: 507-559, respectively.

*Pseudomonas aeruginosa* is a common Gram-negative rod-shaped bacterium found in soil, water, skin flora and most man-made environments. It thrives not only in normal atmospheres, but also with little oxygen as a facultative anaerobe, and can infect damaged tissues or immunocompromised individuals. When such colonisations occur in critical body organs such as the lungs, the urinary tract, and kidneys, the results can be fatal. Because it thrives on surfaces, this bacterium is also found on and in medical equipment including catheters, causing cross infections in hospitals and clinics. *P. aeruginosa* is one of the most relevant opportunistic, nosocomial pathogens, and it has been estimated that one in ten hospital-acquired infections are from *Pseudomonas*. *P. aeruginosa* is also the most common cause of burn injury infections and the most frequent colonizer of medical devices, such as catheters.

In some embodiments, the invention provides a bacteriophage having a genome comprising or consisting of the nucleic acid sequence of SEQ ID NO: 560. A specific example in accordance with this embodiment is the isolated bacteriophage F44/10, which targets a number of strains of *Staphylococcus* species, including *S. aureus*. A schematic organization of the F44/10 genome, comprising the nucleic acid sequence of SEQ ID NO: 560, is provided in FIG. 9. Open reading frames (ORFs) in the F44/10 genome are provided in FIG. 10. Also provided are the positions of the ORFs within the genome, the amino acid sequences encoded by the ORFs, homologous or similar proteins and conserved domains within the encoded polypeptide, and the assignment of putative functions. ORFs 1-216, including 1a, 1b, 82a, 82b, 82c, 114a, and 114b, listed in FIG. 10, encode the amino acid sequences of SEQ ID NOs: 561-780, as indicated in the Figure.

In some embodiments, the invention provides a bacteriophage having a genome comprising or consisting of the nucleic acid sequence of SEQ ID NO: 1074. A specific example in accordance with this embodiment is the isolated bacteriophage F125/10, which targets a number of strains of *Staphylococcus* species, including *S. aureus*. A schematic organization of the F125/10 genome, comprising the nucleic acid sequence of SEQ ID NO: 1074, is provided in FIG. 13. Open reading frames (ORFs) in the F125/10 genome are provided in FIG. 14. Also provided are the positions of the ORFs within the genome, the amino acid sequences encoded by the ORFs, homologous or similar proteins and conserved domains within the encoded polypeptide, and the assignment of putative functions. ORFs 1-221, including 1a, 1b, 36a, 36b, 68a, 68b, 153a, and 153b, listed in FIG. 14, encode the amino acid sequences of SEQ ID NOs: 1075-1300, as indicated in the Figure.

*Staphylococcus aureus* is a Gram-positive spherical facultative anaerobe, which grows as grape-like clusters with a characteristic golden color, and the most common cause of staph infections. It is frequently part of the flora of human skin and responsible for a range of infections, including pimples, carbuncles, scalded skin syndrome, pneumonia, gastroenteritis, meningitis, osteomyelitis, endocarditis, toxic shock syndrome, bacteremia, and sepsis. It remains one of the five most common causes of nosocomial infections, often causing post-surgical wound infections. It has been estimated that about 50,000 patients in American hospitals contract a staph infection. Of particular concern are the methicillin-resistant *Staphylococcus aureus* strains (MRSA). MRSA remained an uncommon occurrence in hospital setting until the 1990's, when there was an explosion in MRSA prevalence in hospitals, where it now is considered endemic, especially in the UK. Johnson A. P., et al., *J. Antimicrobial Chemotherapy*, 48(1): 143-144 (2001). *S. aureus* has proven to be a very hardy bacterium, and was shown in one study that it could survive on polyester for almost three months, polyester being the main material used in hospital privacy curtains. Neely, A. N., et al., J. Clin. Microbiol., 38(2): 724-726 (2000).

The following organisms were deposited on Sep. 16, 20011, with NCIMB Limited, located at the Ferguson Building, Craibstone Estate, Bucksburn, Aberdeen, AB21 9YA, Scotland UK, under the provisions of the Budapest Treaty for the International Recognition of the Deposit of Microorganisms for the Purpose of Patent Procedure ("Budapest Treaty") and the NCIMB has assigned the corresponding NCIMB accession numbers as follows: host strain *Pseudomonas aeruginosa* 433/07 B2, NCIMB 41861; host strain *Staphylococcus aureus* 743/06 B1, NCIMB 41862; host strain *Acinetobacter baumannii* 1305/05 B3, NCIMB 41863; *Pseudomonas aeruginosa* phage F770/05, NCIMB 41864; *Acinetobacter baumannii* phage F1245/05, NCIMB 41865; *Staphylococcus aureus* phage F125/10, NCIMB 41866; *Staphylococcus aureus* phage F44/10, NCIMB 41867; and *Pseudomonas aeruginosa* phage F510/08, NCIMB 41868, all of which are incorporated by reference herein.

In certain embodiments, the bacteriophage of the invention comprises or consists of a genome having a sequence identity of at least 85%, 90%, 95%, 96%, 97%, 98% or at least 99% with the nucleic acid sequence of SEQ ID NO: 1, SEQ ID NO: 2, SEQ ID NO: 3, SEQ ID NO: 4, SEQ ID NO: 560, SEQ ID NO: 781, or SEQ ID NO: 1074, which bacteriophage exhibits at least one biological activity, e.g., antimicrobial or antibacterial activity (e.g., lytic killing activity), of one or more of bacteriophage F391/08, F394/08, F488/08, F510/08, F387/08, FF44/10, and F125/10. Alternatively or in addition, the bacteriophage of the invention may have a genome comprising a functional fragment of the nucleic acid sequence of SEQ ID NO: 1, SEQ ID NO: 2, SEQ ID NO: 3, SEQ ID NO:4, SEQ ID NO: 560, SEQ ID NO: 781, or SEQ ID NO: 1074, including the sequences of any of the open reading frames described in FIGS. 2, 4, 6, 8, 10, 12, and/or 14.

The invention also provides for isolated bacteria infected with one or more of the bacteriophage of the invention. In certain embodiments, the invention provides isolated *K. pneumoniae* infected with a bacteriophage having a genome comprising or consisting of the nucleic acid sequence of SEQ ID NO: 1 and/or SEQ ID NO: 781. In certain embodiments, the invention provides isolated *A. baumannii* infected with a bacteriophage having a genome comprising or consisting of the nucleic acid sequence of SEQ ID NO: 2. In certain embodiments, the invention provides isolated *E. coli* infected with a bacteriophage having a genome comprising or consisting of the nucleic acid sequence of SEQ ID NO: 3. In certain embodiments, the invention provides isolated *P. aeruginosa* infected with a bacteriophage having a genome comprising or consisting of the nucleic acid sequence of SEQ ID NO: 4. In certain embodiments, the invention provides isolated *S. aureus* infected with a bacteriophage having a genome comprising or consisting of the nucleic acid sequence of SEQ ID NO: 560 and/or SEQ ID NO: 1074.

The invention provides for methods of production and isolation of a bacteriophage having a genome comprising or consisting of the nucleic acid sequence of SEQ ID NO: 1, SEQ ID NO: 2, SEQ ID NO: 3, SEQ ID NO: 4, SEQ ID NO: 560, SEQ ID NO: 781, or SEQ ID NO: 1074. In certain embodiments, the invention provides for a method of producing and/or isolating a bacteriophage having a genome that comprises or consists of the nucleic acid sequence of SEQ ID NO: 1 and/or SEQ ID NO: 781 comprising (i) obtaining a culture of *K. pneumoniae*, (ii) infecting it with the bacteriophage having a genome comprising or consisting of the nucleic acid sequence of SEQ ID NO: 1 and/or SEQ ID NO: 781; (iii) culturing until significant lysis of the culture is observed; and (iv) isolating from the culture the bacteriophage. In other embodiments, the invention provides for a method of producing and/or isolating a bacteriophage having a genome that comprises or consists of the nucleic acid sequence of SEQ ID NO: 2 comprising (i) obtaining a culture of *A. baumannii*, (ii) infecting it with the bacteriophage having a genome comprising or consisting of the nucleic acid sequence of SEQ ID NO: 2; (iii) culturing until significant lysis of the culture is observed; and (iv) isolating from the culture the bacteriophage. In still other embodiments, the invention provides for a method of producing and/or isolating a bacteriophage having a genome that comprises or consists of the nucleic acid sequence of SEQ ID NO: 3 comprising (i) obtaining a culture of *E. coli*, (ii) infecting it with the bacteriophage having a genome comprising or consisting of the nucleic acid sequence of ID NO: 3; (iii) culturing until significant lysis of the culture is observed; and (iv) isolating from the culture the bacteriophage. In yet still other embodiments, the invention provides for a method of producing and/or isolating a bacteriophage having a genome that comprises or consists of the nucleic acid sequence of SEQ ID NO: 4 comprising (i) obtaining a culture of *P. aeruginosa*, (ii) infecting it with the bacteriophage having a genome comprising or consisting of the nucleic acid sequence of SEQ ID NO: 4; (iii) culturing until significant lysis of the culture is observed; and (iv) isolating from the culture the bacteriophage.

In yet still further embodiments, the invention provides for a method of producing and/or isolating a bacteriophage having a genome that comprises or consists of the nucleic acid sequence of SEQ ID NO: 560 and/or SEQ ID NO: 1074 comprising (i) obtaining a culture of *S. aureus*, (ii) infecting it with the bacteriophage having a genome comprising or consisting of the nucleic acid sequence of SEQ ID NO: 560 and/or SEQ ID NO: 1074; (iii) culturing until significant lysis of the culture is observed; and (iv) isolating from the culture the bacteriophage.

Bacteriophage may be isolated from a bacterial sample using any method described herein or known in the art (see, e.g., Carlson, "Working with bacteriophage: common techniques and methodological approaches," In, Kutter and Sulakvelidze (Eds) Bacteriophage: Biology and Applications, 5th ed. CRC Press (2005); incorporated herein by reference in its entirety).

The invention also provides for polypeptides isolated from bacteriophage of the invention. The isolated polypeptides may be full length bacteriophage proteins or may be fragments, variants or derivatives of the bacteriophage proteins provided that the fragment, variant or derivative exhibit at least one biological activity associated with the bacteriophage or polypeptide from which it is derived. In certain embodiments, the polypeptides of the invention are isolated from bacteriophage F387/08 or F391/08 (which typically infect *K. pneumoniae*), F394/08 (which typically infects *A. baumannii*), bacteriophage F488/08 (which typically infects *E. coli*), bacteriophage F510/08 (which typically infects *P. aeruginosa*) or bacteriophage F44/10 or F125/40 (which typically infects *S. aureus*).

In specific embodiments, the polypeptide of the invention is a lysin isolated from a bacteriophage having a genome comprising or consisting of SEQ ID NO: 1, SEQ ID NO: 2, SEQ ID NO: 3, SEQ ID NO: 4, SEQ ID NO: 560, SEQ ID NO: 781, or SEQ ID NO: 1074 (e.g., bacteriophage F391/08, F394/08, F488/08, F510/08, F44/10, F387/08, or F125/10, respectively). In specific embodiments, the polypeptide of the invention is a lysin, e.g., an endolysin or tail lysin, having the amino acid sequence comprising or consisting of SEQ ID NO: 20, SEQ ID NO: 80, SEQ ID NO: 192, SEQ ID NO: 282, SEQ ID NO: 547, SEQ ID NO: 556, SEQ ID NO: 557, SEQ ID NO: 598, SEQ ID NO: 1216, or SEQ ID NO: 1261. Predicted functions of said lysins include, for example an Ig-like virion protein (SEQ ID NO: 20), cell wall hydrdolase (SEQ ID NO: 80), endolysin; N-acetylmuramoyl-L-alanine amidase (SEQ ID NO: 192), soluble lysozyme (SEQ ID NO: 282), T4-like lysozyme (SEQ ID NO: 547), endolysin (SEQ ID NO: 556), lambda Rz1-like protein (SEQ ID NO: 557), endolysin (SEQ ID NO: 598), endolysin (SEQ ID NO:1216), and tail lysin (SEQ ID NO: 1261).

In other embodiments, the isolated polypeptide of the invention is a fragment, variant or derivative of an endolysin or lysin isolated from a bacteriophage of the invention, which fragment, variant or derivative exhibits at least one biological activity, preferably antibacterial activity (e.g., lytic killing activity), of the endolysin, lysin or bacteriophage from which it is isolated or derived. Accordingly, in certain embodiments, the invention provides isolated polypeptides that are fragments, variants or derivatives of endolysins or lysins isolated from bacteriophage of the invention, which fragments, variants or derivatives exhibit antibacterial or antimicrobial activity (e.g., lytic killing activity) against one or more of *K. pneumoniae, A. baumannii, E. coli, P. aeruginosa*, or *S. aureus*. In other embodiments, the isolated polypeptides are fragments, variants or derivatives of endolysins or lysins isolated from bacteriophage of the invention that exhibit antibacterial or antimicrobial activity (e.g., lytic killing activity) against one or more species of bacteria other than *K. pneumoniae, A. baumannii, E. coli, P. aeruginosa*, or *S. aureus*. In certain embodiments, the polypeptide of the invention comprises or consists of the amino acid sequence SEQ ID NO: 20 and/or SEQ ID NO: 80, or a fragment, variant or derivative thereof, which polypeptide exhibits antibacterial or antimicrobial activity against one or more strains of *K. pneumoniae*, e.g., against the bacteriophage having a genome comprising or consisting of the nucleic acid sequence SEQ ID NO: 1. In other embodiments, the polypeptide of the invention comprises or consists of the amino acid sequence SEQ ID NO: 192, or a fragment, variant or derivative thereof, which polypeptide exhibits antibacterial or antimicrobial activity against one or more strains of *A. baumannii*, e.g., against the bacteriophage having a genome comprising or consisting of the nucleic acid sequence SEQ ID NO: 2. In yet still other embodiments, the polypeptide of the invention comprises or consists of the amino acid sequence SEQ ID NO: 282, or a fragment, variant or derivative thereof, which polypeptide exhibits antibacterial or antimicrobial activity against one or more strains of *E. coli*, e.g., against the bacteriophage having a genome comprising or consisting of the nucleic acid sequence SEQ ID NO: 3. In yet still other embodiments, the polypeptide of the invention comprises or consists of the amino acid sequence SEQ ID NO: 547, SEQ ID NO: 556, SEQ ID NO: 557, or a fragment, variant or derivative thereof, which polypeptide exhibits antibacterial or antimicrobial activity against one or more strains of *P. aeruginosa*, e.g., against the bacteriophage having a genome comprising or consisting of the nucleic acid sequence SEQ ID NO: 4. In yet still further embodiments, the polypeptide of the invention comprises or consists of the amino acid sequence SEQ ID NO: 598, or a fragment, variant or derivative thereof, which polypeptide exhibits antibacterial or antimicrobial activity against one or more strains of *S. aureus*, e.g., against the bacteriophage having a genome comprising or consisting of the nucleic acid sequence SEQ ID NO: 560. In yet still further embodiments, the polypeptide of the invention comprises or consists of the amino acid sequence SEQ ID NO: 1216 and/or SEQ ID NO: 1261, or a fragment, variant or derivative thereof, which polypeptide exhibits antibacterial or antimicrobial activity against one or more strains of *S. aureus*, e.g., against the bacteriophage having a genome comprising or consisting of the nucleic acid sequence SEQ ID NO: 1074.

In certain embodiments, the polypeptide of the invention comprises or consists of a CHAP domain isolated from an endolysin or lysin of bacteriophage F387/08, F391/08, F394/08, F488/08, F510/08, F44/10, or F125/10. Isolated CHAP domains have been demonstrated to retain the antibacterial activity, e.g., lytic killing activity, of the endolysin or lysin from which they are derived; CHAP domains may be identified and isolated by methods routine in the art (see, e.g., Rigden et al., 2003, *Trends Biochem. Sci.* 28:230-234; Bateman et al., 2003, *Trends Biochem. Sci.* 28:234-237, each of which is incorporated by reference herein in its entirety). In specific embodiments, the polypeptide of the invention comprises or consists of a CHAP domain isolated from a polypeptide having an amino acid sequence of SEQ ID NO: 20, SEQ ID NO: 80, SEQ ID NO: 192, SEQ ID NO: 282, SEQ ID NO: 547, SEQ ID NO: 556, SEQ ID NO: 557, SEQ ID NO: 598, SEQ ID NO: 1216, or SEQ ID NO: 1261. In other embodiments the invention provides for a fragment, variant or derivative of a CHAP domain of isolated from an endolysin or lysin of bacteriophage F387/08, F391/08, F394/08, F488/08, F510/08, F44/10, F125/10, which fragment, variant, or derivative exhibits at least one biological activity, e.g., lytic cell killing, of the CHAP domain from which it was derived.

In certain embodiments, a polypeptide of the invention comprises or consists of a tail protein (e.g., tail component, tail fiber protein, adsorption associated tail protein, tail length tape measure protein, baseplate wedge subunit), or fragment, variant, or derivative thereof, isolated from a bacteriophage having a genome comprising or consisting of SEQ ID NO: 1, SEQ ID NO: 2, SEQ ID NO: 3, SEQ ID NO:4, SEQ ID NO: 560, SEQ ID NO: 781, or SEQ ID NO: 1074 (e.g., bacteriophage F391/08, F394/08, F488/08, F510/08, F44/10, F387/08, or F125/10 respectively), wherein the tail protein, or fragment, variant, or derivative thereof has a biological function associated with the bacteriophage from which it is derived, e.g., antimicrobial or antibacterial activity (e.g., lytic killing activity). In specific embodiments, the antimicrobial or antibacterial activity of the tail protein is directed against at least one or more species or strains of *K. pneumoniae, A. baumannii, E. coli, P. aeruginosa*, and *S. aureus*. In specific embodiments, the polypeptide of the invention is a tail protein having the amino acid sequence comprising or consisting of SEQ ID NO: 15, SEQ ID NO: 26, SEQ ID NO: 27, SEQ ID NO: 30, SEQ ID NOs: 32-35, SEQ ID NO: 180, SEQ ID NO: 183, SEQ ID NO: 185, SEQ ID NO: 190, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-496, SEQ ID NO: 544, SEQ ID NO: 545, SEQ ID NO: 549, SEQ ID NO: 551, SEQ ID NO: 629; SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1217, SEQ ID NO: 1250, or SEQ ID NO: 1266. In other embodiments, the isolated polypeptide of the invention is a fragment, variant or derivative of the amino acid sequence of SEQ ID NO: 15, SEQ ID NO: 26, SEQ ID NO: 27, SEQ ID NO: 30, SEQ ID NOs: 32-35, SEQ ID NO: 180, SEQ ID NO: 183, SEQ ID NO: 185, SEQ ID NO: 190, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-496, SEQ ID NO: 544, SEQ ID NO: 545, SEQ ID NO: 549, SEQ ID NO: 551, SEQ ID NO: 629; SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1217, SEQ ID NO: 1250, or SEQ ID NO: 1266, which fragment, variant, or derivative exhibits at least one biological activity or function of the bacteriophage from which it is isolated or derived, e.g., antimicrobial or antibacterial activity (e.g., lytic killing activity). In preferred embodiments, the at least one biological activity or function of the fragment, variant or derivative is directed against one or more strains of *K. pneumoniae, A. baumannii, E. coli, P. aeruginosa*, and *S. aureus*.

Predicted functions of said tail proteins include, for example a receptor-binding tail protein (SEQ ID NO: 15), major tail protein (SEQ ID NO: 26), minor tail protein (SEQ ID NO: 27), pore-forming tail tip protein (SEQ ID NO: 30), tail protein (SEQ ID NOs: 32-33), minor tail protein (SEQ ID NO: 34), phage tail protein (SEQ ID NO: 35), tail sheath protein (SEQ ID NO: 180), tail tape measure protein (SEQ ID NO: 183), tail protein (SEQ ID NO: 185), tail-fiber protein (SEQ ID NO: 190), tail tube protein (SEQ ID NO: 231), tail sheath monomer (SEQ ID NO: 232), tail sheath stabilizer and completion protein (SEQ ID NO:235), short tail fibers (SEQ ID NO: 239), base plate wedge completion tail pin (SEQ ID NOs: 240-241), base plate wedge completion tail fiber socket (SEQ ID NO: 242), base plate wedge subunit (SEQ ID NO: 243), base plate wedge initiator (SEQ ID NO: 244), base plate wedge (SEQ ID NO: 245), base plate hub subunit and tail lysozyme, cell-puncturing device (SEQ ID NO: 248), base plate wedge completion (SEQ ID NO: 249), tail completion and sheath stabilizer protein (SEQ ID NO: 252), chaperone long and short tail fiber assembly (SEQ ID NO: 254), tail fiber protein (SEQ ID NO: 433), tail fiber protein (SEQ ID NO: 434), hinge connecter long tail fiber (SEQ ID NO: 435), tail fiber hinge (SEQ ID NO: 436), proximal tail fiber subunit (SEQ ID NO: 437), base plate-tail tube initiatior (SEQ ID NO: 489), base plate (SEQ ID NO: 490), baseplate hub subunit, tail length determinator (SEQ ID NO: 491), base plate distal hub subunit (SEQ ID NO: 492), base plate hub subunit (SEQ ID NO: 493), base plate hub assembly catalyst (SEQ ID NO: 494), baseplate hub subunit (SEQ ID NO: 495), baseplate wedge subunit (SEQ ID NO: 496), tail tubular protein (SEQ ID NOs: 544-545), tail fiber protein (SEQ ID NO: 549 and SEQ ID NO: 551), major tail sheath protein (SEQ ID NO: 629); major tail protein (SEQ ID NO: 686); tail tube protein (SEQ ID NO: 789); fibritin (SEQ ID NO: 796); short tail fibers (SEQ ID NO: 797); base plate wedge completion tail pin (SEQ ID NO: 798); base plate wedge subunit and tail pin (SEQ ID NO: 799); baseplate wedge tail fiber connector (SEQ ID NO: 800); baseplate hub subunit and lysozyme (SEQ ID NO: 806); lysozyme (SEQ ID NO: 854); holin (SEQ ID NO: 999); distal long tail fiber assembly catalyst (SEQ ID NO: 1000); L-shaped tail fiber protein (SEQ ID NO: 1001); hinge connector of long tail fiber distal connector (SEQ ID NO: 1002); hinge connector of long tail fiber proximal connector (SEQ ID NO: 1003); long tail fiber proximal subunit (SEQ ID NO: 1004); baseplate tail tube initiator (SEQ ID NO: 1053); baseplate tail tube cap (SEQ ID NO: 1054); baseplate hub subunit, tail length determinator (SEQ ID NO: 1055); baseplate distal hub subunit (SEQ ID NO: 1056); baseplate hub subunit (SEQ ID NOs: 1057 and 1059); baseplate hub assembly catalyst (SEQ ID NO: 1058); baseplate wedge subunit (SEQ ID NO: 1060); major tail protein (SEQ ID NO: 1077); holin (SEQ ID NO: 1217); major tail sheath protein (SEQ ID NO: 1250); and baseplate protein (SEQ ID NO: 1266).

In certain embodiments, the invention encompasses a variant, fragment or derivative of the amino acid sequence of SEQ ID NO: 15, SEQ ID NO: 26, SEQ ID NO: 27, SEQ ID NO: 30, or SEQ ID NOs: 32-35, which exhibits a biological function associated with the bacteriophage having a genome comprising or consisting of the nucleic acid sequence SEQ ID NO: 1, e.g., antimicrobial or antibacterial activity (e.g., lytic killing activity), which function is directed against one or more strains of *K. pneumoniae*. In certain embodiments, the invention encompasses a variant, fragment or derivative of the amino acid sequence of SEQ ID NO: 789, SEQ ID NOs: 796-800, SEQ ID NO: 806, SEQ ID NO: 854, SEQ ID NOs: 999-1004, or SEQ ID NOs: 1053-1060, which exhibits a biological function associated with the bacteriophage having a genome comprising or consisting of the nucleic acid sequence SEQ ID NO: 781, e.g., antimicrobial or antibacterial activity (e.g., lytic killing activity), which function is directed against one or more strains of *K. pneumoniae*. In other embodiments, the invention encompasses a variant, fragment or derivative of the amino acid sequence of SEQ ID NO: 180, SEQ ID NO: 183, SEQ ID NO: 185, or SEQ ID NO: 190, which exhibits a biological function associated with the bacteriophage having a genome comprising or consisting of the nucleic acid sequence SEQ ID NO: 2, e.g., antimicrobial or antibacterial activity (e.g., lytic killing activity), which function is directed against one or more strains of *A. baumannii*.

In certain embodiments, the invention encompasses a variant, fragment or derivative of the amino acid sequence of SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-495, or SEQ ID NO: 496, which exhibits a biological function associated with the bacteriophage having a genome comprising or consisting of the nucleic acid sequence SEQ ID NO: 3, e.g., antimicrobial or antibacterial activity (e.g., lytic killing activity), which function is directed against one or more strains of *E. coli*. In certain embodiments, the invention encompasses a variant, fragment or derivative of the amino acid sequence of SEQ ID NO: 544, SEQ ID NO: 545, SEQ ID NO: 549, or SEQ ID NO: 551, which exhibits a biological function associated with the bacteriophage having a genome comprising or consisting of the nucleic acid sequence SEQ ID NO: 4, e.g., antimicrobial or antibacterial activity (e.g., lytic killing activity), which function is directed against one or more strains of *P. aeruginosa*. In certain embodiments, the invention encompasses a variant, fragment or derivative of the amino acid sequence of SEQ ID NO: 629 or SEQ ID NO: 686, which exhibits a biological function associated with the bacteriophage having a genome comprising or consisting of the nucleic acid sequence SEQ ID NO: 560, e.g., antimicrobial or antibacterial activity (e.g., lytic killing activity), which function is directed against one or more strains of *S. aureus*. In certain embodiments, the invention encompasses a variant, fragment or derivative of the amino acid sequence of SEQ ID NO: 1077, SEQ ID NO: 1216, SEQ ID NO: 1217, SEQ ID NO: 1250, SEQ ID NO: 1261, or SEQ ID NO: 1266, which exhibits a biological function associated with the bacteriophage having a genome comprising or consisting of the nucleic acid sequence SEQ ID NO: 1074, e.g., antimicrobial or antibacterial activity (e.g., lytic killing activity), which function is directed against one or more strains of *S. aureus*.

In certain embodiments, the isolated polypeptide of the invention is a variant of a bacteriophage polypeptide, which variant comprises or consists of a amino acid sequence having at least 60%, 65%, 70%, 75%, 80%, 85%, 86%, 87%, 88%, 89%, 90%, 91%, 92%, 93%, 94%, 95%, 96%, 97%, 98%, 99%, or greater sequence identity to a second amino acid sequence of the same length (i.e., consisting of the same number of residues), which second amino acid sequence is SEQ ID NO: 15, SEQ ID NO: 20, SEQ ID NO: 26, SEQ ID NO: 27, SEQ ID NO: 30, SEQ ID NOs: 32-35, SEQ ID NO: 80, SEQ ID NO: 180, SEQ ID NO: 183, SEQ ID NO: 185, SEQ ID NO: 190, SEQ ID NO: 192, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NO: 282, SEQ ID NOs: 433-437, SEQ ID NOs: 489-496, SEQ ID NO: 544, SEQ ID NO: 545, SEQ ID NO: 547, SEQ ID NO: 549, SEQ ID NO: 551, SEQ ID NO: 556, SEQ ID NO: 557, SEQ ID NO: 598, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1216, SEQ ID NO: 1217, SEQ ID NO: 1250, SEQ ID NO: 1261, SEQ ID NO: 1266 and/or a fragment thereof, and wherein the variant exhibits at least one biological function or activity of the bacteriophage from which it was derived (e.g., antimicrobial or antibacterial activity (e.g., lytic killing activity)) against one or more strains of bacteria, e.g., Gram-positive bacteria (e.g., *S. aureus*), Gram-negative bacteria (e.g., *K. pneumoniae, A baumannii, E. coli, P. aeruginosa*) or bacteria not classified as either Gram-positive or Gram-negative.

In certain embodiments, the invention provides an isolated polypeptide having an amino acid sequence of any of SEQ ID NOs: 5-176, SEQ ID NOs: 177-223, SEQ ID NOs: 224-506, SEQ ID NOs: 507-559, SEQ ID NOs: 561-780, SEQ ID NOs: 782-1073, and SEQ ID NOs: 1075-1300 and active biologic fragments thereof. In preferred embodiments, the variant polypeptide of the invention exhibits at least one biologic activity associated with the polypeptide or bacteriophage from which it was isolated or derived, e.g., lytic activity directed against at least one or more strains of *K. pneumoniae, A. baumannii, E. coli, P. aeruginosa*, and/or *S. aureus*.

In other embodiments, the invention provides an isolated nucleic acid sequence encoding the amino acid sequence of one of SEQ ID NOs: 5-176, SEQ ID NOs: 177-223, SEQ ID NOs: 224-506, SEQ ID NOs: 507-559, SEQ ID NOs: 561-780, SEQ ID NOs: 782-1073, and SEQ ID NOs: 1075-1300 and active fragments thereof. In other embodiments the invention provides the nucleic acid sequence encoding any of the open reading frames identified in FIGS. 2, 4, 6, 8, 10, 12, and/or 14.

In certain embodiments, the polypeptides of the present invention are recombinantly fused or chemically conjugated (including both covalently and non-covalently conjugations)

to therapeutic agents, e.g., heterologous polypeptides or small molecules, to generate fusion proteins or chimeric polypeptides. The fusion does not necessarily need to be direct, but may occur through linker sequences or through chemical conjugation. Non-limiting examples of therapeutic agents to which the polypeptides of the invention may be conjugated are peptide or non-peptide cytotoxins (including antimicrobials and/or antibiotics), tracer/marker molecules (e.g., radionuclides and fluorphores) and other antibiotic or antibacterial compounds known in the art.

6.2 ANTIBIOTIC COMPOSITIONS

The isolated bacteriophage or polypeptides of the present invention may be administered alone or incorporated into a pharmaceutical composition for the use in treatment or prophylaxis of bacterial infections, e.g., infections caused by bacteria including, but not limited to, *K. pneumoniae, A. baumannii, E. coli, P. aeruginosa* and *S. aureus*. The polypeptides may be combined with a pharmaceutically acceptable carrier, excipient, or stabilizer. Examples of pharmaceutically acceptable carriers, excipients and stabilizers include, but are not limited to, buffers such as phosphate, citrate, and other organic acids; antioxidants including ascorbic acid; low molecular weight polypeptides; proteins, such as serum albumin and gelatin; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™. The pharmaceutical compositions of the present invention (e.g., antibacterial compositions) can also include a lubricant, a wetting agent, a sweetener, a flavoring agent, an emulsifier, a suspending agent, and a preservative, e.g., in addition to the above ingredients.

The bacteriophage and/or polypeptides of the present invention may also be combined with one or more therapeutic and/or prophylactic agents useful for the treatment of bacterial infection as described herein and/or known in the art (e.g. one or more lysins). The pharmaceutical compositions of the invention may therefore comprise two or more isolated bacteriophage of the invention (with antibacterial activity against the same or different bacterial species or strains), the combination of a bacteriophage and a polypeptide of the invention or the combination of a bacteriophage and/or polypeptide of the invention and a bacteriophage and/or polypeptide known in the art. In specific embodiments, the therapeutic components of a combination target two or more species or strains of bacteria or exhibit differing enzymatic activity. For example, lysins in general exhibit one of amidase, endopeptidase, muramidase or glucosamidase activity. Accordingly, the combination of lysins exhibiting different activities may provide synergistic enhancement to the therapeutic activity of the pharmaceutical composition of the invention.

In some embodiments, a number of different bacteriophage are combined to provide a "phage cocktail." In some embodiments, the phage cocktail comprises at least 2 phage, at least 3 phage, at least 4 phage, at least 5 phage, at least 6 phage, at least 7 phage, at least 8 phage, at least 9 phage, at least 10 phage, or more. In some embodiments, the phage cocktail comprises 2-20 phage, 2-15 phage, 2-10 phage, 3-8 phage, or 4-6 phage.

In some embodiments, at least one phage of the cocktail is a phage with antibacterial activity against at least one Gram-negative bacteria, including but not limited to *Klebsiella pneumoniae, Acinetobacter baumannii, Escherichia coli*, and *Pseudomonas aeruginosa*; and/or against at least one Gram-positive bacteria including but not limited to *Staphylococcus aureus*. In certain embodiments, at least one phage of the cocktail is F391/08, having a genome comprising the nucleic acid sequence of SEQ ID NO:1 and exhibiting antibacterial activity against one or more strains of *Klebsiella pneumoniae*. In certain embodiments, at least one phage of the cocktail is F394/08, having a genome comprising the nucleic acid sequence of SEQ ID NO:2 and exhibiting antibacterial activity against one or more strains of *Acinetobacter baumannii*. In certain embodiments, at least one phage of the cocktail is F488/08, having a genome comprising the nucleic acid sequence of SEQ ID NO:3 and exhibiting antibacterial activity against one or more strains of *Escherichia coli*. In certain embodiments, at least one phage of the cocktail is F510/08, having a genome comprising the nucleic acid sequence of SEQ ID NO:4 and exhibiting antibacterial activity against one or more strains of *Pseudomonas aeruginosa*. In certain embodiments, at least one phage of the cocktail is F44/10, having a genome comprising the nucleic acid sequence of SEQ ID NO:560 and exhibiting antibacterial activity against one or more strains of *Staphylococcus aureus*. In certain embodiments, at least one phage of the cocktail is F387/08, having a genome comprising the nucleic acid sequence of SEQ ID NO:781 and exhibiting antibacterial activity against one or more strains of *Klebsiella pneumoniae*. In certain embodiments, at least one phage of the cocktail is F125/10, having a genome comprising the nucleic acid sequence of SEQ ID NO:1074 and exhibiting antibacterial activity against one or more strains of *Staphylococcus aureus*.

In certain embodiments, at least one phage of the cocktail is F170/08, having a genome as disclosed in WO 2010/090542, and exhibiting antibacterial activity against one or more strains of *Enterococcus faecalis* or *faecium*. In certain embodiments, at least one phage of the cocktail is F168/08, having a genome as disclosed in WO 2010/090542, and exhibiting antibacterial activity against one or more strains of *Enterococcus faecalis* or *faecium*. In certain embodiments, at least one phage of the cocktail is F770/05, having a genome as disclosed in WO 2010/090542, and exhibiting antibacterial activity against one or more strains of *Pseudomonas aeruginos*. In certain embodiments, at least one phage of the cocktail is F1245/05, having a genome as disclosed in WO 2010/090542, and exhibiting antibacterial activity against one or more strains of *Acinetobacter baumannii*.

In some preferred embodiments, the cocktail comprises a phage having biological activity against *Acinetobacter*. For example, the cocktail may comprise F394/08 and/or F1245/05, exhibiting antibacterial activity against one or more strains of *Acinetobacter baumannii*. In certain embodiments, the phage cocktail comprises at least one phage exhibiting antibacterial activity against one or more strains of *Acinetobacter baumannii* and at least one phage exhibiting antibacterial activity against a different bacteria. For example, in some embodiments, the phage cocktail comprises F394/08 and/or F1245/05 in combination with at least one other phage selected from F391/08, F488/08, F510/08, F44/10, F387/08, F170/08, F168/08, F770/05, and F125/10. In certain embodiments, the phage cocktail comprises at least one phage exhibiting antibacterial activity against one or more strains *Klebsiella pneumoniae* and at least one phage exhibiting antibacterial activity against a different bacteria. For example, in some embodiments, the phage cocktail comprises F391/08 and/or F387/08 in combination with at least one other phage selected from F394/08, F488/08, F510/08, F44/10, F1245/05, F170/08, F168/08, F770/05, and F125/10. In certain embodiments, the phage cocktail comprises at least one phage exhibiting antibacterial activity against one or more strains of *Escherichia coli* and at least one phage exhibiting antibacterial activity against a different bacteria. For example, in some embodiments, the phage cocktail comprises F488/08 in combination with at least one other phage selected from F391/08, F510/08, F44/10, F394/08, F387/08, F170/08, F168/08, F1245/05, F770/05, and F125/10.

In certain embodiments, the phage cocktail comprises at least one phage exhibiting antibacterial activity against one or more strains of *Pseudomonas aeruginosa* and at least one phage exhibiting antibacterial activity against a different bacteria. For example, in some embodiments, the phage cocktail comprises F510/08 and/or F770/05 in combination with at least one other phage selected from F391/08, F394/08, F488/08, F44/10, F387/08, F170/08, F168/08, F1245/05, and F125/10. In certain embodiments, the phage cocktail comprises at least one phage exhibiting antibacterial activity against one or more strains of *Staphylococcus aureus* and at least one phage exhibiting antibacterial activity against a different bacteria. For example, in some embodiments, the phage cocktail comprises F44/10 and/or F125/10 in combination with at least one other phage selected from F391/08, F394/08, F488/08, F510/08, F387/08, F170/08, F168/08, F770/05, and F1245/05. In certain embodiments, the phage cocktail comprises at least one phage exhibiting antibacterial activity against one or more strains of *Enterococcus faecalis* or *faecium* and at least one phage exhibiting antibacterial activity against a different bacteria. For example, in some embodiments, the phage cocktail comprises F170/08 and/or F168/08 in combination with at least one other phage selected from F391/08, F394/08, F488/08, F510/08, F44/10, F387/08, F770/05, F1245/05, and F125/10.

In certain embodiments, the phage cocktail comprises at least four (4) phage selected from the group consisting of F391/08, F394/08, F488/08, F510/08, F44/10, F387/08, F170/08, F168/08, F770/05, F1245/05, and F125/10. In certain embodiments, the phage cocktail comprises F391/08, F394/08, F488/08, and F510/08. In certain embodiments, the phage cocktail comprises F44/10, F387/08, F170/08, and F168/08. In certain embodiments, the phage cocktail comprises of F391/08, F394/08, F770/05, and F1245/05. In certain embodiments, the phage cocktail comprises F391/08, F394/08, F510/08, and/or F44/10. In certain embodiments, the phage cocktail comprises F391/08, F394/08, F44/10, and/or F387/08. In certain embodiments, the phage cocktail comprises F391/08, F394/08, F387/08, and/or F170/08. In certain embodiments, the phage cocktail comprises F391/08, F394/08, F170/08, and F168/08. In certain embodiments, the phage cocktail comprises F391/08, F394/08, F168/08, and/or F770/05. In certain embodiments, the phage cocktail comprises F391/08, F394/08, F770/05, and F1245/05.

In certain embodiments, the phage cocktail comprises F125/10, F391/08, F394/08, and F488/08. In certain embodiments, the phage cocktail comprises F125/10, F394/08, F488/08, and F510/08. In certain embodiments, the phage cocktail comprises F125/10, F488/08, F510/08, and F44/10. In certain embodiments, the phage cocktail comprises F125/10, F44/10, F387/08, and F170/08. In certain embodiments, the phage cocktail comprises F125/10, F170/08, F168/08, and F770/05. In certain embodiments, the phage cocktail comprises F125/10, F770/05, F1245/05, and F391/08. In certain embodiments, the phage cocktail comprises F125/10, F510/08, F44/10, F387/08. In certain embodiments, the phage cocktail comprises F125/10, F387/08, F170/08, F168/08. In certain embodiments, the phage cocktail comprises F125/10, F168/08, F770/05, and F1245/05. In certain embodiments, the phage cocktail comprises F125/10, F1245/05, F391/08, and F394/08.

In certain embodiments, the phage cocktail comprises F394/08, F488/088, F510/08, and/or F44/10. In certain embodiments, the phage cocktail comprises F394/08, F488/088, F44/10, and/or F387/08. In certain embodiments, the phage cocktail comprises F394/08, F488/088, F387/08, and/or F170/08. In certain embodiments, the phage cocktail comprises F394/08, F488/088, F170/08, and/or F168/08. In certain embodiments, the phage cocktail comprises F394/08, F488/088, F168/08 and/or F770/05. In certain embodiments, the phage cocktail comprises F394/08, F488/088, FF770/05, and/or F1245/05. In certain embodiments, the phage cocktail comprises F394/08, F488/088, F1245/05 and/or F391/08. In certain embodiments, the phage cocktail comprises F488/08, F510/08, F44/10, and/or F387/08. In certain embodiments, the phage cocktail comprises F488/08, F510/08, F387/08, and/or F170/08. In certain embodiments, the phage cocktail comprises F488/08, F510/08, F170/08, and/or F168/08. In certain embodiments, the phage cocktail comprises F488/08, F510/08, F168/08, and/or F770/05. In certain embodiments, the phage cocktail comprises F488/08, F510/08, F770/05, and/or F1245/05. In certain embodiments, the phage cocktail comprises F488/08, F510/08, F1245/05, and/or F391/08. In certain embodiments, the phage cocktail comprises F488/08, F510/08, F391/08, and/or F394/08.

In certain embodiments, the phage cocktail comprises F387/08, F170/08, F168/08, and/or F770/05. In certain embodiments, the phage cocktail comprises F387/08, F170/08, F770/05, and/or F1245/05. In certain embodiments, the phage cocktail comprises F387/08, F170/08, F1245/05, and/or F391/08. In certain embodiments, the phage cocktail comprises F387/08, F170/08, F391/08, and/or F394/08. In certain embodiments, the phage cocktail comprises F387/08, F170/08, F394/08, and/or F488/08. In certain embodiments, the phage cocktail comprises F387/08, F170/08, F488/08, and/or F510/08. In certain embodiments, the phage cocktail comprises F387/08, F170/08, F510/08, and/or F44/10. In certain embodiments, the phage cocktail comprises F387/08, F170/08, F44/10, and/or F387/08. In certain embodiments, the phage cocktail comprises F387/08, F170/08, F387/08, and/or F170/08. In certain embodiments, the phage cocktail comprises F387/08, F170/08, F170/08, and/or F168/08. In certain embodiments, the phage cocktail comprises F387/08, F170/08, F168/08, and/or F770/05. In certain embodiments, the phage cocktail comprises F387/08, F170/08, F770/05 and/or F1245/05. In certain embodiments, the phage cocktail comprises F387/08, F170/08, F1245/05, and/or F391/08. In certain embodiments, the phage cocktail comprises F387/08, F170/08, F391/08, and/or F394/08. In certain embodiments, the phage cocktail comprises F387/08, F170/08, F394/08 and/or F488/08. In certain embodiments, the phage cocktail comprises F387/08, F170/08, F488/08, and/or F510/08. In certain embodiments, the phage cocktail comprises F387/08, F170/08, F510/08, and/or F44/10.

In some embodiments, the phage cocktail comprises of F510/08, F44/10, F387/08, and/or F170/08. In some embodiments, the phage cocktail comprises F510/08, F44/10, F170/08, and/or F168/08. In some embodiments, the phage cocktail comprises F510/08, F44/10, F168/08, and/or F770/05. In some embodiments, the phage cocktail comprises F510/08, F44/10, F770/05, and/or F1245/05. In some embodiments, the phage cocktail comprises F510/08, F44/10, F1245/05, and/or F391/08. In some embodiments, the phage cocktail comprises F510/08, F44/10, F391/08, and/or F394/08. In some embodiments, the phage cocktail comprises F510/08, F44/10, F394/08, and/or F488/08.

In some embodiments, the phage comprises F44/10, F387/08, F170/08, and/or F168/08. In some embodiments, the phage comprises F44/10, F387/08, F168/08 and/or F770/05. In some embodiments, the phage comprises F44/10, F387/08, F770/05, and/or F1245/05. In some embodiments, the phage comprises F44/10, F387/08, F1245/05, and/or F391/08. In some embodiments, the phage comprises F44/10, F387/08, F391/08, and/or F394/08. In some embodiments, the phage comprises F44/10, F387/08, F394/08 and/or F488/08. In some embodiments, the phage comprises F44/10, F387/08, F488/08 and/or F510/08.

In some embodiments, the phage cocktail composition may or may not involve phage selected for increased in vivo half-life, e.g., as disclosed in U.S. Pat. No. 5,688,501, the contents of which are incorporated herein by reference.

In some embodiments, the cocktail comprises one or more polypeptides isolated from one or more phage, and/or a fragment, variant, or derivative thereof, in particular a polypeptide, fragment, variant, or derivative thereof which has antibacterial or antimicrobial activity. In some embodiments, the polypeptide, or fragment, variant, or derivative thereof comprises or consists of a lysin (or fragment thereof, e.g., a CHAP domain) and/or a tail protein. In more specific embodiments, the polypeptide corresponds to an isolated polypeptide, fragment, variant, or derivative thereof, as described herein and/or in WO 2010/090542, the contents of which are incorporated by reference herein. In some embodiments, the cocktail is administered in the absence of an isolated polypeptide, such as in the absence of a lyase.

Other examples of other therapeutic agents that may be used in combination with the polypeptide of the invention include, but are not limited to, standard antibiotic agents, anti-inflammatory agents, antiviral agents, local anesthetic agents, and corticosteroids. In some embodiments, the cocktail is administered in the absence of an antibiotic.

Standard antibiotics that may be used with pharmaceutical compositions comprising a bacteriophage and/or polypeptide of the invention include, but are not limited to, amikacin, gentamicin, kanamycin, neomycin, netilmicin, paromomycin, rhodostreptomycin, streptomycin, tobramycin, apramycin, rifamycin, naphthomycin, mupirocin, geldanamycin, ansamitocin, carbacephems, imipenem, meropenem, ertapenem, faropenem, doripenem, panipenem/betamipron, biapenem, PZ-601, cephalosporins, cefacetrile, cefadroxil, cefalexin, cefaloglycin, cefalonium, cefaloridine, cefalotin, cefapirin, cefatrizine, cefazaflur, cefazedone, cefazolin, cefradine, cefroxadine, ceftezole, cefaclor, cefonicid, cefprozil, cefuroxime, cefuzonam, cefmetazole, cefotetan, cefoxitin, cefcapene, cefdaloxime, cefdinir, cefditoren, cefetamet, cefixime, cefmenoxime, cefteram, ceftibuten, ceftiofur, ceftiolene, ceftizoxime, ceftriaxone, cefoperazone, ceftazidime latamoxef, cefclidine, cefepime, cefluprenam, cefoselis, cefozopran, cefpirome, cefquinome, flomoxef, ceftobiprole, azithromycin, clarithromycin, dirithromycin, erythromycin, roxithromycin, aztreonam, pencillin and penicillin derivatives, actinomycin, bacitracin, colistin, polymyxin B, cinoxacin, flumequine, nalidixic acid, oxolinic acid, piromidic acide, pipemidic acid, rosoxacin, ciprofloxacin, enoxacin, fleroxacin, lomefloxacin, nadifloxacin, norfloxacin, ofloxacin, pefloxacin, rufloxacin, balofloxacin, gatifloxacin, grepafloxacin, levofloxacin, moxifloxacin, pazufloxacin, sparfloxacin, temafloxacin, tosufloxacin, clinafloxacin, garenoxacin, gemifloxacin, sitafloxacin, trovalfloxacin, prulifloxacin, acetazolamide, benzolamide, bumetanide, celecoxib, chlorthalidone, clopamide, dichlorphenamide, dorzolamide, ethoxyzolamide, furosemide, hydrochlorothiazide, indapamide, mafendide, mefruside, metolazone, probenecid, sulfacetamide, sulfadimethoxine, sulfadoxine, sulfanilamides, sulfamethoxazole, sulfasalazine, sultiame, sumatriptan, xipamide, tetracycline, chlortetracycline, oxytetracycline, doxycycline, lymecycline, meclocycline, methacycline, minocycline, rolitetracycline, methicillin, nafcillin, oxacilin, cloxacillin, vancomycin, teicoplanin, clindamycin, co-trimoxazole, and any combination thereof in amounts that are effective to additively or synergistically enhance the therapeutic effect of the bacteriophage and/or polypeptide of the invention for a given infection.

Local anesthetics that may be used in pharmaceutical compositions of the present invention include tetracaine, tetracaine hydrochloride, lidocain, lidocaine hydrochloride, dimethisoquin hydrochloride, dibucaine, dibucaine hydrochloride, butambenpicrate, and pramoxine hydrochloride. An exemplary concentration of local anesthetic is about 0.025% to about 5% by weight of the total composition.

Corticosteroids that may be useful in combination with the polypeptides, bacteriophage, and/or pharmaceutical compositions of the invention include betamethasone, dipropionate, fluocinolone, actinide, betamethasone valerate, triamcinolone actinide, clobetasol propionate, desoximetasone, diflorasone diacetate, amcinonide, flurandrenolide, hydrocortisone valerate, hydrocortisone butyrate, and desonide. An exemplary concentration of corticosteroid is about 0.01% to about 1% by weight of the total composition.

In certain embodiments, a formulation comprising a bacteriophage and/or polypeptide of the invention further comprises SM buffer (0.05 M Tris-HCl (pH 7.4-7.5); 0.1 M NaCl; 10 mM $MgSO_4$). In other embodiments, the formulation further comprises SM buffer and 10 mM $MgCl_2$. In still other embodiments, the formulation further comprises SM buffer and about 20% or about 30% ethanol.

Pharmaceutical compositions comprising a bacteriophage and/or polypeptide of the present invention can be formulated in a unit dose or multi-dose formulation. Suitable formulations can be selected from the group consisting of ointments, solutions, suspensions or emulsions, extracts, powders, granules, sprays, lozenges, tablets, or capsules; and additionally may include a dispersing agent or a stabilizing agent.

The pharmaceutical compositions of the invention can be administered by inhalation, in the form of a suppository or pessary, topically (e.g., in the form of a lotion, solution, cream, ointment or dusting powder), epi- or transdermally (e.g., by use of a skin patch), orally (e.g., as a tablet, which may contain excipients such as starch or lactose), as a capsule, ovule, elixirs, solutions, or suspensions (each optionally containing flavoring, coloring agents and/or excipients), or they can be injected parenterally (e.g., intravenously, intramuscularly or subcutaneously). For parenteral administration, the compositions may be used in the form of a sterile aqueous solution which may contain other substances, for example enough salts or monosaccharides to make the solution isotonic with blood. For buccal or sublingual administration the compositions may be administered in the form of tablets or lozenges which can be formulated in a conventional manner. In a preferred embodiment, a bacteriophage and/or polypeptide of the present invention is administered topically, either as a single agent, or in combination with other antibiotic treatments, as described herein or known in the art.

A bacteriophage and/or polypeptide of the present invention may also be dermally or transdermally administered. For topical application to the skin, the bacteriophage and/or polypeptides of the present invention may be combined with one or a combination of carriers, which can include but are not limited to, an aqueous liquid, an alcohol base liquid, a water soluble gel, a lotion, an ointment, a nonaqueous liquid base, a mineral oil base, a blend of mineral oil and petrolatum, lanolin, liposomes, proteins carriers such as serum albumin or gelatin, powdered cellulose carmel, and combinations thereof. A topical mode of delivery may include a smear, a spray, a bandage, a time-release patch, a liquid-absorbed wipe, and combinations thereof. The bacteriophage and/or polypeptide of the invention may be applied to a patch, wipe, bandage, etc., either directly or in a carrier(s). The patches, wipes, bandages, etc., may be damp or dry, wherein the phage and/or polypeptide (e.g., a lysin) is in a lyophilized form on the patch. The carriers of topical compositions may comprise semi-solid and gel-like vehicles that include a polymer thickener, water, preservatives, active surfactants, or emulsifiers, antioxidants, sun screens, and a solvent or mixed solvent system. U.S. Pat. No. 5,863,560 discloses a number of different carrier combinations that can aid in the exposure of skin to a medicament, and its contents are incorporated herein. The carrier may or may not involve a controlled-release formulation, e.g., as disclosed in US 2008/0260697, the contents of which are incorporated herein by reference. The carrier may or may not involve phage adsorbed on a matrix, e.g., as described in any one of US 2008/0038322, US 2008/0138311, US 2009/0130196, EP 1 812 025, EP 1 817 043, and EP 1 833 497, the contents of which are incorporated herein by reference. In some embodiments, the carrier may or may not involve a viscous formulation, e.g., a gel, e.g., as disclosed in US 2009/0191254, the contents of which are incorporated herein by reference.

For intranasal or administration by inhalation, the bacteriophage and/or polypeptide of the invention is conveniently delivered in the form of a dry powder inhaler or an aerosol spray presentation from a pressurized container, pump, spray, or nebuliser with the use of a suitable propellant, e.g., dichlorodifluoromethane, trichlorofluoromethane, dichlorotetrafluoroethane, a hydrofluoroalkane such as 1,1,1,2-tetrafluoroethane (HFA 134A.TM.) or 1,1,1,2,3,3,3-heptafluoropropane (HFA 227EA.TM.), carbon dioxide, or other suitable gas. In the case of a pressurized aerosol, the dosage unit may be determined by providing a valve to deliver a metered amount. The pressurized container, pump, spray, or nebuliser may contain a solution or suspension of the active compound, e.g., using a mixture of ethanol and the propellant as the solvent, which may additionally contain a lubricant, e.g., sorbitan trioleate. Capsules and cartridges (made, for example, from gelatin) for use in an inhaler or insufflator may be formulated to contain a powder mix of the bacteriophage and/or polypeptide of the invention and a suitable powder base such as lactose or starch.

For administration in the form of a suppository or pessary, the therapeutic compositions may be applied topically in the form of a gel, hydrogel, lotion, solution, cream, ointment, or dusting powder. Compositions of the invention may also be administered by the ocular route. For ophthalmic use, the compositions of the invention can be formulated as micronized suspensions in isotonic, pH adjusted, sterile saline, or, preferably, as solutions in isotonic, pH adjusted, sterile saline, optionally in combination with a preservative such as a benzylalkonium chloride. Alternatively, they may be formulated in an ointment such as petrolatum.

Dosages and desired drug concentrations of the pharmaceutical compositions of the present invention may vary depending on the particular use. The determination of the appropriate dosage or route of administration is within the skill of an ordinary physician. Animal experiments can provide reliable guidance for the determination of effective doses in human therapy. Interspecies scaling of effective doses can be performed by one of ordinary skill in the art following the principles described by Mordenti, J. and Chappell, W. "The use of interspecies scaling in toxicokinetics" in Toxicokinetics and New Drug Development, Yacobi et al., Eds., Pergamon Press, New York 1989, pp 42-96.

6.3 THERAPEUTIC USE

The bacteriophage and polypeptides of the present invention have activity against a plurality of strains of *K. pneumoniae, A. baumannii, E. coli, P. aeruginosa,* and/or *S. aureus*, e.g., as described in Tables 1-7, in the Examples below. Therefore, the compositions of the present invention may find use in methods of preventing and/or treating infections associated with *K. pneumoniae, A. baumannii, E. coli, P. aeruginosa,* and/or *S. aureus* in both humans and animals. In other embodiments, the compositions of the present invention may be used to treat infection associated with related species or strains of these bacteria, including, but not limited to *S. epidermidis, S. auricularis, S. capitis, S. haemolyticus, S. hominis, S. saprophyticus, S. simulans, S. xylosis, Micrococcus luteus, Bacilus subtilis, B. pumilus, E. hirae.*

In specific embodiments, the subject receiving a pharmaceutical composition of the invention is a mammal (e.g., bovine, ovine, caprine, equid, primate (e.g., human), rodent, lagomorph or avian (e.g., chicken, duck, goose)). In the context of the present invention, "treatment" refers to therapeutic treatment, wherein the object is to eliminate, lessen, decrease the severity of, ameliorate, slow the progression of or prevent the symptoms or underlying cause (e.g., bacterial infection) associated with the pathological condition or disorder. "Treatment" refers to both therapeutic treatment and prophylactic or preventative measures, wherein the object is to eliminate, lessen, decrease the severity of, slow the progression of or delay or prevent the symptoms or underlying cause (e.g., bacterial infection) associated with the pathological condition or disorder. It is also contemplated that a bacteriophage and/or polypeptide of the invention acts as a prophylactic or preventative measure, preventing the onset of infection caused by one or more bacteria.

*K. pneumoniae, A. baumannii, E. coli, P. aeruginosa,* and *S. aureus* are responsible for many severe opportunistic infections, particularly in individuals with compromised immune systems. The pharmaceutical compositions of the present invention are contemplated for treating any infection associated with *K. pneumoniae, A. baumannii, E. coli, P. aeruginosa,* and/or *S. aureus*, or associated with other species or strains of bacteria, including, but not limited to, infections of the skin (including but not limited to skin ulcers, carbuncles, bed sores, and diabetic foot ulcers), infections in and around wounds, post-operative infections, infections associated with catheters and surgical drains, and infections of the blood.

Diabetic foot ulcer is one of the major complications of diabetes mellitus, occurring in about 15% of all diabetic patients and resulting in about 85% of all lower leg amputations. (Brem, et al., J. Clinical Invest., 2007, 117(5):1219-1222). Diabetes mellitus impedes the normal steps of the wound healing process. Non-healing chronic diabetic ulcers are often treated with extracellular matrix replacement therapy, advanced moist wound therapy, bio-engineered tissue or skin substitutes, growth factors, debridement, arterial revascularization, and/or negative pressure wound therapy. (Blume et. al, *Diabetes Care*, 2008, 31: 631-636). The ulcers may become infected with opportunistic bacteria, which further exacerbate the condition. Accordingly, foot ulcers in diabetes also often require antibiotics, e.g., against *Staphylo-*

*coccus*, as well as other anaerobic bacteria, such as *Klebsiella pneumonia, Escherchia coli*, and/or *Pseudomonas aeruginosa*.

One or more compositions of the present invention find use in the treatment of diabetic foot ulcer. For example, an isolated phage or polypeptide of the invention can be used for the treatment of infections associated with diabetic foot ulcer, in a subject in need thereof. In particular embodiments, the composition used for treating diabetic foot ulcer is a topical composition, formulated for topical administration, e.g., a composition for direct application to an ulcer, wound, lesion, and/or sore associated with diabetic foot ulcer.

In certain embodiments, the composition for use with respect to diabetic foot ulcer comprises isolated F44/10, having a genome comprising the nucleic acid sequence of SEQ ID NO:560 and exhibiting antibacterial activity against one or more strains of *Staphylococcus aureus*. In some embodiments, a composition is used comprising a polypeptide isolated from bacteriophage F44/10, or a fragment, variant, or derivative thereof, which polypeptide, fragment, variant, or derivative exhibits antibacterial activity against one or more species or strains of *S. aureus*. In certain such embodiments, the polypeptide, or fragment, variant, or derivative thereof, is a lysin, a CHAP domain, or a tail protein, exhibiting antibacterial activity against one or more species or strains of *S. aureus*. In certain embodiments, the composition for use with respect to diabetic foot ulcer comprises isolated F125/10, having a genome comprising the nucleic acid sequence of SEQ ID NO:1074 and exhibiting antibacterial activity against one or more strains of *Staphylococcus aureus*. In some embodiments, a composition is used comprising a polypeptide isolated from bacteriophage F125/10, or a fragment, variant, or derivative thereof, which polypeptide, fragment, variant, or derivative exhibits antibacterial activity against one or more species or strains of *S. aureus*. In certain such embodiments, the polypeptide, or fragment, variant, or derivative thereof, is a lysin, a CHAP domain, or a tail protein, exhibiting antibacterial activity against one or more species or strains of *S. aureus*.

In certain embodiments, a composition comprising a phage cocktail is used, e.g., where the phage cocktail comprises at least one phage exhibiting antibacterial activity against one or more strains of *Staphylococcus aureus* and at least one phage exhibiting antibacterial activity against a different bacteria. In particular embodiments, the phage cocktail comprises F44/10 and/or F125/10 in combination with at least one other phage selected from F391/08, F394/08, F488/08, F510/08, F387/08, F170/08, F168/08, F770/05, and F1245/05. In particularly preferred embodiments, the phage cocktail comprises F44/10 and/or F125/10 in combination with one, two, three or more other phages selected from F391/08, F387/08, F488/08, F510/08 and/or F770/05.

In certain embodiments, the composition for use with respect to diabetic foot ulcer comprises isolated F391/08 and/or F387/08, having a genome comprising the nucleic acid sequence of SEQ ID NO:1 or SEQ ID NO: 781, respectively, and exhibiting antibacterial activity against one or more strains of *Klebsiella pneumoniae*. In some embodiments, a composition is used comprising a polypeptide isolated from bacteriophage F391/08 and/or F387/08, or a fragment, variant, or derivative thereof, which polypeptide, fragment, variant, or derivative exhibits antibacterial activity against one or more species or strains of *K. pneumoniae*. In certain such embodiments, the polypeptide, or fragment, variant, or derivative thereof, is a lysin, a CHAP domain, or a tail protein, exhibiting antibacterial activity against one or more species or strains of *K. pneumoniae*. In certain embodiments, a composition comprising a phage cocktail is used, e.g., where the phage cocktail comprises at least one phage exhibiting antibacterial activity against one or more strains of *Klebsiella pneumoniae* and at least one phage exhibiting antibacterial activity against a different bacteria. In particular embodiments, the phage cocktail comprises F391/08 and/or F387/08 in combination with at least one other phage selected from F394/08, F488/08, F510/08, F44/10, F170/08, F168/08, F770/05, F1245/05, and F125/10. In particularly preferred embodiments, the phage cocktail comprises F391/08 and/or F387/08 in combination with one, two, three or more other phages selected from F44/10, F488/08, F510/08 and/or F770/05.

In certain embodiments, the composition for use with respect to diabetic foot ulcer comprises isolated F488/08, having a genome comprising the nucleic acid sequence of SEQ ID NO:3 and exhibiting antibacterial activity against one or more strains of *Escherichia coli*. In some embodiments, a composition is used comprising a polypeptide isolated from bacteriophage F488/08, or a fragment, variant, or derivative thereof, which polypeptide, fragment, variant, or derivative exhibits antibacterial activity against one or more species or strains of *E. coli*. In certain such embodiments, the polypeptide, or fragment, variant, or derivative thereof, is a lysin, a CHAP domain, or a tail protein, exhibiting antibacterial activity against one or more species or strains of *Escherichia coli*. In certain embodiments, a composition comprising a phage cocktail is used, e.g., where the phage cocktail comprises at least one phage exhibiting antibacterial activity against one or more strains of *Escherichia coli* and at least one phage exhibiting antibacterial activity against a different bacteria. In particular embodiments, the phage cocktail comprises F488/08 in combination with at least one other phage selected from F394/08, F510/08, F44/10, F170/08, F168/08, F770/05, F1245/05, F391/08 F387/08, and F125/10. In particularly preferred embodiments, the phage cocktail comprises F488/08 in combination with one, two, three or more other phages selected from F391/08, F387/08, F44/10, F125/10, F510/08 and/or F770/05.

In certain embodiments, the composition for use with respect to diabetic foot ulcer comprises isolated F510/08 and/or F770/05, having a genome comprising the nucleic acid sequence of SEQ ID NO:4 or as disclosed in WO 2010/090542, respectively, and exhibiting antibacterial activity against one or more strains of *Pseudomonas aeruginosa*. In some embodiments, a composition is used comprising a polypeptide isolated from bacteriophage F510/08 and/or F770/05, or a fragment, variant, or derivative thereof, which polypeptide, fragment, variant, or derivative exhibits antibacterial activity against one or more species or strains of *P. aeruginosa*. In certain such embodiments, the polypeptide, or fragment, variant, or derivative thereof, is a lysin, a CHAP domain, or a tail protein, exhibiting antibacterial activity against one or more species or strains of *Pseudomonas aeruginosa*. In certain embodiments, a composition comprising a phage cocktail is used, e.g., where the phage cocktail comprises at least one phage exhibiting antibacterial activity against one or more strains of *Pseudomonas aeruginosa* and at least one phage exhibiting antibacterial activity against a different bacteria. In particular embodiments, the phage cocktail comprises F510/08 and/or F770/05 in combination with at least one other phage selected from F394/08, F488/08, F44/10, F170/08, F168/08, F1245/05, F391/08, F387/08, and F125/10. In particularly preferred embodiments, the phage cocktail comprises F510/08 and/or F770/05 in combination with one, two, three or more other phages selected from F44/10, F488/08, F391/08, and/or F387/08.

*K. pneumoniae, A. baumannii, E. coli, P. aeruginosa*, and *S. aureus* are also associated with infections that involve organ systems that have a high fluid content, and it is contemplated that the bacteriophage and/or polypeptides of the invention have therapeutic use in the prevention and treatment of these infections. For example, the pharmaceutical compositions of the invention may be used for the prevention or treatment of infections of the respiratory tract, of the cerebrospinal fluid, of peritoneal fluid, and of the urinary tract. The compositions of the invention may also be used to prevent and/or treat nosocomial pneumonia, infections associated with continuous ambulatory peritoneal dialysis (CAPD), catheter-associated bacterimia, and nosocomial meningitis.

In a preferred embodiment, a bacteriophage and/or polypeptide of the invention is used prophylactically in hospital setting, particularly to prevent infections associated with wounds, ulcers, and openings in the skin, e.g., due to catheterization and any other medical procedures or devices.

In certain embodiments, a bacteriophage and/or polypeptide of the invention is used as a single agent for treating or preventing infections associated with *K. pneumoniae, A. baumannii, E. coli, P. aeruginosa*, and/or *S. aureus*, and/or other bacterial species. In other embodiments of the invention, a bacteriophage and/or polypeptide of the invention is used in combination with other agents, including other bacteriophage (for example, that target a different species or strain of bacteria), or with antibiotics that target the same or different kinds of bacteria, including bacteria selected from any gram-positive bacteria, any gram-negative bacteria, and any other groups of bacteria that is not classified as gram-positive or gram-negative. The compositions of the invention may also be used in combination with any other means of treating bacterial infection known to one of skill in the art.

Also contemplated by the invention are methods of preventing and methods of treating an infection caused by bacteria including, but not limited to, *K. pneumoniae, A. baumannii, E. coli, P. aeruginosa*, and/or *S. aureus* comprising administering to a mammal in need thereof a composition comprising a lysin comprising or consisting of the amino acid sequence of SEQ ID NO: 20, SEQ ID NO: 80, SEQ ID NO: 192, SEQ ID NO: 282, SEQ ID NO: 547, SEQ ID NO: 556, SEQ ID NO: 557, SEQ ID NO: 598, SEQ ID NO: 1216, SEQ ID NO: 1261, or a fragment, variant, or derivative thereof, wherein the fragment, variant, or derivative exhibits antibacterial or antimicrobial activity against the species of bacteria from which the parent bacteriophage was isolated. In a specific example in accordance with this embodiment, the invention provides methods of preventing or treating an infection caused by a bacteria including, but not limited to, *K. pneumoniae, A. baumannii, E. coli, P. aeruginosa*, and/or *S. aureus*, comprising administering to a mammal in need thereof a composition comprising an isolated CHAP domain of a lysin, or a fragment, variant, or derivative thereof that exhibits at least one biologic activity of the CHAP domain from which it was isolated (e.g., lytic cell killing).

In certain embodiments, the invention provides methods of preventing and/or treating an infection caused by bacteria including, but not limited to, *K. pneumoniae, A. baumannii, E. coli, P. aeruginosa*, and/or *S. aureus*, comprising administering to a mammal in need thereof a composition comprising a tail protein comprising or consisting of the amino acid sequence of SEQ ID NO: 15, SEQ ID NO: 26, SEQ ID NO: 27, SEQ ID NO: 30, SEQ ID NOs: 32-35, SEQ ID NO: 180, SEQ ID NO: 183, SEQ ID NO: 185, SEQ ID NO: 190, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-496, SEQ ID NO: 544, SEQ ID NO: 545, SEQ ID NO: 549, SEQ ID NO: 551, SEQ ID NO: 629, or SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1217, SEQ ID NO: 1250, SEQ ID NO: 1266, or a fragment, variant, or derivative thereof, wherein the fragment, variant, or derivative exhibits a biologic activity associated with the bacteriophage from with it was derived.

In still other embodiments, the invention provides methods of preventing and/or treating an infection caused by bacteria including, but not limited to, *K. pneumoniae, A. baumannii, E. coli, P. aeruginosa*, and/or *S. aureus*, comprising administering to a mammal in need thereof a composition comprising bacteriophage having a genome comprising or consisting of the nucleic acid sequence of SEQ ID NO: 1, SEQ ID NO: 2, SEQ ID NO: 3, SEQ ID NO: 4, SEQ ID NO: 560, SEQ ID NO: 781, and/or SEQ ID NO: 1074. Combinations of the lysins (or fragments, variants, or derivatives thereof as described above) and tail proteins (or fragments, variants, or derivatives thereof as described above), optionally with one or more bacteriophage of the invention or with other treatments, such as antibiotics, are also contemplated, as well as methods of treating and/or methods of preventing a bacterial infection using one or more of the combinations herein described.

As used herein, the term "in combination" refers to the use of more than one prophylactic and/or therapeutic agent. The use of the term "in combination" does not restrict the order in which prophylactic and/or therapeutic agents are administered to a subject with a disease or disorder. A first prophylactic or therapeutic agent can be administered prior to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second prophylactic or therapeutic agent (different from the first prophylactic or therapeutic agent) to a subject with a disease or disorder.

6.4 DISINFECTANT AND ANTI-INFECTIVE USE

Bacterial pathogens most often infect at a mucous membrane site (e.g., upper and lower respiratory, intestinal, urogenital, ocular, and the like). The mucous membranes themselves are often the reservoir, sometimes the only reservoir, for many pathogenic bacteria found in the environment (e.g., pneumococci, staphylococci, and streptococci). There are very few anti-infectives that are designed to control the carrier state of pathogenic bacteria. However, studies have shown that by reducing or eliminating this reservoir in environments such as hospitals and nursing homes, the incidence of infections by these bacteria will be markedly reduced. The prevention of nosocomical infections involves routine and repeated cleaning of affected surfaces.

The bacteriophage and/or polypeptides of the present invention may be used in anti-infective compositions for controlling the growth of bacteria (e.g., Gram-positive bacteria (e.g., *S. aureus*), Gram-negative bacteria (e.g., *K. pneumoniae, A. baumannii, E. coli*, and *P. aeruginosa*), or bacteria not classified as either Gram-positive or Gram-negative), in order to prevent or reduce the incidence of nocosomial infections. In addition to use in compositions for application to mucous membranes, a bacteriophage and/or polypeptide of the present incorporation may also be incorporated into formulations such as gels, creams, ointments, or sprays for controlling or preventing colonization of bacteria on body surfaces (e.g., skin and mucus membranes) (e.g., for sterilization of surgical fields or of the hands and exposed skin of healthcare workers and/or patients) and other solid surfaces (e.g., appliances, countertops, and, in particular, hospital equipment).

6.5 USE IN NANOTECHNOLOGY

The bacteriophage and/or polypeptides of the present invention also may be used in nanotechnology, e.g., in the development of nanoscale devices. The combination of nanotechnology and molecular biology has led to a new generation of nanoscale-based devices, such as nanoscale conductors. Biological systems function based on the structure of macromolecules, mainly proteins and nucleic acids, which are structurally organized at the nanoscale. Accordingly, biological macromolecules may find use in nanoscale applications. In particular, proteins with highly organized structures can be used in the development of nanoscale devices.

In some embodiments, a polypeptide of the invention comprising or consisting of a tail protein (e.g., tail component, tail fiber protein, adsorption associated tail protein, tail length tape measure protein, baseplate wedge subunit), or fragment, variant, or derivative thereof, isolated from a bacteriophage having a genome comprising or consisting of SEQ ID NO: 1, SEQ ID NO: 2, SEQ ID NO: 3, SEQ ID NO:4, SEQ ID NO: 560, SEQ ID NO: 781, or SEQ ID NO: 1074 (e.g., bacteriophage F391/08, F394/08, F488/08, F510/08, F44/10, F387/08, or F125/10, respectively), may be used in nanotechnological applications. For example, tail proteins from tail fibers of the phage may have highly organized structures and may find use in nanoscale conductors. Such conductors may be used, e.g., to deposit gold and/or other ions.

In specific embodiments, the polypeptide of the invention used in nanotechonology is an isolated tail protein comprising or consisting of the amino acid sequence SEQ ID NO: 15, SEQ ID NO: 26, SEQ ID NO: 27, SEQ ID NO: 30, SEQ ID NOs: 32-35, SEQ ID NO: 180, SEQ ID NO: 183, SEQ ID NO: 185, SEQ ID NO: 190, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-496, SEQ ID NO: 544, SEQ ID NO: 545, SEQ ID NO: 549, SEQ ID NO: 551, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1217, SEQ ID NO: 1250, or SEQ ID NO: 1266. In other embodiments, the polypeptide of the invention comprises a fragment, variant or derivative of SEQ ID NO: 15, SEQ ID NO: 26, SEQ ID NO: 27, SEQ ID NO: 30, SEQ ID NOs: 32-35, SEQ ID NO: 180, SEQ ID NO: 183, SEQ ID NO: 185, SEQ ID NO: 190, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-496, SEQ ID NO: 544, SEQ ID NO: 545, SEQ ID NO: 549, SEQ ID NO: 551, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1217, SEQ ID NO: 1250, or SEQ ID NO: 1266, wherein said fragment, variant or derivative possesses a highly-organized structure. Such polypeptides find use, e.g., in nanoscale conductors, as described above.

6.6 DIAGNOSTIC METHODS

The present invention also encompasses diagnostic methods for determining the causative agent in a bacterial infection. In certain embodiments, the diagnosis of the causative agent in a presentation of bacterial infection is performed by (i) culturing tissue, blood, or fluid samples of a patient according to standard techniques; (ii) contacting the culture with one or more bacteriophage and/or polypeptides of the invention; and (iii) monitoring cell growth and/or evidence of lysis after said contacting. Because the activity of bacteriophage and/or their isolated products (e.g., polypeptides, or biologically active fragments, variants, or derivatives thereof) tends to be species or strain specific, susceptibility, or lack of susceptibility, to one or more bacteriophage and/or polypeptides of the invention may be indicative of the species or strain of infective bacteria. For example, decreased growth of test cultures after contacting with a bacteriophage having a genome comprising or consisting of the nucleic acid sequence SEQ ID NO: 1 or 781, or with an isolated polypeptide thereof or derived therefrom, may be indicative of the test sample comprising *K. pneumoniae*. Similarly, a bacteriophage having a genome comprising or consisting of the nucleic acid sequence SEQ ID NO: 2, or an isolated polypeptide product thereof or derived therefrom, may be used to identify infection by *A. baumannii*; a bacteriophage having a genome comprising or consisting of the nucleic acid sequence SEQ ID NO: 3, or an isolated polypeptide product thereof or derived therefrom, may be used to identify infection by *E. coli*; while that having a genome comprising or consisting of the nucleic acid sequence SEQ ID NO: 4, or an isolated polypeptide product thereof or derived therefrom, may be used to identify infection by *P. aeruginosa*; and that having a genome comprising or consisting of the nucleic acid sequence SEQ ID NO: 560 or 1074, or an isolated polypeptide product thereof or derived therefrom, may be used to identify infection by *S. aureus*.

Additionally, in some embodiments, bacteriophage and/or polypeptides of the present invention may be used in biosensors in the scope of diagnostics. As used herein, "biosensor" refers an analytical device for the detection of an analyte that combines a biological component with a physicochemical detector component. In particular, proteins involved in the recognition of bacterial receptors can be used in the development of diagnostic biosensors.

In some embodiments, a polypeptide of the invention comprising or consisting of a tail protein (e.g., tail component, tail fiber protein, adsorption associated tail protein, tail length tape measure protein, baseplate wedge subunit), or fragment, variant, or derivative thereof, isolated from a bacteriophage having a genome comprising or consisting of SEQ ID NO: 1, SEQ ID NO: 2, SEQ ID NO: 3, SEQ ID NO:4, SEQ ID NO: 560, SEQ ID NO: 781, SEQ ID NO: 1074 (e.g., bacteriophage F391/08, F394/08, F488/08, F510/08, F44/10, F387/08, or F125/10 respectively), may be used in biosensor applications. For example, a phage tail protein may specifically recognize one or more bacterial species and/or strains, and thus may find use in biosensor diagnostics. The detection of a certain bacterial species and/or strain, by one or more bacteriophage and/or polypeptides of the invention, can indicate the species or strain of infective bacteria.

In specific embodiments, the polypeptide of the invention used in biosensor applications is an isolated tail protein comprising or consisting of the amino acid sequence SEQ ID NO:

15, SEQ ID NO: 26, SEQ ID NO: 27, SEQ ID NO: 30, SEQ ID NOs: 32-35, SEQ ID NO: 180, SEQ ID NO: 183, SEQ ID NO: 185, SEQ ID NO: 190, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-496, SEQ ID NO: 544, SEQ ID NO: 545, SEQ ID NO: 549, SEQ ID NO: 551, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1217, SEQ ID NO: 1250, or SEQ ID NO: 1266. In other embodiments, the polypeptide of the invention comprises a fragment, variant or derivative of SEQ ID NO: 15, SEQ ID NO: 26, SEQ ID NO: 27, SEQ ID NO: 30, SEQ ID NOs: 32-35, SEQ ID NO: 180, SEQ ID NO: 183, SEQ ID NO: 185, SEQ ID NO: 190, SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-496, SEQ ID NO: 544, SEQ ID NO: 545, SEQ ID NO: 549, SEQ ID NO: 551, SEQ ID NO: 629, SEQ ID NO: 686, SEQ ID NO: 789, SEQ ID NOs: 796-800, SEQ ID NO: 806, SEQ ID NO: 854, SEQ ID NOs: 999-1004, SEQ ID NOs: 1053-1060, SEQ ID NO: 1077, SEQ ID NO: 1217, SEQ ID NO: 1250, or SEQ ID NO: 1266, wherein said fragment, variant or derivative is capable of specifically recognizing a bacteria, e.g., a specific species and/or one or more specific strains of the bacteria. Such polypeptides find use, e.g., in biosensors for detecting specific bacteria and/or diagnosing certain infections, as described above.

Generally, the phage tail protein for use in a biosensor will detect its host bacteria, or one or more specific species and/or specific strains of the host bacteria. Accordingly, in certain embodiments, the invention encompasses a tail protein corresponding to the amino acid sequence of SEQ ID NO: 15, SEQ ID NO: 26, SEQ ID NO: 27, SEQ ID NO: 30, or SEQ ID NOs: 32-35, or a variant, fragment or derivative thereof, which recognizes and can detect one or more strains of *K. pneumoniae*. Such detection may be indicative of a *K. pneumoniae* infection. In certain embodiments, the invention encompasses a tail protein corresponding to the amino acid sequence of SEQ ID NO: 180, SEQ ID NO: 183, SEQ ID NO: 185, or SEQ ID NO: 190, or a variant, fragment or derivative thereof, which recognizes and can detect one or more strains of *A. baumannii*. Such detection may be indicative of an *A. baumannii* infection. In certain embodiments, the invention encompasses a tail protein corresponding to the amino acid sequence of SEQ ID NO: 231, SEQ ID NO: 232, SEQ ID NO:235, SEQ ID NOs: 239-245, SEQ ID NO: 248, SEQ ID NO: 249, SEQ ID NO: 252, SEQ ID NO: 254, SEQ ID NOs: 433-437, SEQ ID NOs: 489-495, or SEQ ID NO: 496, or a variant, fragment or derivative thereof, which recognizes and can detect one or more strains of *E. coli*. Such detection may be indicative of an *E. coli* infection In certain embodiments, the invention encompasses a tail protein corresponding to the amino acid sequence of SEQ ID NO: 544, SEQ ID NO: 545, SEQ ID NO: 549, or SEQ ID NO: 551, or a variant, fragment or derivative thereof, which recognizes and can detect one or more strains of *P. aeruginosa*. Such detection may be indicative of a *P. aeruginosa* infection. In certain embodiments, the invention encompasses a tail protein corresponding to the amino acid sequence of SEQ ID NO: 629, SEQ ID NO: 686, SEQ ID NO: 1077, SEQ ID NO: 1217, SEQ ID NO: 1250, or SEQ ID NO: 1266, or a variant, fragment or derivative thereof, which recognizes and can detect one or more strains of *S. aureus*. Such detection may be indicative of an *S. aureus* infection. In certain embodiments, the invention encompasses a tail protein corresponding to the amino acid sequence of SEQ ID NO: 789, SEQ ID NOs: 796-800, SEQ ID NO: 806, SEQ ID NO: 854, SEQ ID NOs: 999-1004, or SEQ ID NOs: 1053-1060, or a variant, fragment or derivative thereof, which recognizes and can detect one or more strains of *K. pneumoniae*. Such detection may be indicative of a *K. pneumoniae* infection.

In some embodiments, the invention encompasses the use of more than one tail protein, e.g., a combination of two of more of the tail proteins provided above, in a biosensor for detecting more than one bacterial species and/or strains. The biosensor also may comprise additional proteins and/or other agents for detecting the same or different bacteria.

6.7 AMINO ACID VARIANTS

Amino acid sequence variants of the polypeptides of the invention can be created. In some embodiments, they may be substitutional, insertional and/or deletion variants. Deletion variants lack one or more residues of the native protein which typically are not essential for function (e.g., antimicrobial or antibacterial activity). Insertional mutants typically involve the addition of material at a non-terminal point in the polypeptide. Substitutional variants typically involve the exchange of one amino acid for another at one or more sites within the polypeptide, and may be designed to modulate one or more properties of the polypeptide, such as stability against proteolytic cleavage, preferably without the loss (or substantial loss) of other functions or properties. Substitutions of this kind preferably are conservative, that is, one amino acid is replaced with one of similar shape and charge. Conservative substitutions are well known in the art and include, for example, the changes of: alanine to serine; arginine to lysine; asparagine to glutamine or histidine; aspartate to glutamate; cysteine to serine; glutamine to asparagine; glutamate to aspartate; glycine to proline; histidine to asparagine or glutamine; isoleucine to leucine or valine; leucine to valine or isoleucine; lysine to arginine; methionine to leucine or isoleucine; phenylalanine to tyrosine, leucine or methionine; serine to threonine; threonine to serine; tryptophan to tyrosine; tyrosine to tryptophan or phenylalanine; and valine to isoleucine or leucine.

Once general areas of the gene are identified as encoding a particular antibacterial activity, e.g., as a lysin as described herein, point mutagenesis may be employed to identify with greater particularity which amino acid residues are important in the antibacterial activity. Thus, one of skill in the art will be able to generate, for example, single base changes in the DNA strand to result in an altered codon and/or a missense mutation that preserves desired function.

Preferably, mutation of the amino acids of a protein creates an equivalent, or even an improved, second-generation molecule. For example, certain amino acids may be substituted for other amino acids in a protein structure without detectable or substantial loss of function (e.g., antibacterial or antimicrobial activity). In making such changes, the hydropathic index of amino acids may be considered. The importance of the hydropathic amino acid index in conferring interactive biological function on a protein is generally understood in the art. It is accepted that the relative hydropathic character of the amino acid contributes to the secondary structure of the resultant protein, which in turn defines the interaction of the protein with other molecules, for example, interaction with a peptidoglycan within the outer coat of a gram-positive bacteria. Each amino acid has been assigned a hydropathic index on the basis of their hydrophobicity and charge characteristics; for example: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan 0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5). It is also understood in the art that the substitution of like amino acids can be made effectively on the basis of hydrophilicity. Like hydrophobicity, values of hydrophilicity have been assigned to each amino acid: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). Equivalent molecules may be obtained by substitution of one amino acid for another where their hydropathic and/or their hydrophilicity indices are within ±2, preferably ±1, or most preferably ±5 of each other.

In certain embodiments, the invention encompasses isolated peptides that comprise 1, 2, 3, 4, 5, 6, 7, 8, 9, or 10 or more amino acid modifications (e.g., insertion, substitution, deletion, etc.) relative to an amino acid sequence disclosed herein. In preferred embodiments, the mutation(s) are made such that biological activity of the particular polypeptide is retained or substantially retained. For example, the present invention encompasses polypeptides isolated from bacteriophage F387/08, F391/08, F394/08, F488/08, F510/068, F44/10, and/or F125/10, which are mutated to comprise 1, 2, 3, 4, 5, 6, 7, 8, 9, or 10 or more amino acid modifications relative to an amino acid sequence listed herein, and which exhibit antibacterial activity against one or more species or strains of Gram-positive or Gram-negative bacterium, e.g., against *K. pneumoniae, A. baumannii, E. coli, P. aeruginosa*, and/or *S. aureus*. In specific embodiments, the polypeptides of the invention derived from F387/08 or F391/08 exhibit antibacterial or antimicrobial activity, e.g., lytic killing activity, against at least *K. pneumoniae*; those derived from F394/08 against at least *A. baumannii*; those derived from F488/08 against at least *E. coli*; those derived from F510/08 against at least. *P. aeruginosa*, and those derived from F44/10 or F125/10 against at least. *S. aureus*.

6.8 POLYNUCLEOTIDES ENCODING POLYPEPTIDES OF THE INVENTION

The invention provides polynucleotides comprising a nucleotide sequence encoding a polypeptide of the invention. The invention also encompasses polynucleotides that hybridize under high stringency, intermediate, or lower stringency hybridization conditions, e.g., as defined supra, to polynucleotides that encode a polypeptide of the invention and that encode modified polypeptides that have antibiotic and/or other biological activity.

The polynucleotides may be obtained, and the nucleotide sequence of the polynucleotides determined, by any method known in the art. For example, a polynucleotide encoding a polypeptide of the invention may be generated from nucleic acid from a suitable source (e.g., bacteriophage F387/08, F391/08, F394/08, F488/08, F510/08, F44/10, and/or F125/10). Nucleotide sequences may be isolated from phage genomes by routine methods known in the art (see, e.g., Carlson, "Working with bacteriophage: common techniques and methodological approaches," In, Kutter and Sulakvelidze (Eds) Bacteriophage: Biology and Applications, 5$^{th}$ ed. CRC Press (2005); incorporated herein by reference in its entirety). If a source containing a nucleic acid encoding a particular polypeptide is not available, but the amino acid sequence of the polypeptide of the invention is known, a nucleic acid encoding the polypeptide may be chemically synthesized and cloned into replicable cloning vectors using any method well known in the art.

Once the nucleotide sequence of the polypeptide of the invention is determined, the nucleotide sequence of the polypeptide may be manipulated using methods well known in the art for the manipulation of nucleotide sequences, e.g., recombinant DNA techniques, site directed mutagenesis, PCR, etc. (see, for example, the techniques described in Sambrook et al., 1990, Molecular Cloning, A Laboratory Manual, 2d Ed., Cold Spring Harbor Laboratory, Cold Spring Harbor, N.Y. and Ausubel et al., eds., 1998, Current Protocols in Molecular Biology, John Wiley & Sons, NY, which are both incorporated by reference herein in their entireties), to generate polypeptides having a different amino acid sequence, for example to create amino acid substitutions, deletions, and/or insertions.

In some embodiments, a nucleotide sequence encoding one or more ORFs of FIGS. 2, 4, 6, 8, 10, 12, and 14 are provided. In some embodiments, a nucleotide sequence encoding a variant, fragment or derivative of one or more ORFs of FIGS. 2, 4, 6, 8, 10, 12, and 14 are provided, where the variant, fragment or derivative exhibits antibacterial or antimicrobial activity (e.g., lytic killing activity) against one or more strains of *K. pneumoniae*, for example, against the bacteriophage having a genome comprising or consisting of the nucleic acid sequence SEQ ID NO: 1 or SEQ ID NO: 781; and/or one against or more strains of *A. baumannii*, for example, against the bacteriophage having a genome comprising or consisting of the nucleic acid sequence SEQ ID NO: 2; and/or against one or more strains of *E. coli*, for example, against the bacteriophage having a genome comprising or consisting of the nucleic acid sequence SEQ ID NO: 3; against one or more strains of *P. aeruginosa*, for example, against the bacteriophage having a genome comprising or consisting of the nucleic acid sequence SEQ ID NO: 4; and/or against one or more strains of *S. aureus*, for example, against the bacteriophage having a genome comprising or consisting of the nucleic acid sequence SEQ ID NO: 560 or SEQ ID NO: 1074.

6.9 RECOMBINANT EXPRESSION OF MOLECULES OF THE INVENTION

Once a nucleic acid sequence encoding a molecule of the invention (e.g., a polypeptide) has been obtained, the vector for the production of the molecules may be produced by recombinant DNA technology using techniques well known in the art. Methods which are well known to those skilled in the art can be used to construct expression vectors containing the coding sequences for the molecules of the invention and appropriate transcriptional and translational control signals. These methods include, for example, in vitro recombinant DNA techniques, synthetic techniques, and in vivo genetic recombination. (See, for example, the techniques described in Sambrook et al., 1990, Molecular Cloning, A Laboratory Manual, 2d Ed., Cold Spring Harbor Laboratory, Cold Spring Harbor, N.Y. and Ausubel et al. eds., 1998, Current Protocols in Molecular Biology, John Wiley & Sons, NY).

The present invention provides expression vectors encoding the polypeptides of the invention. An expression vector comprising the nucleotide sequence of a molecule identified by the methods of the invention can be transferred to a host cell by conventional techniques (e.g., electroporation, liposomal transfection, and calcium phosphate precipitation) and the transfected cells are then cultured by conventional techniques to produce the molecules of the invention. In preferred embodiments, the host cell is other than the species of the parent bacteria from which the bacteriophage comprising the sequence was derived. In specific embodiments, the expression of the molecules of the invention is regulated by a constitutive, an inducible or a tissue, specific promoter. In specific embodiments the expression vector is pQE-30 (Qiagen) or pET-29(a) (Novagen).

The host cells used to express the molecules identified by the methods of the invention may be either bacterial cells (preferably non susceptible to the bacteriophage protein or variant, derivative, or fragment thereof of the invention). A variety of host-expression vector systems may be utilized to express the molecules identified by the methods of the invention. Such host-expression systems represent vehicles by which the coding sequences of the molecules of the invention may be produced and subsequently purified, but also represent cells which may, when transformed or transfected with the appropriate nucleotide coding sequences, express the molecules of the invention in situ. These include, but are not limited to, microorganisms such as bacteria that are not susceptible to the bacteriophage protein or variant, derivative, or fragment thereof of the invention (e.g., *B. subtilis*) transformed with recombinant bacteriophage DNA, plasmid DNA, or cosmid DNA expression vectors containing coding sequences for the molecules identified by the methods of the invention; yeast (e.g., *Saccharomyces Pichia*) transformed with recombinant yeast expression vectors containing sequences encoding the molecules identified by the methods of the invention; insect cell systems infected with recombinant virus expression vectors (e.g., baculovirus) containing the sequences encoding the molecules identified by the methods of the invention; plant cell systems infected with recombinant virus expression vectors (e.g., cauliflower mosaic virus (CaMV) and tobacco mosaic virus (TMV) or transformed with recombinant plasmid expression vectors (e.g., Ti plasmid) containing sequences encoding the molecules identified by the methods of the invention; or mammalian cell systems (e.g., COS, CHO, BHK, 293, 293T, 3T3 cells, lymphotic cells (see U.S. Pat. No. 5,807,715), Per C.6 cells (human retinal cells developed by Crucell) harboring recombinant expression constructs containing promoters derived from the genome of mammalian cells (e.g., metallothionein promoter) or from mammalian viruses (e.g., the adenovirus late promoter; the vaccinia virus 7.5K promoter) containing sequences encoding the molecules identified by the methods of the invention.

In bacterial systems not susceptible to the bacteriophage protein or variant, derivative, or fragment thereof of the invention, a number of expression vectors may be advantageously selected depending upon the use intended for the molecule being expressed. For example, when a large quantity of such a protein is to be produced, for the generation of pharmaceutical compositions of a polypeptide, vectors which direct the expression of high levels of fusion protein products that are readily purified may be desirable. Such vectors include, but are not limited, to the *E. coli* expression vector pUR278 (Ruther et al., 1983, *EMBO J.* 2:1791), in which the protein sequence may be ligated individually into the vector in frame with the lac Z coding region so that a fusion protein is produced; pIN vectors (Inouye & Inouye, 1985, *Nucleic Acids Res.* 13:3101-3109; Van Heeke & Schuster, 1989, *J. Biol. Chem.* 24:5503-5509); and the like. pGEX vectors may also be used to express foreign polypeptides as fusion proteins with glutathione S-transferase (GST). In general, such fusion proteins are soluble and can easily be purified from lysed cells by adsorption and binding to a matrix glutathione-agarose beads followed by elution in the presence of free gluta-thione. The pGEX vectors are designed to include thrombin or factor Xa protease cleavage sites so that the cloned target gene product can be released from the GST moiety.

In an insect system, *Autographa californica* nuclear polyhedrosis virus (AcNPV) is used as a vector to express foreign genes. The virus preferably grows in *Spodoptera frugiperda* cells. The polypeptide coding sequence may be cloned individually into non-essential regions (e.g., the polyhedrin gene) of the virus and placed under control of an AcNPV promoter (e.g., the polyhedrin promoter).

Once a molecule of the invention (i.e., polypeptides) has been recombinantly expressed, it may be purified by any method known in the art for purification of polypeptides, for example, by chromatography (e.g., ion exchange, affinity, and sizing column chromatography), centrifugation, differential solubility, or by any other standard technique for the purification of polypeptides or antibodies.

Certain modifications and improvements will occur to those skilled in the art upon a reading of the foregoing description. It should be understood that all such modifications and improvements have been deleted herein for the sake of conciseness and readability but are properly within the scope of the following claims.

7. EXAMPLES

It is understood that the following examples and embodiments described herein are for illustrative purposes only and that various modifications or changes in light thereof will be suggestive to persons skilled in the art and are to be included within the spirit and purview of this application and the scope of the appended claims. All publications, patents, and patent applications cited herein are hereby incorporated by reference in their entirety for all purposes.

Unless otherwise indicated, the bacteriophage of the invention were isolated, processed and analyzed according to the following methods.

7.1.1 PURIFICATION OF PHAGE

Stock preparations of bacteriophage isolated from clinical samples were prepared according to protocols described in Carlson, "Working with bacteriophage: common techniques and methodological approaches," In, Kutter and Sulakvelidze (Eds) Bacteriophage: Biology and Applications, $5^{th}$ ed. CRC Press (2005) ("Carlson," incorporated herein by reference in its entirety).

The bacteriophage stock preparations were concentrated by precipitation with PEG according to the protocol described in Carlson and Yamamoto et al., 2004, *PNAS* 101: 6415-6420. Briefly, the stock preparation was incubated in 1 M NaCl for one hour at 4° C. with agitation. Next, PEG 8000 (AppliChem, Cheshire, Mass.) was gradually added to a final concentration of 10% (w/v). The composition was then incubated overnight at 4° C. After the incubation period, the composition was centrifuged at 10000×g for 30 minutes at 4° C. The sediment was then re-suspended in SM buffer (0.05 M Tris-HCL at pH 7.4, 0.1 M NaCl, 10 mM $MgSO_4$) with gelatin at 1% w/v and centrifuged again at 1000 rpm at 4° C. for 10 minutes. The supernatant containing the suspended phage was saved for further purification. The supernatant was purified using a CsCl gradient according to the methods in Carlson.

CsCl was removed from the purified and concentrated phage stock by dialysis. A dialysis membrane, Cellu.Sep H1 High Grade Regenerated Cellulose Tubular Membrane (Cellu.Sep, River Street, USA), was prepared according to the manufacturers' instructions. The dialysis involved a first incubation of 30 minutes in 100 mM Tris-HCl and 3 M NaCl (pH 7.4) at 4° C. This was followed by a second incubation of 30 minutes in 100 mM Tris-HCl and 0.3 M NaCl (pH 7.4) at 4° C. After dialysis, the suspended phage was removed from the interior of the dialysis bag and stored at 4° C.

7.1.2 EXTRACTION OF PHAGE DNA

To 5 ml of the purified and concentrated bacteriophage samples was added 20 mM EDTA at pH 8.0, SDS at 0.5% (p/v) and Proteinase K at a final concentration of 40 µg/ml. The mixture was incubated at 56° C. for one hour. Successive extractions in phenol:chloroform:alcohol at a proportions of 25:24:1 were performed until the interface between the aqueous and organic phases was clear. The aqueous phase was then treated with an equal volume of chloroform and centrifuged at 13,0000×g for 10 minutes at 4° C. The aqueous phase was once again removed, and the DNA was precipitated by adding two volumes of absolute ethanol and incubating for thirty minutes at 20° C. The samples were then centrifuged at 11,000×g for 30 minutes at 4° C. The pellet was washed with 70% ethanol at room temperature and resuspended in 50 µl of ultra-pure water (Gibco, California). DNA concentration was determined by measuring the absorbance at 260 nm in a ND-1000 Spectrophotometer. Integrity of the isolated phage DNA was analyzed by electrophoresis on a 1% agarose gel.

7.1.3 ANALYSIS OF PHAGE GENOMES

Sequencing of the bacteriophage genome allowed identification of potential open reading frames (ORFs) within the genome. The putative ORFs of the bacteriophage were used to search the NCBI nucleotide collection database for homologous DNA sequences using the BLASTN program (see, e.g., Zhang et al., 2000, *J. Comput. Biol.* 7:203-214).

7.2 EXAMPLE 1

Bacteriophage F391/08

Comparison of the putative ORFs of the bacteriophage F391/08 genome with the sequences in the NCBI nucleotide database revealed that only small portions of the genome 11% genome coverage) exhibited homology with known sequences. A schematic organization of the F391/08 genome is provided in FIG. 1. F391/08 ORFs, their encoded amino acid sequences, and known homologous proteins are provided in FIG. 2. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). orfs whose products presented homology with the same protein(s) are indicated with the same number with the addition of a lowercase letter, in FIG. 2. Identification of putative transfer RNA genes (tRNA) was carried out using the tRNAscan-SE program (Lowe, T. M. et al., 1997. Nucleic Acids Res., 25: 955-964).

Table 1 below provides the results of spot tests that assessed the host range and activity of the bacteriophage F391/08 against 100 *Klebsiella* sp. strains (86 *K. pneumoniae* strains; 12 *K. oxytoca* strains; and 2 *Klebsiella* sp. strains) isolated from clinical samples. Each spot contained 5 µl of bacteriophage suspension with the indicated titers, prepared from a CsCl purified lysate. Sensitivity of each strain to, the phage was evaluated based on a relative scale ranging from turbid (+) to clear (++++) lysis halos. Spots originating from isolated phage plaques are indicated as (pfu) and resistance to phage infection is indicated as (−). The percentage of strains displaying a particular sensitivity phenotype is indicated also.

TABLE 1

| Phage | Titer (pfu/ml) | Phage sensitivity (%) of *Klebsiella* sp. strains (n = 100) | | | | | | Total of infected strains (%) |
|---|---|---|---|---|---|---|---|---|
| | | ++++ | +++ | ++ | + | pfu | − | |
| F391/08 | $2.72 \times 10^{10}$ | 3 | 26 | 8 | 11 | 0 | 52 | 48 |
| | $2.72 \times 10^{8}$ | 1 | 5 | 6 | 1 | 0 | 87 | 13 |
| | $2.72 \times 10^{6}$ | 0 | 1 | 3 | 1 | 1 | 94 | 6 |
| | $2.72 \times 10^{4}$ | 0 | 0 | 0 | 0 | 3 | 97 | 3 |

7.3 EXAMPLE 2

Bacteriophage F394/08

Comparison of the putative ORFs of the bacteriophage F394/08 genome with the sequences in the NCBI nucleotide database revealed no significant homologies with known sequence, other than that observed for small portions of the genome (≤1% genome coverage). A schematic organization of the F394/08 genome is provided in FIG. 3. F394/08 ORFs, their encoded amino acid sequences, and known homologous proteins are provided in FIG. 4. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). orfs whose products presented homology with the same protein(s) are indicated with the same number with the addition of a lowercase letter, in FIG. 4. Identification of putative transfer RNA genes (tRNA) was carried out using the tRNAscan-SE program (Lowe, T. M. et al., 1997. Nucleic Acids Res., 25: 955-964).

Table 2 below provides the results of spot tests that assessed the host range and activity of the bacteriophage F394/08 against 100 *Acinetobacter* sp. strains (93 *A. baumannii* strains; 6 *A. calcoaceticus* strains; and 1 *A. lwoffi* strain) isolated from clinical samples. Each spot contained 5 µl of bacteriophage suspension with the indicated titers, prepared from a CsCl purified lysate. Sensitivity of each strain to the phage was evaluated based on a relative scale ranging from turbid (+) to clear (++++) lysis halos. Spots originating from isolated phage plaques are indicated as (pfu) and resistance to phage infection is indicated as (−). The percentage of strains displaying a particular sensitivity phenotype is indicated also.

TABLE 2

| Phage | Titer (pfu/ml) | Phage sensitivity (%) of Acinetobacter sp. strains (n = 100) | | | | | | Total of infected strains (%) |
|---|---|---|---|---|---|---|---|---|
| | | ++++ | +++ | ++ | + | pfu | − | |
| F394/08 | 2.2 × 10⁹ | 67 | 3 | 1 | 0 | 0 | 29 | 71 |
| | 2.2 × 10⁸ | 66 | 1 | 2 | 1 | 0 | 30 | 70 |
| | 2.2 × 10⁶ | 9 | 38 | 8 | 0 | 0 | 45 | 55 |
| | 2.2 × 10⁴ | 0 | 7 | 1 | 0 | 32 | 60 | 40 |

7.4 EXAMPLE 3

Bacteriophage F488/08

Comparison of the putative ORFs of the bacteriophage F488/08 genome with the sequences in the NCBI nucleotide database revealed that approximately 94% of phage F488/08 DNA is highly similar to that of Enterobaceria phage RB14, with individual ORF identities ranging from 70 to 100%. A schematic organization of the F488/08 genome is provided in FIG. 5. F4884/08 ORFs, their encoded amino acid sequences, and known homologous proteins are provided in FIG. 6. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). orfs whose products presented homology with the same protein(s) are indicated with the same number with the addition of a lowercase letter, in FIG. 4. Identification of putative transfer RNA genes (tRNA) was carried out using the tRNAscan-SE program (Lowe, T. M. et al., 1997. Nucleic Acids Res., 25: 955-964).

Table 3 below provides the results of spot tests that assessed the host range and activity of the bacteriophage F488/08 against 100 *Escherichia coli* (ECO) strains isolated from clinical samples. Each spot contained 5 µl of bacteriophage suspension with the indicated titers, prepared from a lysate purified by ion exchange chromatography. Sensitivity of each strain to the phage was evaluated based on a relative scale ranging from turbid (+) to clear (++++) lysis halos. Spots originating from isolated phage plaques are indicated as (pfu) and resistance to phage infection is indicated as (−). The percentage of strains displaying a particular sensitivity phenotype is indicated also.

TABLE 3

| Phage | Titer (pfu/ml) | Phage sensitivity (%) of ECO strains (n = 100) | | | | | | Total of infected strains (%) |
|---|---|---|---|---|---|---|---|---|
| | | ++++ | +++ | ++ | + | pfu | − | |
| F488/08 | 1 × 10¹⁰ | 0 | 60 | 1 | 2 | 0 | 37 | 63 |
| | 1 × 10⁸ | 0 | 42 | 15 | 0 | 0 | 43 | 57 |
| | 1 × 10⁶ | 0 | 8 | 10 | 7 | 0 | 75 | 25 |
| | 1 × 10⁴ | 0 | 0 | 0 | 0 | 10 | 90 | 10 |

7.5 EXAMPLE 4

Bacteriophage F510/08

Comparison of the putative ORFs of the bacteriophage F510/08 genome with the sequences in the NCBI nucleotide database revealed that approximately 95% of phage F510/08 DNA is highly similar to that of *Pseudomonas* phage LUZ19, with individual ORF identities ranging from 89 to 97%. A schematic organization of the F510/08 genome is provided in FIG. 7. F510/08 ORFs, their encoded amino acid sequences, and known homologous proteins are provided in FIG. 8. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). orfs whose products presented homology with the same protein(s) are indicated with the same number with the addition of a lowercase letter, in FIG. 8. Identification of putative transfer RNA genes (tRNA) was carried out using the tRNAscan-SE program (Lowe, T. M. et al., 1997. Nucleic Acids Res., 25: 955-964).

Table 4 below provides the results of spot tests that assessed the host range and activity of the bacteriophage F510/08 against 100 *Pseudomonas aeruginosa* (PSA) strains isolated from clinical samples. Each spot contained 5 µl of bacteriophage suspension with the indicated titers, prepared from a CsCl purified lysate. Sensitivity of each strain to the phage was evaluated based on a relative scale ranging from turbid (+) to clear (++++) lysis halos. Spots originating from isolated phage plaques are indicated as (pfu) and resistance to phage infection is indicated as (−). The percentage of strains displaying a particular sensitivity phenotype is indicated also.

TABLE 4

| Phage | Titer (pfu/ml) | Phage sensitivity (%) of PSA strains (n = 100) | | | | | | Total of infected strains (%) |
|---|---|---|---|---|---|---|---|---|
| | | ++++ | +++ | ++ | + | pfu | − | |
| F510/08 | 5.7 × 10¹⁰ | 35 | 18 | 4 | 10 | 3 | 30 | 70 |
| | 5.7 × 10⁸ | 18 | 25 | 6 | 9 | 4 | 38 | 62 |
| | 5.7 × 10⁶ | 13 | 14 | 4 | 2 | 4 | 63 | 37 |
| | 5.7 × 10⁴ | 10 | 12 | 0 | 1 | 10 | 67 | 33 |

7.6 EXAMPLE 5

Bacteriophage F44/10

Comparison of the putative ORFs of the bacteriophage F44/10 genome with the sequences in the NCBI nucleotide database revealed that approximately 81% of phage F44/10 DNA is highly similar to that of *Staphylococcus* phage K, with individual ORF identities ranging from 80 to 99%. A schematic organization of the F44/10 genome is provided in FIG. 9. F44/10 ORFs, their encoded amino acid sequences, and known homologous proteins are provided in FIG. 10. Prediction of orfs was performed by integrating the results obtained with GeneMark.hmm and MetaGeneAnnotator programs (Besemer, J. and Borodovsky, M. 1999. *Nucleic Acids Res.,* 27: 3911-3920; Noguchi, H. et al., 2008. *DNA Res.,* 15: 387-396). Protein homology searches were carried out with BLASTP program (Alschul, S. F. et al., 1997. *Nucleic Acids Res.,* 25: 3389-33402) using the NCBI non-redundant protein sequences database. Protein conserved domains were predicted using NCBI specialized BLAST (Marchler-Bauer, A. et al., 2007. *Nucleic Acids Res.* 35: 237-240). orfs whose products presented homology with the same protein(s) are indicated with the same number with the addition of a lowercase letter, in FIG. 10. As previously reported for *Staphylococcus* phage K, the putative polymerase gene (orf114a, orf114b) may contain an intron-like sequence. (O'Flaherty et al., 2004). Identification of putative transfer RNA genes (tRNA) was carried out using the tRNAscan-SE program (Lowe, T. M. et al., 1997. *Nucleic Acids Res.,* 25: 955-964).

Table 5 below provides the results of spot tests that assessed the host range and activity of the bacteriophage F44/10 against 100 *Staphylococcus aureus* (STA) strains isolated from clinical samples. Each spot contained 5 µl of bacteriophage suspension with the indicated titers, prepared from a CsCl purified lysate. Sensitivity of each strain to the phage was evaluated based on a relative scale ranging from turbid (+) to clear (++++) lysis halos. Spots originating from isolated phage plaques are indicated as (pfu) and resistance to phage infection is indicated as (−). The percentage of strains displaying a particular sensitivity phenotype is indicated also.

TABLE 5

| Phage | Titer (pfu/ml) | Phage sensitivity (%) of STA strains (n = 100) | | | | | | Total of infected strains (%) |
|---|---|---|---|---|---|---|---|---|
| | | ++++ | +++ | ++ | + | pfu | − | |
| F44110 | $2.25 \times 10^{11}$ | 53 | 35 | 10 | 1 | 1 | 0 | 100 |
| | $2.25 \times 10^{10}$ | 35 | 52 | 10 | 2 | 1 | 0 | 100 |
| | $2.25 \times 10^{8}$ | 19 | 51 | 5 | 5 | 1 | 19 | 81 |
| | $2.25 \times 10^{6}$ | 5 | 22 | 0 | 0 | 34 | 39 | 61 |
| | $2.25 \times 10^{4}$ | 0 | 0 | 0 | 0 | 42 | 58 | 42 |

7.7 EXAMPLE 6

Bacteriophage F387/08

Comparison of the putative ORFs of the bacteriophage F387/08 genome with the sequences in the NCBI nucleotide database revealed no significant homologies with known sequences other than small portions of the genome (≤12% genome coverage). A schematic organization of the F387/08 genome is provided in FIG. 11. Functionally assigned orfs are indicated on the right and in FIGS. 11B-C. DNA homology searches were carried out with BLASTN program (Zhang, Z. et al., 2000. J. Comput. Biol., 7: 203-214), using the NCBI nucleotide collection database.

F387/08 ORFs, their encoded amino acid sequences, and known homologous proteins are provided in FIG. 12. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240).

Table 6 below provides the results of spot tests that assessed the host range and activity of the bacteriophage F387/08 against 100 *Klebsiella* sp. strains (86 *K. pneumoniae* strains; 12 *K. oxytoca* strains; and 2 *Klebsiella* sp. strains) isolated from clinical samples. Each spot contained 5 µl of bacteriophage suspension with the indicated titers, prepared from a CsCl purified lysate. Sensitivity of each strain to the phage was evaluated based on a relative scale ranging from turbid (+) to clear (++++) lysis halos. Spots originating from isolated phage plaques are indicated as (pfu) and resistance to phage infection is indicated as (−). The percentage of strains displaying a particular sensitivity phenotype is indicated also.

TABLE 6

| Phage | Titer (pfu/ml) | Phage sensitivity (%) of KLE strains (n = 100) | | | | | | Total of infected strains (%) |
|---|---|---|---|---|---|---|---|---|
| | | ++++ | +++ | ++ | + | pfu | − | |
| F387/08 | $1.0 \times 10^{10}$ | 1 | 38 | 20 | 9 | 0 | 32 | 68 |
| | $1.0 \times 10^{8}$ | 0 | 10 | 14 | 9 | 0 | 67 | 33 |
| | $1.0 \times 10^{6}$ | 0 | 2 | 2 | 0 | 1 | 95 | 5 |
| | $1.0 \times 10^{4}$ | 0 | 0 | 0 | 1 | 2 | 97 | 3 |

7.8 EXAMPLE 7

Bacteriophage F125/10

Comparison of the putative ORFs of the bacteriophage F125/10 genome with the sequences in the NCBI nucleotide database revealed that approximately 87% of phage F125/10 DNA is highly similar to that of *Staphylococcus* phage A5W, with individual ORF identities ranging from 77 to 99%. A schematic organization of the F125/10 genome is provided in FIG. 13. F125/10 ORFs, their encoded amino acid sequences, and known homologous proteins are provided in FIG. 14. Prediction of orfs was performed by integrating the results obtained with GeneMark.hmm and MetaGeneAnnotator programs (Besemer, J. and Borodovsky, M. 1999. *Nucleic Acids Res.,* 27: 3911-3920; Noguchi, H. et al., 2008. *DNA Res.,* 15: 387-396). Protein homology searches were carried out with BLASTP program (Alschul, S. F. et al., 1997. *Nucleic Acids Res.,* 25: 3389-33402) using the NCBI non-redundant protein sequences database. Protein conserved domains were predicted using NCBI specialized BLAST (Marchler-Bauer, A. et al., 2007. *Nucleic Acids Res.* 35: 237-240). orfs whose products presented homology with the same protein(s) are indicated with the same number with the addition of a lowercase letter, in FIG. 14. As previously reported for *Staphylococcus* phage K (O'Flaherty et al., 2004, *J. of Bacteriology* 186(9):2862-2871), and phage Twort (Landthaler et al., 2002, *Nucleic Acids Research* 30(9):1935-1943), introns interrupting genes involved in DNA metabolism were found; and the putative terminase large subunit gene (orf153a, orf153b) may contain an intron-like sequence (orf154*).

Table 7 below provides the results of spot tests that assessed the host range and activity of the bacteriophage F125/10 against 98 *Staphylococcus aureus* (STA) strains isolated from clinical samples. Each spot contained 5 µl of bacteriophage suspension with the indicated titers, prepared from a CsCl purified lysate. Sensitivity of each strain to the phage was evaluated based on a relative scale ranging from turbid (+) to clear (++++) lysis halos. Phage dilutions originating from isolated phage plaques are indicated as (pfu) and resistance to phage infection is indicated as (−). The percentage of strains displaying a particular sensitivity phenotype is indicated also.

TABLE 7

| Phage | Titer (pfu/ml) | Phage sensitivity (%) of STA strains (n = 198) | | | | | | Total of infected strains (%) |
|---|---|---|---|---|---|---|---|---|
| | | ++++ | +++ | ++ | + | pfu | − | |
| F125/10 | 8.30 × 10⁹ | 49 | 27 | 12 | 10 | 0 | 0 | 100 |
| | 8.30 × 10⁸ | 21 | 38 | 21 | 16 | 0 | 2 | 98 |
| | 8.30 × 10⁶ | 4 | 29 | 27 | 15 | 0 | 23 | 77 |
| | 8.30 × 10⁴ | 0 | 9 | 20 | 10 | 22 | 37 | 62 |

SEQUENCE LISTING (1300 sequences)

SEQ ID NO: 1 - DNA, 113073 bp, Unknown
  Description of Unknown: Bacteriophage F391/08
attatgcaaactaaacgaaatcatacactccactaattaaaggttgacaacatgaaacgctttgtaatatcatctaaaccggcggcaaaattgaacaaaatggcaagctcggaactggtcaaaatgcagcgcgatatggcgcggcgttaccgctcttatcagcgcggaggtcagcaaggcttaccgatgatttgggataacatgatgcgttatctaaaatctttacaaaataacgtttgacaatctgccgataacgctttattatagaatctcaataagcaacaccgctctttaaaaatttggaaaagtcgattctctcagtaagggtaattgagttttctgttaacactctagcagtaaaagagtgttaaccggataacccaataaactaaactggagtaagaaacatgcaaaacgttaaaaccccaatgatcggtgattccgtttttattcctttcgttactggcgacgtaagtaagccgggcgaaaatgaaaaaatcggatatatcaaaggggcggcgatgatcccgtttgataaaattaatgcggtatacgccgaaacggaaaaagcaaaaaacagcgacgcgaagatttacagcgtccgggtagattccggcgacgtggtgaaagtcattcgcaaagatgataaatggttggctgtcgcttaacagccaataagtttaaccccggcaaataatgggatgcttcccctatgttagacttccgatgtatattccatgcagcgcaagcaatgttatggtgcgcaaattaaacttatgtgctggaacttatatcatgctttgaacggcaattgtgagttaacacgaatctatagcgtgaaatagacgtaatagcgtaattattaaaggcagcgtatatatacaatgccgctttaaatagctttaaattgaaaactaaaataaagagttttcgttatatattctagctagaatatatagcggctaactttctagccttaacccttaaataaaactggagatatatcatgactgctactaaaaccgaaaaattcgcatggaacgaaacaaacgccgctaccgccgttgaaatgtacgaaaagatcattgcttccgatggtctggaggtggctaactcgcaaggtcttattgatattgcaaaggctgtaggtgctgaatcgcatgttaaagtgcgctctaaactggttagcgcaaaggtgtatcagaagtccgataagccgcgcaaagtcggcggcggctcctccctgcgtaaagctcactatgtgcgcgttctcactcagcacgccattgctgacggcctgattgatgatgccgatggtctggcaagtctggaacaaatgaagctcgaccaactggacgttatcgcccgtatggttggcgttcaggatgaagtaaaagaatcagcagaataattataatgcgcctccctagcggggcgcataattaaatattttgtcccccataactggagaaataaaaatggctttaattaaaggctccgttattaaattaacgggaaccgttgtggatgaattaatccaaacggggtatcaggataataaggttatgacgcccccaagcgttaaagtacctgaatatattgttttgtgggttaaccctgatgcggatactttcgggatggctattaaccgcgaagtctttaagccggaaatgctggaattatcttcccgcgaaatttaccttctcaattacgctttcagcgtagaagaaaaggaggttgtaaaatgatctttttccctactgaatccttaattcttatcgctggctttttcgccgccgcttgtctctatggttactataatttcatggaaataggcagcgaacaaacggatttattacgccgtgacttctggttcaagaaagcgagtatttgccgccgctggtcaataatctttattattctagcggtaactttcggaatatcagcaagcattatcccggcaatagtttagagtcgcaaattataacgccaccagcaacaaggcgttatatttggcaattctgcctatatcccattaactggagaatttagataatgatcattgcaattgagaaacaaaaagctattttaaccgctgctaacaacctcaatttttggggtaaacgcctgcgcgctaaaaagctggagatctgcgacgaattgagcaaagagcattacgggacggcgaaacactctagcgaaatttgcgattggctggatagtaacaagcctgttaaacccgctgctgaaaaacgcgcccaacgtgttgcggtggaagattcccgccccgttgccgctggtcagcttaattccagcgtcgaaagctggaaggtaattccgggccgccgttttctgctaacgtcgattcaaaataataccttccctcatgctaatttctggaaaactttacaggaggccgcgaaatatctcggcgctactctgttagtaagcaaatacgcctacaacaaaaaaggcttccaaaacgggcaaggcaacgatgaactgaaatatgatgatgctttctcagatttcatttgtgatgaaaacgtgtttttgggcaaccgcgaaaccggattcgcattcatggcggaaattaatattctgccaactgctgattttccgctgtccggctttggcgagactgcgaccgcctacggcctgaaagggctggctattggtcacgctaaaatcaccgccgaaagtgtcccggcaatgaagggcgacactgtgcgccgtatgtattcaactggcacagcgacgctgaaaaattatattcagcaaaaagcgggccaaaaggccgaagcgctgcataactatggcgctttgctggtagagatcgacgacaacggcaacttctttgctcgccaaatcgaaacgatggacgaaagcgggatgttttacgatcttaatcataaatttactgttaacggtggcgaggaggtaacgggccacgttgccgcgctgcaatatggtgacattcacgccgaaaagctggatcacgctgtcgcctttgcttcatgggggccgtgtgatgattctctagtgaacgtcctgcgccctcgttaccagattgtgcatgatgtgcatgactttacatcacgaaaccatcataaccgcgctagtggcgttttccttgcgaaacaatatgccgccggacgtgacaaggtaattgacgatcttatcgataccgggcgcgtactagaagcaatggaacgtgaattcagtcaaacggtcattgttgaatcgaaccacgatcttgcgctttctcgctggctggatgatagtaaagctaacattcaacaagacccggcgaacgcccatctttattatcgcctgaatgctgcgatttatgaagcaatcgaaaacaaggacgatacttttaacgtactagattacgccctgcgcaatgttgctggctgcgattttgctgcgatcttcttaaccacggatgaatctatgaaaattgcgggcatcgaatgcggttcccacggtcacaacggcattaacggcgctcgcggcaacccgaagggattccgcaagctcggcaagatgaacactggccatacgcatacgcccagcatttacggcggcgtttataccgctggcgtcgctggttccctcgatatgggttacaacatcggcgcgtctagctggtcacaaacgcatttgatcacctatgaaaacgggcaacgtaccttgattgactttaaagacggcgttttctttgcataacaaaaaagccggggtaattgccccggcaataaataacccataaataaataaataagctggagaaacaaatgaaacttactttcatctataacaatcgtaaatctttcaccgcgtccaacgtcgtagaaaatagccttgttatttcccgcgatagtgaagggcgcccgcatgttagctatcagaaagttaacacggtggacggcgacactgttttaaaagctctagccgctatcctcccgcgccccgctgaatttaaagaatccggcattgtgtcgcaattagtcgccgccgattctattctttatgaggctgatatctgcgagatcgtagagattgacgccgccgccgctggccttatgtttatcgtcgtaagcgaaaatgattatgatgatacctatctgctcggcgacgtgatggattattcttctagcgaatatacgccgccgctggcaattgtcccggtaatggctacccggattaaaccggctgaattagccgatgccttaactttattcttctgataattaacaaagcgagttataatatagctcgcttgattaattaccaacaaccccgaaaccggagaaatgaaaaatggcttttaataaactggcaattaaggcaattaagttatgggatttagacggaactgttattaattcctttgcccgcgtgttcccgtgtatggatgataaagggaacttagatttaaacatgtaccgggaaaaggcttgcgtacatgatgcaattatgaccgacactcttttaccgctggttgaatatatgcgggcatcgcttaacgatcccactgtattaaacattattgtcaccgctcgttatatgggtaagagtgactactatttcctacgcaaacaacgtatccgggcggggcgcggtggtaatatccagatactgtcccgcgatgtattgcaccgatatattggcgatgctgattataaagaggtgtactattcgaaagatggtatctataaaacgcattatttcgaaatgcttaaagctgaatatccgaacgctactatcactatgattgacgataatagaggcgtgttggctgctgctgctgctgctggccttcaaacgatggacgctaccgcaattaacgatattctatctattggtgtgcgccttgcgggtgagtcattcatagatgaagcgctggatgatgataatgattatcaatatctttgcgagcgtttagctcattgctgggaaggtatgaccgaagaagaaagaagcgactacggaattaagccgcaacaatttattcaatcgttagccatcgcatcataagaaagctaatagtaccctagcgaaatagttagggtactaatagttagctaggggggtaatcggactaccataccaccccccgaccctctaagcccacctccatgtgtaactttatgaaatttggagaaaaggctaaagggagtacttaggcaaacttagaacgagcagcccgaatcaaagctactactgctactgccgctgtcgcaataagaacttcccgagtcatacccgctatacgttgcaactgccgcagttgtagctatgattgctgcagtcgacccatcatcgctccgagaacttcccgagttcgatgaaggacttcccgaaactttccgagaattatccgagcctgcccgtttttgcttgcgtttcgcgacctgtggtgtcactggagggatgtagtacgggttgctcgggtcattccgaagatcgttcatgactcgttggtgttttgagatcgctacttgacgttctgcccgagtttgaaggatctcttgatgcagacttttgttacgaagatctgccgctactaccgcgttccgcaggtcatgtgcccgcacaccaaaccaaactgctgccaggaaaaagaatgttgtgaaaattaatacaatagtcatgttttacaccatacccttagtaatgtagattttgtttgctgattctagttctgccttgcattcagacaggtttaactgtgccttatgcagcaaacgggtttgattgtcataagacttctgcagcaccccgttagtgcgttctagctgtttgattgccttaccctgctttacggtaatgacgaatagtacgattgagagtaaaacaagtgctcctataactacttccatagtggtcctcctagatggttttaaaaaatctggtttacttggcggttgatttaatttataataatattatattataaaagtcacttgttagcaagtgagattttgaggtttttatgggcttttatgcaggaaggataggcgacaaaaaagtgttgtctcttacctctggcaacaataaagacgttaataaccacactaatccaggttgggatactatattccatagcgatatgcctcacgttgtagttttagaaactcacgaaagagacctctgggatggtggtgattggtatcgttgtactagaatgccagacagaattattcaggtactgtccgcagactacgacagggttgtcttaactgaagttgagtttgaggatggcaccagacgtttcatttatggtacatccctgggtgtgggcgctaaagcgtataacgcttactttagtaatactgtcggttcccaggcttctgcaggtactatggctagtatgaagactaacgtttgtgcttctgcagacttacacatggatattagtttctatttcgaagagacgccaggtactattaacgagaagctacgagacggtactgggtgtatgtacacctggggcgttaactcagaatggggagacagagggcctgggccgccggttggagctcctatacgtcctaactttgagactattattaaagctggatgggtgctctataggggggcttttagtggcaatatagccggttctgtgtctccgcccaatagaccccttactattggtgttgatgctatgcgccacccgtggatgcgtactactggtgttaacagtatatgtttgcgtggtgagactctcaaccgtaatatgtacggacatatggggcctagatatgggcagagctccaatcccgttggtggtccttatgctcataacatccagactgagtcttatcaggaggttcagtacaaagcaggttttttccgtggtccgcccaataactttatggggtgggaaaacacagataacaacaatgctggtagtggttggggtaacaatgccatttaccgtgacaataacttccgtgttcctaaacgtgttcgctggtatattactaatatgaaatacaatgggcaggggttctacgcagagaacgtatttggctcccgcaaccaggagattaaaatcagccctagagagttcattgtaaacggtataaacctaatgaacactgggtggaagttcataaaccagaacgatataaactacagcccaggtaataggcctgatatccgagttattgcaaccaacgtcgccagatttagtggcaaccctactgttggtaataatggatatgttcactttaatcagcctctaactcgaccagataatggtgctgagtttggacaaggtaacgtgagtgagatgcatgtaaccactgtaggggtttacaattttagatctgatgcacagtggtacgtaaaatctaacccgccggaaatcggaaaccagtggggtccagtatggtctgaatcaactcgacctctccgcctagtgggcggtaccggctctgctgatattggagggaacctacgtactagcggtaatgctagtcaccacctggctaccttgtggttaggggttaataactcccgaaatggggcttgcgtcgtcactctagactggaaaaatgatgagtggattgctgctgcagggattggatgttataaccctctagaagatcttacccagtggagcgaggtggatagtaggctgagaattttcggaaatcacttccagaaacgtgtgcatcaaatcatgtgtttgcccgttaacatgtgtgtgccgttccactttatacgcgggaccgtaacccagtgtggggttattcctgggaacaacgccatgcaaatgaaggctatgtgggcacctactactaccaactctgccactcagggcgattatgccattatctattggctgatagctagggctgacggtagtgttgaagtttgggttaacgttgagatgagcaatatcatgaatatgcgagtaattcttcctgaggttaggattgctgtgcaaaggcttgcctaaaggaggcaatatgagcaatgatttaattgtaccagatacaatgtctccggaaggcatgctagttatagaggcctacctggagtctggcagcgacgttgcgaaagcagcgttagctgttggcatggaggaacctaaattccgggagattatgcgtaaacctgaggtcaaagcgtaccttacggatatcttcatggaatctggcttccgtaaccgtgataaattcttcggcattctagacactgttctaactatgaaaatggaggaactggatgaaactggaatgggttcagagatggatattatggatatcctcaaactcatgcacaaaatgaagatggatgagatgaagatgcagatcgagtatgagaaggtgaagcaagctaaagctccaatacaccaaaataatactcagatcaacctggcagggggtcacgactctaattacacggaccttctgtcacgcattgtgggagcaggtaagtaatggaaatctcacgtagttatattaatacgactgacgtggtggattttggtgttgataaacgattctttaaattcccggtgtccggcttgctggccaccgaggggatcgttccaaatggcccgcagtgcgcaatcataaacgcactggaagacccacgtcaccgtttcgttacagcatgcgtatcacgtcgtgttggcaagtcgttcattgcgtatactctaggcttccttaaactcctagagccgaacgttaaggtgctcgtagtagctccgaactactccctggcaaacatcgggtgggcgcagatcaaaggtctgattaagaaatacgggcttcaaactgagcgtgagaacgccaaagataaagagattgaacttgctaacggttcgctctttaagctggcttctgctgcgcaggctgactccgcagttggtcgttcatacgactttattatctttgacgaagcagcgatctccgacgttggtggggacgcttttgatattcagctccgtcctacactagacaaacctaactctaaagctctgtttatctctactcctcgtggcggtaactggttcaagcgcttctatgaacagggattcagagaggatcttccgcaatgggtatcaatccacggtacataccgagataaccctcgcgtatctcttgcagatatcgaggaagcacgtaagactgtatctaagaactacttcaaacaggagtatgaggcggacttctccgtattcgaaggtcagatttacgacaccttcagcgtttccgagcacgtacaggatcttgcaggtatggggcacttctttgctgcggaccatgagttcgaaaccattctaggtatcgacgttggttacagagacccgacagcagtacttaccattaagtaccactatgaccaagatgtgtactacatccttgaggagtaccagcaggcagagaagactacagcacagcatgccatgtacatacaacactgcatagaccggtataacgtagaccgtatcttcgttgactccgcggctgcacagttccgacaggacttagcatacgagcatgaaatatcctctgctcctgccaaaaaatctgttctagatggcctggcatgcctagctgctctattccagcagggtaagatcattgtcgacgcctcgtgcactgcgttaattcacgcactccagaactacaagtgggacttccaagaaggggaggaaaagctctccagagagaaacctcgtcacgatgccaactctcacttatgtgacgcactgcgttacggcatctactcgatttcccgtggcaaataagagctgagttggaacggatagtagtgagtacaaattccgttccaactttataaaattcactttacaatttcgtgtgtggcagttataatatattcataccttgagagatctcatagacatcagggtgaatgagaggaatatttaattgctatacccgaagtagtattttcccaactaagaggaggaacactttggcttccaatgtaaaatataagagagatgcaatctccataatgcgtgacggaatcaaagcccagtacaaaagaggcaactgttgcgccatttgtgactcacaggaaaacctggagctacaccactactcgactgtggccttactagttaaaaactttgctaaagaattccaactggatttcactgactcagaagtcgtcctaagtaatcgggataagttctataaacattattggcatgagctagtagaggacacggtcaccttatgtgtctttcatcatcagaccttacacaaggtctatacgaaagaacctccgttgttttcagctaacaaacagaagatttgggttgagaaacaacgtgaaagatgtatgaatccagaggcacctcgtacaagcaacactggcgaaagatcaggctttgcgaagtggcttccgactgacgtcaagactgagaaatcaggattcgcaaggttcctataatggctattcgtgactggttagttactaaactaaaccgcggacaacgcataatcagggacttggaggatgttagtcaccgtactaacgtcaagccattcacgactggcaaagcctattcgtctattgagatccttaatagatccgcgaacatggtaattgacagcgccgctgagtgctcctacaccgtaggtgaacagtataaaacaataacaacctatggcacgatcaggagtaaaactcttgagacgctgcttaatgttcgccctaacccgtacatggattccagtacttttagacgcctaatagtgtctgaccttctattcgaagggtgcgcgtatatccattgggacggttcgtctctgtaccatctgcctgctgccctaatggaagtaaaagcagatgacaaaaaattcgttaacaaattcgtctttaataatatgatcgactatcgcgttgatgaaattatcttcatcaaagataatggccagaatggtggtattaactcccagattacgggtcaatctcgtgtggctaccgtaattaactcgcttactaagcgtgagaaaatgcttgagttcaaggagaaattcctggacaatggtacggttatcggtcttattctagaaacagatgaaatcctaaataaaaagctccgtgaacgtaaacaagaagagcttcagctggactataaccctagtaccggccaatcaactgtgctcattctagacggcgggatgaaggctaagccatactcccaaatctcctcctttaaagatctcgatttcgagaacgatatcgctcgttttaataaagacgtatgtatcgctctcggagtcccacaactattgatcgatgggggtaacaacgccaatattcgaccgaacattgagctgttctactacatgactattgtgcctatgctcaataaagtatgtagctctcttacgttcttcttcggttttaaagtaacgcccaatactaaagacgtagtagcactaactcctgacaaggagaaagaggctaaattcgtaactgcactggtcaacaacggtatccttaccggtaacgaaggtcgtatagagcttggttacgaggagctggctgacgagcagatgaagaaaattcgcatccctgccaacgtagctggatcagctaccggagtaagtggacaagaaggtggcgctcccaataaagacgaggaaaaacaatgattgactataaagcattaaaagcactattccctaatggtctccccgaggcacataacgtgtttgcaaccgttaaggcacatctcacttaccagattctgcgtaaggagtatgggtacgctgctactaacagtaaaacctgggatcagtttaaggaagcctacgcggaagcaactaagccagtaccggtagcttctgttagtatcacgggcgctcctgcatccttagactatactaagactgtacagcttgccgcaactgtcctaccaacaaacgcagataataaaactgtaacgtggaagactagtgatgctaccctagctactgtgagctcaacaggattagtaacagccctgtctaaggcaggcactgttaaaattactgccactgcaggtggtaaatctagtgaagtgtctattcaggtcaaggctcctgttgtagcagttaccggtgtcactatgtcacctaagactattacaatcgaagcaggtaagaccggcaaacttactggtaccgtagccccggctaacgcaaccaataagtctgtaacttacacttctgctgataccaccaaagctaccgtagctgcggacggtacggtaactgttcctgctaacctggctgcggatagtaccgtagttattactgttaaaacagctgacggcaataagaccgacactgcaatagtaacagttaaggttcctacagcgggtgtgtaatatctgttaactggggagcttcggctccccatttttctatgctagtgcataactattttcagtgtaaccaatttcgactacctactaattccacacaccgtgtgggattttcaaatatcttttgacattcgcgatttggtatgtaataatagtatctgaaaactgaggaacaacacgaaagtgtttggagcaaacgatgcagaatattaatcttaatgctgagattaaatctgttaaagctgtcggtgagggtgataatcctcctttaaaaatcaaagggtatgctaacacgattaccaaagaccgcgccggcgacgttattctctccgaagcgtggactaccagtaacgccctcaagaattttatgaagaacccgatcatgcttttcggccataaccatagccgcccaattggtaagatcctagacctggtaccaaccgagtccggacttatggttgagggtgaggtaagtgctgctgatctacagatttactcattaatacgtgatgaggttcttaaaacgttctcggtaggcttctatattaaagacgccgaatgggacgatatgactgaaacgttcattattaaagatctggagttactcgagatctctgtagtctcggttccctgcaaccaagactcaacttttagcctttcgaagtctgtaaaccataatgattacatggagcttcgtaagtcttttgtaaaatcttcgcaggtccagcctgttgaacaacctgaactttctaatttagagaaattcctagtagccgctggttacgctaaaggataatggagaaataataatgtcttacgatatcgcacaactgtctaaagatctgggcctgggtgacattgctgagcagcttaaaggtctaaccgcctctcagaaagctgaagaagctcgcaaatttgctgctgagcaggaagctaaagaactcaagcgtatggaagacctggttgctaaagcaactggtgaagaccgtaaaaacctggcagaagctctggagcttgtaaaaaacctggatgagaaatccaaacagtccgctgaagcgttcgttaaagcaatgaactcccagcaggaagaaatcactggtctgaaagaagaaatcaaatctctgctggccgctcgtgaaaatggtcgctctttcgtagctgatggcgttgctaaggcaatgtttggtaagcaggaagatttcgaagacgaagttgagaaactggttcttctgtcctacgtaatgcagaaagatgtattcggtactaagcgtggcgaagcccacctgaaagctgttaacggctcttcttctatcgaagtttctaccgaagcatacgaaaccatcttctccctgcgtatcctgcgtgacattcaggctaaactgattatcggtaccatgttcgaagaactgccgatgtctagcaaattgctgaccatgatggttgagccggaagctggtgaagctagctgggttgacgcctctacttacggtactcctgctactgttggtgcggaagacaaaaccaagctgtctgaaatcaccttcaagacctacaaactggctgctaaagcgtatatgaccgacgaaacagaagaagatgctatcttcactctgctgccgatcatgcgtcgtcgtctgattgaagctcacgctatcgcaatcgaaaaggcgttcctgaccggtactggtgctgcgggtactccgaaaggcctgatccagttcgctaaagacgatggtaaagtggttgctaccactgctaaagctgacggttctgttaaagttaccgctaaagaaattcacaagctgcgtcgttcgctgggccgccacggtctagacctgaacaaactggctctggttgtttcgatggatgcttactacgatctgatcgaagacgaagaattccaggacgttgcacaggttaccgctaccaccgctatcaaactgcagggtcaggttggtcgtatctacggtctgccggtactggtttctgagttcttcccagctaaggctgcaagcgctgagttctgtgtagttgtttaccgtgacaacttcatcgttcctcgtcagcgtgcaatcactgttgagaaagagcgtcaggctgaacgtcagcgcgatgcgtactacgttactcagcgtctgaacctgatgcgtttcttcgagaacggcgtagttgctggtgcttacgctgcttaatttggctatactgccgactaaaggagagcttcggctctccttttttattgggtaaaatatgcaattcatgacagattctgattggagaacatatggaggccttaaacgtcctgacttagagtcaaatatcccaatgttaatcaaagcagccaatgctctgattactcagcttctaggtattgacgacactgctaacgttgtagacgttctgcctactaaaccagcacgcaaaaagtacttcctgtcttctcccgtgcctagcacgatcactaaaattacgattaacgatcaggagatcgataagtcgcaatataagaactacccggatggtacgctcttgctgaaattctcccctccagaggggtatatggaagtagagtttactcagaccggcttcacctcgatccctgacgacctggtactagcagcctgcttcctagttgatcactgggtcaagaaggactaccgcgagtctcgtacattcggcggagaaaccgttactttcaataccactaaatctggcgtaccggaacacattcgtactataatcgaagtataccggaggctgtagtggcgttgggcgatctagctcgacagatagttaaagaacagctggacattatgagtggtggtagccactctaccaagaacaccgtgatatatagtgcggaaactatggataaccacaaagatggcaccataggcaaggtatccttccgatttaccaagccggtatcggaggatttactgaatgttcggacgtcctctattttaaaagctgtctcgtcgtcacttaatctggaaggtgacgttggtgttatcgataaccttctaaatagtatcactggtaaaaaatccaaaataggaagaaaacggtctaccggtagggtagaggttaactttggagatccttcagatgctgacaacggttacgctggtgctatttctggcgcttctgggcgtttcgtctcaaacacaaaccttagagcgttacttgaactcgtagcgaaagaatacttagtcaaggatatgaaaaaagctggggcaccccttaaatttagaacggggcgtttcgctaattccttgaagattaaagacgtgctgttaagagaagacgcaggggcaaagactcctgacctcaacatcacgtataactacatgcttaagccttactctgtgttcaaccctgccgtctctacctaccgcggactttccttacggcctttccctggtgctaggaacccgcagaagctgatcggcgaggcaatcgctaaggctgcaagagaccttatccattctagataccggataagagtaaatcagggtacataatgaattacagaacaagtattgctgatgccctagtggaacgactgaagaaggacatggatgggagtaatcccacagagttcttcactaatatgtatgggaacgtatcccgccagacttattcgtttgagcagatcaatgagttcccttacatagcagtccatgtgggtaccgaaactggaaactacctgccgtctgcacagcagtgggtttaccttgaaattcctattcttatctatgataaagaaaaggatgatattaacatgcaacttgagaaactcatagcggatgtaaaaacctctattgacactggaggaaatttacaatatactataatgaaacctgatggttcaactatcgattctgaagccactgacatgcagatcacgtcggtgtccacagacgagggtatactgtccccgtttggttttgctcaagttaacgtaacagtccggtatatgcctctgagaagagcgctggatagataagttacagctcaggagaaatttaaatgtctgtacaactattacgtaatacacgaatcttcgtgtcaaccgttactacggggttcactaaggccaacactcaggagatcctagttcaggatgatgtctcctggagccaggacagtaactccactgatattaccctaaatgaggctggccctaagccgacccgcggttcgcagcgctttaacgattcattgaacgctgctgagtggagcttctccacttatatcctaccgtatgacgatgcaggtaaacagatcctgccggactacctactgtggcacggactggcaactggagctgccgtgaatctagcaggtactactggcgtattccagaatgctactaacctggttgtcaactttaaagacaacgggtaccacgaactggccatgttgaacatctacatcctaaccgatagctcttggtctgtgatccgtaactgccaggttgggcaggctgaggttaacgtagatattgatgatatcgggcgtgtaacctggtcaggtaatggtactcgcttggagaccctagcttctcagccgttcgaccctaaaaccatagggatagacgacgctctttatgctaagattcagagttcttatatcaagaacaaactgaccattcttaagctgaagaacaacgctaccggcggaaaaacctataacatcccgatcacgggaggttctttcactatgaacaacaacgtgacgtacctgactcctaacatcatgtctcgtgttgacgttccgatcggttcattcactggttccttcgagctgactggttccttgacagcgtatatgaatgatgctgccaacggctctatccagctgtacaaagatctggtttccgacctgaaagctgtgaacgacttcgaagttgcaatcatcctgggtggagagtatgatactgctcgtccggcagctgttctggtggctaagcacgctaacctgaacatcccgtcaatcgaaactgatgacgtgctgggtgtgtctattgagttcaaggctattccgactcagatggacgcaggggatgaaggttatctgggcttctcttccaagtacaccaagacttcgatcgcgaagctgatcagctctggtgacggtaaccctgtcacaccataaggataactaatgctatactccctaatgcgggagtctagagtagtcatcgagtacgatggcagggcgtacggatttgacgccctgtctgattacactgctggaacgtcctacgaagagtttaaagcaaatcgtaggacgattcacagacgcagtaactacgcctattcgaagataactgctcagtctccttcttcaatttctctaactcttaacttctctagcaatgctctcgaaggtctatttttcgagttgatggggtttatagagatagacggaatgtatcagatgcccttgttcagtaataatattgagcctaaaatgttctccgtatatattattaacaagaacacgagcttacgtttcgataactgttttgctaccacctgcgacttttctctagataagagtgtcccggtgctaaacgttggtatcgagtcgggatactttgaggaagtaggccacccactcaacagctatacgcttgatcaaggtgaggtgctaccattttcattacctcaggtatcttcgaatgggagagtgctcccaggacttatgtcagccggtatgtcattccagcagcaatgcgaatggcgaggtgacagaagtttattcgatatcaataagatttataataatagaagggcaatcgttaacgaattgaactcatccgctttgatatcgatgtactatgcaaagagtcttcagatagactctacgcataacattaaacctgatattggcctaccggtacaaatcagaaataaatatattgtggtggatttcccttccactcgaatcacaaaacgcctagacttaaccgacgtgtacaagatcgattatgacgtaatacctactgagcaatcagatcctgtccgaatcaagctaattggagaataacaaatgagtattaacctaaaagatattgcactggataccaaacagatcaccattgcataccctggcctaccacacttcaaactgaaagttaactacgtctcccgtaagctctccaagaaaattctggaagctgcacaagagaaccagtttgttaatggtatcgctgttaaagtgcaaaacgatgacaaattcgcagaagagttcgtcaaagtggctattgcaggttgggaaggtctgaccgtcgcagatgttgagaaactaatgctgatcgaagttccagaagatcgtctggaagacaaagtcgaatttagtatcgacaacgcgatgatgttggtgcgtaactccagtgccttcgagacttggatgaacagcactgtcttccacctagacacttttcgtggctcaaaatcggaacctactgcttaaggaaatagatgcctttgcagaacgatgtgtcaaaggaggggactccaaaattacacgggagcagtatctgacgatgtgcgaatccctcggggaggaacctaaccccgaggtacttaaacgtttcgtagagatccatgacttccctgaaatcgcacagaccgctctaacaatatataacaacttatcggataactatatccccggagattatccaacctatttaggcaaggataagagtgctttactagttttcttcgatatctacggagtcgaagacgctgatgagaagagccttatactccaaatcatcaatatattcgactcacatgccgtggcagcctctcgtaaacgcgttgaagcagctattaagaagtctaaaatgaagtcttctagtaggtagtgagttacagtttcctccaacgggcgttccacgtgaggcttggcctagggttaatgccctaggcctttttattggaaaaaatcatgacagatagactaatacgagaattacttgtagatatcaagcagcgtggtggatccaaagccgctaaacaaatcagggatgttgaagctgctttagacggggctgctcagagctcagagggtctaaatacaagcttgggcaaacttcctgggtctttcacggcgctggaacgatctgtatcacgtactgctaagtcgctggagaaattatcctcgaccaccagcattacagcattagcagcgtctatcggcatgctaagcggcaagtttacctcgttcgaggttgacttggctaaatccgtactaaaaatcaacgcaaacctaaacggggtgacttccgccgctaacaaaatggcctctggttttgacactgcagccacttcttcggttgcggacttaaaccgcgtcaataaggctcttcaggagttagatgcgcacgcctcttcagtagctaaagtgttgcagaccttgaaggcgggggccgggttagaatctattagctctagtgctgctaaggctagtacggatcttagccacctagtatctggggtggaaaagataggtaaccaattagctagaatggcggagcaagccgtgctggcaggcaggtctcttcaggggctgaaagccgactccttaggggctgccggagagcatctgagtaaggctgcgtccgggatttccgtagctgtatcttctatgggcgaagaggtgaacaagctaaacaaactacttcttgagttggcagtaaaggctgatttagcgagtaaatctatagcaaatattgcaccagggaccaaactgaatagtctgggaactgaaatccagaagattaatactagtttagccactgcagccaatacctcggtagctgagatatctaagattaaagcagcccttacgtctttagtatcctctaccgctacagctgccgcttcaatgaaaaccgtaggaaccggtagtggtctgagcaagctaatctcagagatatcagcagccacctcagcttccacttcggatatctctaaagtaacagccgctttaaaacagcttaacgtagatgctacggcagcaggaaaagcactgcaaagtattaaagcaggcgcaaatctttcttctgtacctacagttgttggaaagataggtacttcaatgacgcagttgcgtgctcagttagaaggatctgtaaccggtatcgagaaaagcctaaatgatctatctagagcttttgccactatgggaggtacgggaaacctgaatccactgggtaactccatcagaggtatgatcccgtcactcacccagctggctaaggccgctgtgcaagttaactccgctctgtcaaaaatacaggcaggcaggggcgtacttcaattacctacccaattcaaagcagtaacggcctcattaaatgccctggagactaaactggcctctacgtctcaaatactagagcgcggattctccaagggatttcaggatatggcgtctaaatcaacctcgtcatctacgagaatgattaacaacttccagaaagtggtaccggagctcaacgctattgaagctgctgctatacgttctgctgctgcaatagacaagctaatagccaaacgtatacgcctcggacaagctgggggagggggtaaccctgcagcgttcaatatgggtgccttagtagcggaaatgaacaggattgtaacctccattgaagctatgggcaacaaaatgaataccaccatggctgatatggcacggagtacggacaaggtatctgacaaattaacagatctaaactcgggagttcgggatgttaatactggtttaggtgggttgaattcaacgttaacgggtacgggtagcgctgctaatagggcgtccagagcgttgggaaatacttcaggatctgctcgcggagctactaggaacttcgcagcactagctatggtgactggccctatgcctcttatctacggtgctatagcctctaacgtatacgtgcttaaagcagcgttcgatcagctaaaacttggagaccagctgaaccgcttagaacagtttggatctatcgtaggagcgaagacaggtacacctattcagtcccttgctgtggcactgcaggaagctaccggccacgcggtatcctttgaagaggcaatgcgtcaggcatctactgcggccgcgtatggtttcgacgctaaacagattagcgagtttgctctagttgcacgtagggcagcggctactcttggcgttgatatgaccgatgcactcaaccgtgtaatcaagggtgtgtccaagcaggaaattgagcttctagacgaattaggtgtaaccatccgtttaaatgatgcgtatgccgaatacgttaaaatacttaatgcggctaacactggtataacgtataacattcagggtctaacttccttccagaagcagcaggcatatgctaatgcggtagtagcagagtctaccaaacgcttcggctaccttgatgaggtactacgagcaaccccatgggagcaatttgcggctaatgcggattctgcattacgcaaggttcaacaagcagctgctaaatatctaggtccagttattgcatctataaacgcagcattctatacgtctaaggcttcggtatctgcagaggcagctactgcccagcaagagtcgattaagcaaatggacggtaaagactctaacgcagtggtcatgaaccttgaggcttctcagaaaggcttggatgatgcagtcaaagcaaaagaggaagtaaaaaataaactcgcagctcttaataaggagataatggatagagaggcgaagatggatatgtccactgcactggccacagccgccaactatagtgggttcggtaatctgcttaccctgggagcctctaaagctaacaaagaatttacacaacagactgcagatatgcgtagacaggcgtatatgttacagcaggagttagcagattctgcgggagctatccaaaaatggaaagacgccagggactccgctctatctaaggctcagaaagagaacccagaactggcggggaaacttaatatagggcagaacgttgaagcaagtaatggactatacacctttgacaacgcagcattagacggggcagttgctctacggaaggagttcaataatataaagaaaacttccggagatctgagcaacgatatccagaactttgcacaggactctaacactgcgtctcgagctactgcagcactgggtgatgcacttaaggcggttgagtcattggcgggtggatctacggaaaaagccaatcaaatgaccaaggaccttaatttgggctattccaccgtaaccgagatgaacactgcgtataaagccatgtctaactatcagaagatagtgaatgatgaggctaagtctaagctagatgttgagaaacgtatagcggaggtctacgctgccactcgtaataaggataaggcggaagaagctggtagagccctagaaatgcagcaacttagcgcgaagaaagaggcattgaaagctgtgctggcgacgaacaaggacaacaaggctattcaaaaagagttgaccctgttagagacggaagagctcaaagtgaagaaccagggcatggaagcgactaagaaggagaaattctataaggataagatagtaggcatagatcgagaaatagcactcctaaataatcgcactatgacagattctcagtataacgtggcgaaccttaaattaaatctacaagtagagaaagataggttagccttactgaagactcaggcagataaggagaaggaagccgaacagtctagacgtaacattgcctctattgaaagggaaatctggaaagagcagcttgaccgtaatgccaaaactgctgagatgcgtaaagaagaattcgagcgcaatcaaagcatgaagcctctaatgggagagtcacagaaaatgcaggagcagctagcgttctaccaagaaatgaaggaattcacgaaaggtaacgctgatgaacaggcgcgttggagcaaggaaattgctaacactactgcgcaaatggcggctctcaaagctcagcgtactgcacagatgatggatcgcgtaggacagtccttgggcgcagactatacgcctactactggcctggagggggaggataagaaattcgccgacatggaaaaccagatggcgtcatacgataccgctatcggtaagctctctcagctaaattcggaggctactgctactgctcaaagtatggggaacttagctaacgctatgatccagttctctcaaggatctctggatactacgtccatgattgcagcgggcatgcagacagttagccagatgatcagctacggtactaaccagcagatttcagcaattgatgcagctatagcggcagagcagaagcgtgacggtaaatctgagcagtctaagaacaagatcaaaaagatggaagcggagaagattaaacttcagcaggaatctgctaagaagcaaatcattatccagacagcagtagcggtaatgcaggcagcaacagctgttccgtatccgttctctattcctctgatgatcgcggctgggcttgcaggtgctctgtctctagcacaggcgtctagtgctaccggaatgaccgatatagcaggatctggtggtgaaaccgcctcttacctaaccttaggtgagcgccagaaaaacgtagacgttagcatgggcgcaaacgcaggtgaactatcttacgttcgcggcgataaaggcataggtagtgctaacggatttatccctcgtgcagaaggtggtaatacctacccaggtgtctcctataagatgggtgaacacggaacggaagttgcaactcctatggtgcctaccaaggtaactccagcggataaagtggcttctgaaacttcttctggcggtgctagaagaccggttaatctgaacatccaggcaatggacgctaagagctttatggagtacgcattggaaaaccctgcggcattccaggcagctgtagagttagccttgaatgaacaagggctgagcttaaagaacctgaattaactaaactaaagggaggacgtaattgtcctcccttctttttggaatttataaaattatcttgaaaatttttcttgatatgactataatattaacattgagaggagaaaacaaaacatgagattaccagatccctttacacatcctcagtataacggccttgggtttgataaagctacgctgatcgataatgatccagtgatcagagacgagctaccaaacggcaaggttaacgaagttaaaacagccactcagtactggggtcttaacattagttatcctgtgatgtttcccgacgagtatgctgtactttcgtcagcaattctagagtataagcgtaccagaggctatctcgacgttatactcccacattacgagtcttaccgagtaagaggggatgcgaacaactgtcgcattgccgctggacaaaaaggctccacactggttatcaccaatacgaattccttatctggagaacctaagccaggtgatttattccagttaaccacacatccaaaggtgtataagattacatcttttaaaaacgtagcaggagtatggacacttaatctataccctgatctgttgctcactaccaacggctccgagagaccacgtttcaatgggattcttttccaaactaaattaatgaacggagattcattcagcgaagagatcacagttgatggtgtatacgacggggttaacctagttctgagagaaagtctatgagacagatccttccttctgcgaaagcctaccttgccaacaatgacaagatacgattagcgtatcttgtctctatcgaactcccggggtccacgggtaataacgctgtttatgcttatatgacggactatatgagagatatcaactatggtggtatactcttccaatcagggaaaattaaaacaattagcagccacaaacaaaaccgtacgttaaccgtcggcagtttgagctttagtgttactggtacggatgccaacgaagtcattaagctcgtgcaaagtggtgtatcatttttagatcgctctatttctatatatcaggcgatcatcgacgacaatggggaaatccttccagtggacccagatactaatggccccttactcttctttaggggtaagattgtaggtggtggtatcaaagaaagtaatacagtatccggagttggtacttctgttataacctggaactgttctaatgaattctatgattttgagcgggttgctggacgcttcacagatgacgcttcccaccgaggacttgagattgtaaatggagaattactgccttctcacggtgccaaacgaccggaataccaagaagactatggattcttccacgccaacaagagcgttaacttcctagctaaatatcaagtaaaagaagaacgatacaagctagaatctaagaagaaattattcggtctctccaagagctacagccttaaaaagtattatgagactgttactaaagaagtagacctggacttcaaccttgcagccaaatttattcctgtagtatacggtactcaaaaagttcctggtatcccggttttcgcggatacagagagaaacaatccaaacgttgtgtacgtggtttacgcgttctgtgagggtgagattgaaggattcctagacttccagtttggggacgcccccatgatctgtactgatcaaactgacagtacatctcgtacatgctttggacaaaaaagggtgtcgggagatactatggcaagaatttccacagggctcccatcaacatctctctccacgcatggtcaagaatacaagtataatgacggtaacggagatatacgaatctggacattccatggcaagccagaccaaacggtagctacggtactaagagacattgctgctgctaacaatttcttccttcaaggagagaacggtaatggtccggagtactgggattctaggtacaagttattagacaccgcatacgctgtcatacgtttcactatcacggagaacagaactgatattcctgaagtatccgcagaattaagcggacgcaaagtgaaagtataccaggcagatggttctgttaaaatggataaaacgagtcagaatggtgtgtggcaaacatttgactacctaacctccaccacctttggtgcaagtatcccgatagacagaatggtgattggtgactggagaaaagaggccgatctattaaacattatagacacctcttatcaaactagttggcaacctttctggagatacgttggatgggagagctggacagccgaaaacagacaaataatgcaaatgaacacaatcctggataactccaactctgtgttcaaaaacgtgcaggagctattagaatccttccagggggcgttgaataacctatcaggtatcttccgcatcaccgtagagaaagattcaaaaactccgctagaacttaatttcctagatacttatggggacctggatctatcagatactacaggccgtaataagtacaactcagttcaggcatctctgattgatcctaccctgaactggaaaaccaactctataacgttctataattctaagtttaagaatgaagatcgtggagttgacaagaaacttcaactttcttttgctaacataaccaactactacactgctagaagcttggcagatagagagcttaagaagtctcgttactctcgctctctgagtttctctttaccttacaaattccttggtatagaacctaacgatcctgtagtattcacctacgatcgttatggctggaataagaagttcttcctagtagatgaggtggagaacacaagggatggtaagataaacgtaactcttcaggagtatggtgaggatgtatttattaactcaacgcaggtggataacagtagcgaggccgttcctgaaatatccaataacgtcctgccaccaagagactttaagtacacccctacaccaggtggaatggtaggtgatgttggcaaaaacggagagctttcatggcttcctagcttgacacctaacgtagtctattactcgatacgtaaatccgaccgcgtggatccttatattgtgcagcagactgctttcacacctaacgttagaatgttccaagatatcgtgggtgagcctgctggcctgactattttcgagatccgcgccgttgatattaatggtcgtcgtagctctccagtaacaatttctgtagatttgaactcagctaaaaaccttagtatggtggaaaacttccgagtgcttaaccttgcccctgaccctgctgaatgggtaggacctgacttagagttagggtgggacaagctgcaagaagaggggctgatttcagggattttctacacgcttgaaataagggacaacactaataaactgcttagatccgcaaagatcaccagtttatataactacagctacctgttgggctataataagctcgactacaaggccaacaactcgaatactttggggatttacagagcacttcagccaagaattcaggcggagggaccaaagggcgagaagtcggttgcatgggcatatatctaaatgatttcaaacatagcaccagctaaaatggtactgcagaatatcgtgaccggctatacgattgcgagtattcagcactcaatcttttccgattacgacgtaattggtagaactttctggctaactacgggtggggtaactacccgtagggactttaccggcgttgatacattcattgccacaattaacaatctaatcgctggcgctacctactctgcccagggtgctttctatgactcgatggttgatgcagagctgatggctgctaaagtaggtatgaacctctctagcaccattaacttcaagatgaaaactgctccgaagattaccaaagtgtcctcttttgcagaatctgttgacgtgggtgtgggtgctcctatggttgtcgtagagctttctggggaggccgaatacgttaccatcgaaatgaaacctgagggctctagcacctggactaaatactaccgtggtccaatcactgagcagatcatctttgggggtgttccagttggcagatacaatatccgggtatctggtgttgtcactatgccagatggtgttactgtggatgtttctgggtatgatacctggccgtcactgtttaacctgacctacaacttcactccaccgtctgccccaactaacctgcgtttcaaaactgcccacatccaagatggtatggagcgttttgacgttcgcctggaatgggattggactcgtggtacgggtgctaacgttcgtgaatttatcatccagtatattagtaacgatgagtttgcaaaaactggatggactaaggccaacaagctaaacgtgggtgcagctaaagctggtactatcactagcttcccttacaaaatccgccaccgcttccgtgtactatcggttgcttggggcccagatactcagtctataactaactctaacgaggttacttatattatagacgagagcaccactttcgacaatgcattcattaacgagaccggtgtagaaatgacctacgcaggtatcaagggtaaactctggaactctaacaccaaacagtgggagcagactttcttagtcgatgctgctacaggtgcagtagttcttggtacactcgatgaaaatggtaaagcgccgatttcattcgaccctgttaataagattgtaaacgtcgatggtaaagttatcactaaagacattaatgctgctaacgtaattcttactaacctgaccggtaaagataacccggcaatcttcactcagggtaagaagtacggtaataacgcaggtggtgtctggatgggtgttgacaacgttgacggtaaggccaaatttgacctcggtaataacactcagtatgtgcgctgggacggtgatactcttcgcatttctggtaacgttgtaatcggtactcctggaggcgatgtagaccttgaaaccggtatgcagggtaagcagactgtatttgcttataaacttggtacatctctgccaagtcgcccgcttgaccaagtttatccaccagctggatggtccgcattcccgcctaaccgcactgctcagaatcagaacgtgtacgttgtgcagggtactctggatcctaagaagagtcctcctgctctagtagacggtaccaactactcagctgcatcccagtggtctggtgtcccaggtactggtggtactgatggttctaacggtgattacactgttcagatttaccagatcagtgctagtaagcccacgaaaccaggcaatatcaatgaccctagcggttggagtcgtaccccaccgactggaacccctctttggatgtgttctggtagattcaatggcgatactaacgctctaactgttgagggttggtcagacccgatccgagtagacggcgagaaaggggctactggtgctactggtgctactggtcctcaaggtcctcaaggtccggcaggtggttcagtagaagtacagtggtctaaagatggtactactaactggcatgcaaactttactactggtgatatctacatgcgtcagcgtgttggtacaggtgggtggagttcagctatccgtgcagttggggaagatggtactaatggtactcctgggtctaagggtaactacattgggatgcgcttccgagtggcggctgagaaacctgccactccgactggccagaccccttcaggttggtcagatgcacctcctcagggaaaccctctatggatggttaaagctgagttcaacggtcaaaccaacgccctagtaggtacgtggtcagaaccagttcgtattgatggcgaaggtattggagtaaacctgtatccggttaagaaaacactggatcagtggaccggaatgagcaacggtactatggttaagaacccagataccctcagctttaccataaccaacacagagagcactacctcctctaccggaccgggtgcacatcctgttccgttccagggttcacaaggtcctatagttgagattccagtaaagccgaatacagcgtacatcttcacttatgaggttagtactgatagcaccagctttgttctgagagacctgttactagagttctctagcattaccggaagttttaccaacttccaagagttactgactggagccaaaggtaagcaggaagctaagattgtcactcgtgctgatactaagttcctgagcttccgtccaggtgtccgcactgccggagctacggttacttattctaatctaaaacttgaagaaggcattaaagctaccgcttacagcgtagaggcttccgacagtatcggtgagaaaggagaccaaggtactcagggtccacaagggcctcagggtaatcagggtccacagggtaatcaaggcccgcaaggtgctaagggtgataatgcaaaaggattcagcctctcttctctcggtcagacgtttacgtacgacgcagaaggtaaactgaagtccgatgcaaccatcctgttccaggctttccgtcagaatactactgcaaacgttacttggtcagccaaggacgagaaaggtgggaacatcactctgacaagtactagcaatactggtgctacactgaccgccgctaacttcaaaacatcgaagtctgtagtagttacagccgtctgtgatggtatcaccgatcagatcactattgtgcgtctagacgatggttccaacgctctcgtagggcttctgaccaacgaaggttccacagttctagcgaactatgctggttacgtgcaaaactatagtactggttctggtgacttcaaagtattctatggggcgaaggatatcacctcagaatgcaccttcagtactatggagaagaataaccttgatgctgatattacttcagcgggcaaatatactttaaaaggtatgccggctggtactgatgttatcaacggctgggtcgacttacgtgctgtacaccctacttacggtgccgtggtccgcagagtggcaactactaaatctatccttgcaaaaggttatgatcgcgttattaccacttcattcgagaacggaaataagggtacctggtcgactggtagtgtccaaggggtttctggtgccacaattgtagccgcaggtttcagcaaggccctagtgatctctgctagagactgtatagaagatgctaacgcattccctgtagtagctggtcagaaatatagactgggcatgtggataatggctagtgagtctaaagtcaatatcaacatgggaatgcgaattgtaagggcggccgacggagttgttgattggcaaggaacccttatgattgcacaaggtactgtagtacctggtggctggtcctacatcgaaaaagagtttactgttggcagttctaataccggtatagcaatgccgtggatccagatggctgggtcttctggtagtgacttaggtaaagcttacgttaccgatattcacattttcgccctagaaatggatggggagaaaggtgatactggtgcaactggtgctacaggttctcaaggtccacaaggtccacagggtaataaaggggacaaaggtgatactggtgcaactggtgctcaaggccctgctggtagctctgtaaacgtccagtggtctaaggatgggtctactaactggcatgctggtttccaacctggcgatattttcatgcgtcagcaggttaatggagtttggggcagtgctattcgtgcagttggcgaagacggtaaaaatggtgctgatggtactgacggtgactacatttcaatgaagtttatcgttcaggataccaaacctggcacacctactggtaacaacccaggtagctggagtgatgctcctccagttggtagccctttatggatgactaagggcactatgaatgctagcggtcaactacagggtacgtggtctaatccggtccgcctagacgggactatcaaccctaacctgttcgcagtacgtaagtggatggcagggatgactggtacggaagccggcacatctaagaacgatatcgagaagctagcgcataccttgactcgtacttccggaactgataatacggctccagggtgctatgcgaccccgtatctaggtagtggggcgttttcccatccagtgactccaggtaaacgctacactctaacctataatatcgacgcggctagcgaggtccagacccgagatactatattctggcaggctaatccagactcaggacaatccacctacatagaggaactgaataccgggacgtctataaaggttaagcgtacctttgtagttcctacaggtatgaactacctaaccctacgcccttctgctctgacacttaacgtagcgactacgtggagcaagattaagctggaagaaggcggagagaaaactgagtatcaagtagaatactcagacagtatcggtatagtaggtaaatcagttttagtacagtggtctaaggatagctcttctagtaactggcatgataccttccaaacaggtgacttgttcatgcgtcagaacgttgacggtgtttggggtcctgcgattcgtgctataggtgagaaaggtgagattggtcctgacggtaagaaaggtaactacaccaatatcatcttccgtatttcggatactaaaccagctaaacctactggtaacaaacctacggattggtttgatgctccacctgatggttcccctctttggatggcaacagcaacgtttaatggggatactaacgctatcattggtgcttggtctgaccctgtgcgaatcgatgcttccggcgtaggcgaaaacttcttagcgttcaaagagtggatgatgtctattcagagggctgaggggacgggctcttcagttagcaagaatccggaccagatgagattccgggtaacagctgggccatccagaaatgacgcgtacactaccccttaccaaggaaccggcacacattttatagaagtgtcgcctaatactgtgtatactttatcatttgaaatggaaactgctgtgtccactagaatgatgctgttgcagtttgataatggtaatgggggcacgcacgcacgtaacaatcaggttatatcaaccagtactggtataaacagtctgactattactacgggtgctaacactacccacctgtctatgcgtatgtcaatctctaacatgggagagactaacgtactgatgaaacctaagctggaactcggggcgtttcctacggcatacgtggcgcatcctagtgatctacttggtaaagatggtgctactggagctactggtcctcaaggtccgcagggtaacactggtgctactggtgctacaggcccacaaggtagtaaaggtgacacaggggctactggtcctcaaggtcctcaaggtccgaaaggtaacgcaggtgaaaacgctaaaggattcgccctaacgtcagattatcagtcattcgtgtatgatactgtaggggacattaaatccgctactactattctgttcaagggactaaaacagaatactactgcagggatcacgtggagtgctgtaaataatacgggagctgcagtaacactgatgaattctggagataaccgtcagctaaccgctgcgaacttcggcgcctctaagtgggttacgataacagcaacctgtgatggtttatcagatcaaattactgtggttcgtttgcaggacggtgagaacgtgttgaccgctgttatgacaaatgaggcagctacggtacttgctaactactccggatattgccagagttacgaaaacgccaaaggtcagatgagagtttggtacggaagcaccgatgttactggtcagtgcactttctctgagggcggaagaagtaacgtaactcctagcatcaactcagcaaatgggaactactccgttactggtatgttggatgggaccgatattaccgaaggttgggtggacgttaaggctactcatccaaaatatggagcaattaccaagcgttttgcggtaactaaggtattcctagccaagagctatgagatggttatcaccaataccttcgagaatggtaacaaaggttcatgggcaggagctctgcagagtgtttccggcccaacaaaccagagcatctctaaggcgctgcgtatcacagctagagataacctagagggtaggaacaccatcccagtagcaggggggcaaaaagtccgtatcagattctggtacaacccactaggattagaggaagccatttttagagtaggctttattgttcaccgcaaagatgggggcaaaggttacccctccagaactgtggttacgggccccgctcctaatagctcctgggcgtacttcgatcaagagttgactctaagtgctaacgatgagggtattgcctggccgtggttccagttagataacaaaacttctggttcttcattagggtatatgcttgttgctgacatacacttcgaagatctatccatggatggtgcagacggagctactggtcctcaaggtccgcagggtaacactggtgctacaggtcctcaaggtaacaagggggatactggtccacagggtccacaaggtcctgcaggagcttcagttggtgttcagtggtctaaaaccggcaacgcgagcgattggcacacaaactatgctactggcgacatttatatgcgtcagcaagttaacggtgtgtggtcttcggcaatccgcgcagttggcgaggatgggcgggttggtgctgatggtaaatatacctccctgagattccaagtagctgcaactaaacctgctagacctacagggaactctccggctaactggtctgattcacctccagaaggttccccactctggatggttaaaggtgagtttgactccagcaaccaacttcagggaacctggtcagatccagttcgtctggacggtgagacggtcaacctcaacctgtttgctaacaaagcatggattgcgtctataacgggtgccagtggtagtggatctgttgtagccaaaaaccctgacgaactacgcttacgcattaccgcaggttctggtgcaactgacgcgtataccatgcctagtggtggtgatggtacgttcttcactaaagttaccgcaggtaagcgctacactatgtcgttcgacacggatagtgctctggaaatgagaatgcatgtgttctttatccaggcaggagcaaatactactacctcatcattctcttggatagcgtcaacaactgctggcagaactagctggtcgttcactgttcctgcaggatgtgatagggtatctgtccgtgtgtcactgaacaacaacccaggtggaaccaacgttgtttccaatatcaagctggaagagggagatttcgccacagcgttcattaggaacgagctggatactattggtgctgatggttcacaaggcccacaaggtccacagggtagtaaaggtgataaaggggacacaggagctactggtccacaaggtccgcagggtccaaatggtactagcgccaaagcctttgccttaacatccgatagcctgtcctttagcttcgatactagtggtaacctgaaatctaatggtactatcaagatcgatagctggagacagaataccactgctgcaataacctggactgccaagaaccaagcagggagtaatataactttaggtggcactgctactaacaagactataacctctgctcagttcggaagctcagagtacgtaacagtaaccgcgacgtgtgatggaataaccgattccattacaatagttaggctgcaagacggggtgaactctctagtcgggtacttaactaacgaagcggctaacctgtcgtgtaactcctacggttttgtgcagaattgggatggcactacgggtaactttaaggtgttctacggaacggtagatgttaccagtcagtgtaccttcggagtggaggataagagcaatcttaacggcaacatagggtcaagcggttattatgcccctagcgctatgccaaacgggctggaaattacctctgggtgggtagattataaggctacgcatcctaagtacggaacacttattaagaggtttacactcaaaaagagcctgcccgggattggttacgacagagtgttcacggggtcctttgactctggtaacaatggatcgtggggacgtacggtagttgacatcgctacgggcagtcccggaggacacaccaaggctatacagtgcacctctagggacaccatggaaagtagtaactggttccctactcgtaaggggatgcgctaccgtgtaactgcatgggtgaacaactctgagggtgagtatcagctaaggttaggcctccatacccagaactcttctggcagcgttaacactggttacccaactatgctagccgcatcagctaaggattccgagggatggaaactagtaactggtattgtcacggtaggagatgggtctactgcggagactggtagggcaagaccatttatccagatgaatggtagtgctagccccttcggcaacgcttacgtagctgctatagcgatcgaagacctatctatggatggtgcagatggggcaacagggccgcagggtccacaaggtaatactggtgccactggtccgcaaggtgataaaggggatactggtcctcagggtccacagggtcctgcaggtaactctgtaaacgttcaatggtctaaggacgggtctactaactggcacagtacgttcacttcaggtgatctgtacatgcgtcagcaggtgaatggatcctggggtcctgcgatcagagcagtaggtgagaacggggctaatggtacgccaggttctaagggtaactatgtgagtatgaagttcgccgtaatggctagcactcctagtaggccttctggtagtaatccggctggctggtcagatagccctcctccaggtaacccgttatggatgattaaagcggagtttaatggggagactaatgctattataggtaattggtcagatcctattcgcctagatggggatagtattaacgagaacctgttctactttaaagcctggttagactcgattaccggagttgcaggcaacggttcatctataggtaagaactacgagttactaagggctaggataatcgcaggtacaggagttaccgatgcgtataccctcccatcagatggatccgcctccatgttcacctaccttcctccaagcaccacatatacgatgtctttcgagactgataacgctgtagaagttcgttgtcacgtattttggtacgctaagggaagcaataccactggaggagtgctgaagactattgcatctactactgcaggtttgagcagctttaccttcaccacgccggctaattcggataggatatccgttaggttctcagttaacgaatctgggggaaataacgttgtaggaaggtgtaagattgaaaagggagccttcgtaacgtcatatgttcgtaaccagtatgacgctgtaggggatcgtggtccagggttctatactcaggcgatcacaaacttaaccggatggaacgatactcaggcagcatctttcttccagtcaacatttggtggacctccggttaagtatgacgtactaactcagtataagtcgggctctccgcagaactcctggactcgtcaatggaatggctcggcatggacagctcctgcattaactgttcatggtgatatgatcgtctccggttctatcactgctgataagattattgcaaacaacgcgttcctggcgcagattggtgttgacatcctttacaatagggccgccgcactaagctctaacccagagggcacttacacaatgaaaatagacctggctaacgggtacattcatataaggtaacaaatgagcacggaaaacagagtagttgatattatccttgatcaaaacgtgtcatacggattgatgctacagttcatggatatcgatgactctgcgtacccagcaacggaaacccctgtcaatctgacaggggtaacccttaagtcttcaattaaagactctctggaatccactggggtaaaattagcagatttcgtcgtaacagtagtaaacgctacacaaggtcaggcgtcgctaggattaactgcggctaccgtggcaacaatcgttagtaaagcaagtaaagaacgagataaatataatcctagacttcggttcgcaggttactatgatgtaatcatgaccaaaggaacaggagctaccgctacctcttatagagtcatggaggggagcgtgtacgtcagtgatggagtaaccgcgtaatggctattacaacaagaattattgcacaacaggttaccgctcttgacggagctaactcaagggtaagtaagtacccaaaatttaccgtacagctaggatactcagttagttctctggctgctacagaattactagatgctgccactagatcggcagcatccgccgccgccgctaaaacttcggaaaccaatgctaaggcttctgaaaccgctagtaaaaattcccagacagcagctaagacttcagaaactaacgcggcagcatccgcccaagtagctcagaatttggcaggtaaagcgtccctagtaacaccactaggagtgatgaccggctcggcagaagctaagattgcatctataacaatagccgcaaatcagtcttctagcgttcacgtattatttgcgctctacgctacaggtaatggagccaacagggatgatatatacaatatggagatagtatccctggcattacctggtcctgtaacctctgtaaccgcggacaacatcggcagcttccttagtcatcgagtaataggtccggccaacactaatggatttatggtaggacttaaatctactattgagggtagcaacgtgacctatgatgtatacctcaaatctcgtagtagtttcagagaccctaagatggcattcttatccggctccatatctgttactccacctaccggacctttggtggacggaacatcccctgcgtggaaaactacaggttttgatactgatgttatctatgtaaatagggcgcaagtaattgatgatggcattagtttagcccgcatcaaacaactagctataactaacggtaaaaccgatagctctatacttcttttatcctatttaaatgaaacaggtatactatctaccaataagaagtctatttccctccggccaggaggtacgagtgactctagtattgcagctacggagtttctacctaacgggaatataattctgcctaatggggatactgggaaccaaactattagttggttaggtggtccccgcatacgagtcaactccaacgggtcttttgttctttctactaataatcccagtaatcaaactagtgggtttataactttcaggccacaaggtgatcaagtaacttccactgagcttcagattagggatgatggtaacattaagcagacagctccacagtcatcggcaggcaatgcacttatacgccaggatgcggctattcaacatatcatggataaggctccggctgccggtattactgctaaccccctaagcgacttgaacgtaatacctacgcctgaaggtacagatccttggggagcagacggtgtacgtgtattccaatcaggggtatcaacaaaaaatactccggacggaactactggtcggcttggaactatcctcaacgttaggcacacccagtaccgtataatgcagttcttcatgcagagtaatgctactgcacctattctgcatattagatcattaagggctgatcagggtaataccccaccggcatggtttaaagtttatacagaatactctaaacctaacattcagtctgacatagcaggtattactatagacggcaatggtttcgttaagaaagcctccccgatcgccaagctcatagccgaaattcctagcaaagaggattcattcttctggacaggcgtggaaactgtgggaggttacgtagggtgtaacgcagaggctcaaggtgtatttgctgtaaaaactggactaggcaagtatactattaaagggagtttaggctggaacacggaaggatggaaatttgagctaccaagagatgataacggcaatatgttgtgcttcgtggaatcggattggaatgaggaagagaaagagctaaacatacaggtgttcacccgtaagtttgatattaacacaggtaatatcatcgctggtgaacctatggagataccacaaggtcgttggattgatctacgtctggaaatgccaaaagtggaaataccagaagtggaatttccagaagatccagaagtataataaaataaaaccccagtcggagcaatccgctggggtttttctatttacatcttaccagaacttccgaagccaccttcgccacgatcagtgtcggtcagactatcgacaatttcaatgtcattggggttataatgaggtacgatcaccaactgacacagacgctcaaagttatcaatcggttgtgtctcgttgctcatattcaacaggttcatcttgatggttcctcgataatctgagtcaatcacccctgttgtattggcaatcattagccgacgtttccctagagaacttctcggaaccacgattcctacccagccttcgggaatctcaaccgcaactccggtatcaatcatcaatgactccccaggaggtatggcacgcaataggtcggaagcacgatctccgaagtaggcccgtagatccataccggctgcttccgagcttccaacgtgaggtttacaatcggggtgagataatttaatacgcattatacttctcctgtggcaatagccgtaatgtctttaacaaattgatcgtagatatcttgtcctgctgcggcaactgcttccccacagaaacttgggagatctactagagttaggttacgttccataagttcgcctgatttattcagagcctggacgaatttttgagttcctgggagcggtagtgcatcaataatgtctagcacgctaccatgttcccggattaggttgtagccacgtttttcgccgataccttcaacaccacgaatgttatcccccatatcgcccataatggcttttaatgagataaactgatctacagtatctacgttatggttgtcgaacatatctttctcgtgatattctttacgagtagtaaacgagaagcgggagatattcggagcaagcagggtatcccagtcaccgtctgtggagatgagccagatatgatcgtagtgatgacctatcagctgaataatgaaagccgccatgtcatctgcttctactccgcggattcggaaagtagggaattggcttgcaataagatcaaacgcatcgtctaagtattcaaagaattgacgatccgcctctacttccgcttcggagcgatcggcgtacttagcgtctcggttgcccttatactccgggaaaatattggtacggaagatactcttccctttatcccctagaacgatagtgtgcttcgcatcgtaggagtttgccaaagagttgatggtgtttgcaaaggatgctgcaataggcttaccactatctttcttgaagcggaagcctaagttcgtaccgtcaacaatcataagattacggcgtgaggcgaggcgttgttctgcctctcgtttcattgttccccaggatttactcatttaactaaatctccaatttcacatgcgtttaaccacggctcaaaaagaccgataacaatttccattccacgtttattaactatgaaatgtgctctactcatgaggttatcaatcatagggtcgctactatccagagcgataagccattgaccacgatctttcttaaagatcagggcgggtttcatgttcatttgctcaccttcacgtgcggcttgggcccaccatttttctagctgggattctccaacgtttaggatattgctattaaatttttcgtctgcgtagtgtttgatctcaaaacagtattggctcattttacctacgctaggtggcagatacacatccccctttagggagtgggattggccaaaagctcctgaaccaggaacacgttcccagtccaaggaggtatatttacgcagcatatcacggatttggtattccgcgcgttttcctttctcgcgactatctacggccattaggcctccaaaattgataagccagcttcgtcttgtttaacctcaatcttatgtgcatacggatgtgtgtgcccgtgagatacgatgattgagttcagctgatcttcttcctgtagaagttctacgagggtattaattccatccgggtcaatataacttacaacttcatcaaggaagagcaggttgatattaactttactaatcgttgaaagcaacattcgaattgctaatagcgtggaaatattgatacggctctgctgaccagtggagcagttgaccatagaagtcctgttaccatcattgtagatgacaacctgtagcttcgtctcgtctaactcgaaccctagagcaaatttaccgctggtcatgatagagagataatgattgatcatctcttcaaataccttgacactatgctccagcttataccctaccagatcttttagcccggtaattaagatatctagatccgctacttcttctgcaactaaggacagttcagcctggatcttatcaaactcctgctcggccttttgaatctgttcacgcttagcttcatatttcgcattttcacgtacaactgattcgttatgggttcttgcaagttctaccgaggatctgccttgacgaatgctagactcaatagctttgatacgctcagctaacccgctagcgtctacgatttcatcctgcgttccattgacctcatcaaattccttgaggtttttgcgagcctgttccagagcgttaaacttagagatataatccttaaacgccctatcttccttcctaagttcttcaacttctgcttccagcttttgacgttctttatagagcggatcatactcctccttagttcgtctcatagcttcttgggcggcggaggtatctaagtgagttccgcacgcagaacactgagttttacctgcggcatttttgaaatcgtagtaacgtttcttcaaatcatccgctctagttgccacgaccgttaggttacgcgtaacactcaggagttcctcagatttcgaggtgggcgcaggtaaattttcgaatggtgcaaaagttttttcggcagcttgtacggccatgtccaaagagctacgttttgcaatactggctttttgcttctgagccagtgctaccttgacttttgcttcggttaattcttcgactagtggctcttcatcgaaaacagggattgggatctctgattgaggtgcgccaagcgaggcttttgaggaaagtatagattgggcagttcgcaggctaccttccaatccggacagttttgccgagacggctttacgtcccgctttaacacgttcagaaacttccttatattgttcctgatcaaacaggttaacgaggaaagtcttgcgctgagcatccgtagtcttgaggaagtcgagactggatccaactgactgatatacgagcttagtaaatgtcgtaaaatcacaggcgagtacctcttctatcagcttatacgtttgggttgcggtgtgtccgctgatatcttcaccgtttttagtgagagttactttggcggttgacttcacaactttcttgacgttgtacacgtcaccgtcttttgtgaactgaccttctagcgtataggccttggagccagtatgccagttaaacaggtcgtccttcttgataccacgtgagttcttattataaagaagctcctctagagctgtaccaattgttgatttacccagcccgttacgcccgattaactgagttacgcggtgattatcaaattctatcaccacgttctcagcatatgacataaaatggctgattgtcaatttattaattactatcgacatactcagcggctctctttaatatgcgtgttctagacgcttcgtctagtttctgcacgtttgtgaaataagtatccagctcctgtagcagtgacatatcgtctagatctaacttagcatctttggtgacacggttattgatcttcttatctaacagttcgctgttctttaacgttttgagttgtgatacgtcgccggtgacttcgtatataactctgtcatacgcatcggcttccattggctcgccgacttcaatagtttttcgtatgagctgtggaagatctcccagttcaatccacgaaaggtagtgctcatggtctcttggcaagaccgtatcgatgataaaagctccgttagttccttttgtcctttctctgtgaaacgaagttgtaagcggagatccgggatagagcaggtcaacatccccgatcttttggctgttcttgtagctgtggagatcgcctgcaaatactttggagtacccatgttcgacgaatctttcgaggtagatttctggtacgacatgaggcgggattgcacctctgacatgcgtgaagcaaatgtctgaaactctgggcttccaactagctttgtgaaggctgctgtaagggatgatatcgaactctggagatcggtagtctttgacgactttccaaagtccatctgttgcgtcgctaattgctgctgcatagtgatccaggcaagaaatcgttttagatttcatttcgtggttcccggtgtaaataataccaggatgttggagggtagctaggaatgcaaacagtagttcaacttcttctgaagacgggtctgaaacatccatgatgtcaccaccaataatgtgaaggtcacatccagtagctccaaacacttcgtccagcttttcaccgagaagaataaaccgatttttctgccattcctgaggaacgttcttcgctcctagcttgatgtgatgatctgctgagaaaagtattttcatagtcaaaataaaagggagccgaagctccccttgtttggattaatcgaggtcagaagctgcttcgtgatcgatgttaccggagttcgcggaaccttcattacctttagattcgtcgccctcctcatctttcttaccttccagccatgcctggattgctttcttctgctcatcataggacggaaccgggtaggtaacatccagtttaggcactttttcgaagccttcgaattcgtctgcttcgttgtacagagcctcaccaatcagagcaacgtcggcttcatgcagggcggcctctttagaacccggctgatttttagccatctggaactgcattgcagcgatctgctgtacatcgtacttggtatcgaagccagtaccagatttggagatagtgatatcgatctcacccggatcttccagattcagctgggccatgatggagtggataccggtcaggatggttgccttaacttccatcagcttcagtttgttatcagtacgatcgataacaacggccaggtagtttttcttaggacgcagcggctgagccttaccatctttcttctccggatctttgaagcccatgtcgtgaaccggatcggatgctccacggatgaaacgctctttttcacggtcgaaacgcaggcactcgaacggagccggtttaccttccttattctgaatccagtacacataacgcgggagaacgccggaaacgatacgtacaacgttcttaccgttgttgaacttcatgtagtccagtttgtcgccgttagaaccgccagtagtagaaccccaagatttagtagccatatttaattttcctcgataaatgtcaattttgacttgttgattgcgattagtgggtggtgctcgataactgctctaggaacccacggtggaatatattgcatatccagtgatgtatccttcgagaagctatattcggcatagtttctaaaactcaaaagtcctagatactcagccaactgtcggtctgacagctttcgtttattataaacgattgtatcttcgttcaagataaatgatctacccgttaacataacatgagcttcgggatcttcaaccattcgtctgataatctgtacaatcagcgatgagttacctcgtgctaatatgtaaattttttcgtaatcataaaacaacatgattattatacaccattttgagagaatttagcaactaagtttttatttttctgcttcggactttccgaagattcagttgctgttcccattaatttatacagatattatatcgtatttttgaggactcagcaactgaaatttttaactatttgcttaactcttctttgtaaatctgtctctcagttcaatataaatattatatcaaactttggggttcttagcaaacagaattttatctaagtttgccatattcttctcgttaaagtcaagaacttcccacccattgagacgatataccgcttctctacccgccgcctgcttaaatcctacacctcctagcttcagatccacgaggattgggtctaacttatcatctgccatacgttggacacgacctgccaactgttcgattagagattcgttatttattaaagagcctaacactaaacacgataaagcatttaatgatacaccctccgagaagatgctttgggaagccgctaacacacacggaccgtcattggtcacgtcaatctgtacttgctccctatcatcgagcgaagttacaccggtgatcgtgtaggtcttcacacccctgagttccaaagcattcgtaactctctcaattagatctatacgatcggacacaaacaggactttatggcctgccatcgaatatagctcgcacaagtcaacaacctgttgaaagtattctggctgcgaatatacatcgttagctcttatcgcccacggcacattcatatttccagaaacctgcgtttttagcgcaaacctatggatagtaggtggcatagtgttatttaccggaggactatatactttcgttccaaaatagtccttaaacataacctgcaaaccatccttacgttttaatgtaccggatagcccgattttatatcgtgccgaagactgctctagaaacttggtaaacgtggtggcaacgcagtgatgcacttcgtcaacaataacggtgccgaattcttttgccaaagcggctccgtgtttgttaactgtctgtatattactaataacgataggagaatcgatattaaatttgccagacccaataactcctggctcaatcccaaagaacttgcgtacctccttctcccacatagctcgaatggtagtgttggtacatataactaacgttttctgcccaagtttatgggcgatagcaagagcaaggattgttttaccgaacccaggcttaccattaataatacacgtatcattacagtcttcatatatagggagctgatcccctggtcgcagggtgaacgatggctttggaatatccataggaaccagagtacgtttatctacgatctctgtcactttttgcccgaaagattctagaagatctaatctggttacgggaaaccacttgatctctttacctaccgatcctgagttctggaacattagaggatactttgccccaggtttaaagatctggtatgaagtgtgttttaataagtattcccacagttcgttgctgggtttacaatagattttattagatataactatcttcatatcttaactctaagtctaggagtttctggctcctcttcgtgcgtgtcaaaaataactggtgaaccgcgaaccaacgcgtacgaaatatagttggcaggttcactaagtaagaaaggatatggaacgttcttgacataacactggtactttccgttgaagattctagttgatcctctaacgcgttccgtgataatgttgtaataagtcgtaggtttccatgttactatcttacctgtggagtcgatgaaatgctttagtccagagtttattatctgagataagtacttgaactgtttctttaaaggatagagcttataaggtaaattttcccgctcaccataaagaaaaagccttcgctgagagaatgtcccaggaaggcttggattgtccagcacataccttgtaaatctcgtctggataacaatgtactccccctcttggaagagtacatcataagcccttaaagcatatactggtaagctaaagttaagcaccaagaaccctgcgaacgttgacaatatctttgctgatttccggcaaaaacttaatattggcgtacttatcgtgatcagggtggttttcatcgttagccgcaatagcagcgtagtcgaagtcctccataccgataatactacgtactttctcctcaaactccttgtcctcaatgcaagcaacagaaggacgctgtttcttgatcttaccacaggagtaatcacgagaaccgccagcctcggagtcagagtcgataccaataggacagcccggaatactaataccacggtctacctgaatgttacggattagcatctcgttatactgatcaactaaatcctcacgaacaatggcaaccacggagtcgtgaaccagcatgataatcttcatttcgtcctgcagacccagagagcgaatctcattatcggtatcgatagcgcctagcaggagactatcagaagatgcagactgaatgatggcgttgaaaccagaacgcagttcttcaccctgtacaccacggtcttcggagttaatgttgtgcagacgacgcttacgaccaaagtggctgtaaatgaagccgttagtttggatctgggcatgagatttatcgatccatttcttaagctgagggaatcggccaaagtaggtttcgatgtactctttcgcatcaccagtagtacattcagtgtacggtttaccggtcttcatgtgctcttctaggagagcttcgtttactgacgctgctactttagccgggccagaaccgtaaagaataccgaatgaaatagcttttgcagcctgtcgtagtgcaggatacagttttttaacctcagtcggtttacacggcagagcaaataccatgtgtgcaattgaaccgtggaagtctgagtagttttccgggtcgttctgcatgttgataaacacttgctgcatgttaatgtcaccagacagtacagcggcgtagtaaatctcagcagttgttaagtcccatgcgataatacgataacctacaggggcaacaatacaacctttaataacagactcatcacgaggtaactgctgaaggttcagcttaccagacgaactcagacgaccggatgtagtcatatggatatggaatccagtacgaatgcaaccgtcagcatcaatactgatcagcatcttctcgatatacgtcgagagcagcttggagatcttacgaatctctagcagagtcttagctatcggatgctggtccgaaagctctttcagggcatctgcgccggtggaatctgcacccgtatctgtcatgatacccgtcggggttaagccaacataatcgaacaggagcttacgaagctgtacaacagaggctgcgttaaatactgagccctgatcttcctctagcttacgaacttctggatactcatacagcttagcttttgcaagctgtagcgcagtcattaactgaacctgagcctctttcagacgatctttggagatcggtacaccacggtcttccatacgctgtaggaatacacatcccggcatcagtacatcgtaatacagagacttcagtcgagggttagcttcgacttttggcaggaagaaattggatagacgcagtgttgcatcggtatccttcgctgcgtaaggccacatgatatcaaacggaatgagatcatacgagaaatcctctttcttgatcttatgcgtcttgcaatacgtctccttgaactggtcgagttcaaaatcgtagtcccccatatcggtatacttcatcgccaaagatttcaaaccgtgtgtaccacgtcgttcatctagggcgtagtgcatcagcatggtatcgtggaggcgtttctcttctgctgccttatcaaaggatagacctaagtgatagcagtagaagtgcatatcaaacttcaagttatggaacacaacgccatgctccgggctatcgaacagtttctgtaagtaatagacggtattttctgtgatgacgtctgcatcaatatatacgccctgatactcttggtgggagattgagatccccagcatgtaaccatctcggcagtatagcgcactggtttcggagtcatatgcgatcatgccaggacacatggtatacaccatcttcacatacgcttcggcttcgtccgggcactgaatcgggcggtaatcccctgctttagagcgtttttcacgaccattgagaatggcatgaatgctctctactgtggcttcaaatacaggcttcatttccggtttaaagtggagctgggccggactgatacttgcaatccagttagcatacccatcatgctcaacacgtttacctgagtaatcggaaatgccctttttagctgcaaacttcaagaacgggtctgcacctaccagaataacgtaatcaaaatcttccggattgaacgggttctccggtgttccgatagtgatatgtttcttgagcagtcgcccggttactttctcactagccatgaagaaggtctcaacctcatggtcaaagagttcgaagtgtttctgatagcggacgttattcggtgatttgtctacaactgcgattttcattgatttctcctattaggtaagcaagtaaaacgtcagtgtttcttctcaaacttacccaattattatatcaaatcttgacatgttcagcaatcaagatttctacgtttctgatgagttggtcgacttcttcagcatctaggtctccagggtctttgccctctggaagcaagaagttacctataattggtataattctagtcttatcacggattaatttggccaacttcttagccgcctcattaccggacttatcattgtccaatatgatgactacgtgagtagtaccggcgatttggaacggcatgaatttatctgcaatgttatctagtgagaactggtgagtaccaaaacaacatgaaacgttatggcaacctttatcttctagattcaacatgtcgaatataccttcgactaggattagggctggggtgttatagcgaacagggaagattgggggggagaccttcttaggtctaatcatatatttcggaggggcagagctatccatattacggcctaagaagaataagtttctccctacggcatccgtaataggaaacactacacgaccttcccagtcctctgtttgttggaatgcaaagtatttcttgaaagtctctgctttgataccacgaaagtcttgatcgaatatcatggctgattctggaatttctagactgcgaccctcagttcggaggtcactaatcattctgcgaactctcaggagtctaggcgacgtcctgtactgttcttcattgaagtaatgaaagatgcttggtataccacgaccaaatccgcagcttaggcagtggaaaaccccggaatcggggtcaacacgcaaactaggatgagcatcctcatgatcaggattgagacagcggatgaggatgtccccacccgtatctctgtattcaatccctttgagatctaaaagctcggttattctactcataagtctcttgaggattctccggtgggattagtatcctcatccgaagcctttttcctttttggtttgtctttcggtttatcgctttcaagtgggataacaaactctgcttccatctgacgaatgtcctctagcttaaggtcagaagtctgatccatacgcagtgagttccagttgatcttcggcatgaatgtcataccctcggagttacgagtttttacgaagtcgaacttgattgcaccgtcatgcccctcgttctgtttagcagcatttaggtttgcagccatatcacaggaatcgagaatacctcttgccatacgggcgttaccctgttggtcaatctggtaaggggctacaccagcaacgttatgcttttggcacgtagacttgaatgtagaggagacaaccatctgctgcttccaatcgtacatatctagtgtcttcgtatccggcaaacgtacctggttgatgtagtctagcagggcgattgttaccttatctccatacttggaggttagcttagttagttcaacatcgatggttgctgtactaagttccggatcatacacaatgatcatcggagtgtgcaggggtctttcctgcattagcatagtctccatgtcatggaaatcactcatctcgttgagcgtataacgtgatacaaaatcgttatatacttccagaccgccttcaaacatttttgcacgagtcttcgcaagtttgttgagttcaataccttgtaaggagtcattgcgcatagccttagcggaaacaccggccataatggctaggttacgtctaaagacctcattctctggcatttcgatggagaaatatggggcgatatccccgttgtaatattgggctacttgaatgttagaacagatgattgatttacctgtaccacgccatccaccgagtagcagtgtttcttttctggcaattccgccaagttgagcatcaaattcgtttgagatgccgagagagataagatttaacatggagtcttcttttctcttgaaaacacgcatagtatcggcgttgaagaccttaccagtcgttgttactcgttcctctagcttcatgtgcagagccgctactcgatcaagtaattctccctgatccagtatggtaatatcctgcaacacatcagtttctagcagattcaggaatagatcctgtgtgtattccgactctaggacatgaatcgcatgcgatatgtcaacgtctggaatctgagtgtttgctaaaacagttagtgcttgagacaaccttgcgtttctgttagactctagcattagagcatctaacgaaggcattccgttatgctttttgtaataattctggacagcttggtagatcgcggtaaatgcgtcattgaagtgatctttgcgcagtctagagaatgtctctagggccacctgcttttgatcggaggctaggagcattttcaaaactactgcttggacgttatacataagatactctctacgccgcgttagcgtctacttaaacgaaaaaggggagaggaacaaaattcctctcccctcaggtcaaatcaattacttggcggatttagcgtcaagtttagcgcgcttagcaacaccatcgtgatccttagcagagataccacggcggctcagcatagacttaacaccacgctcggatttaccagttgcttctgcgatctcagcaacggtcatatcggcgatattcagaccttccagaacgtcttcgcgtgccttagcattagagacttcctggaccggcatagcttcgatacggccttcacgcagcaggctcagagctttaccacggatctgcttaacggtacgttcgaactgagcagcgattgcttcaacggacgcgccactggcaacggcattaatgaaagcagcttcctgatccgggctaaagctacgtacagcagcggccttttcagtcggcttaacagccgcagtcagttccaggctcaggattttaccctgtacttgtttagcggtataagcaccaccaactacagcagcagcgatttcagcgtaggtatactgacccggatgatcgttcaggaatgcaaccagttcatcttcctgacccggagtccacggagatttggttacgtcggatgctttctgtacttcgaagccttctttacgcagtttagaaccaaccgaacgggcggtaacttctttaccagtttcagcagccagttcagcagcgatgttagcaacggcttcctgagagataacggtcgcgttcagagcgttagctttagcggtcagggatgcagtgatttcttcgttccaggttaatttagccatttttatttattctccagtagaattttaatcgtcaagacttcgatgcccagcgattgtgcttttttgtatgaagaagaaccgatcttggtttcatcttcgcagattaagtagtttacagccttagtcacggaggttttcaccgtatacccaagactttccagatatttggtagcgtccgcacgatttttgaagtcgttgagcttaccagtaatgcaaagaacaactccgttggattcagtcgccggggtaacttgagcttcccgcgccccactgaatttccatggtagattaattacgttctgtcctgccggtgtattcttccacgaagctaagttttctccagctttaccttccgctttcacagattggaaatcgttgtaaagctgggataatttcttagcagcaacttcaccgataagagggatactaagagatccaagaaccgaaccaaagtcaacatcttgtctcagcttagtttccaactctagctcaagtttcgtggcgactttatcacctacagctctgaccaaatcttctttagtcaggaaaaagagttctgaaactttcgtgatttccagtttagcaatcgtctgtgggccaaagccctttaacttcatctttgagcagaagttctcgattaatttactgctttgagctggacacatagacttgttacggcagaacaactgatcgttaactaagtccagtttcgaaccacaagagtggcaattcagtggaatttcaattttcattgattttcttcctcatcaatttatataaatattatagcaagaaaatcaggactaagcaatcgaaatttttcagaatttagctcagtctctcaccaaatatttctttccctcaactgaatgataatagtatacaccctggcgatgaaaatgtcaataactactttaaaaaatcatcacggtgtatctattgaatcaagtgttactcgtaaacacgttctacgatgcgagggatgaccccaccactacgaattacgcgaatctggcaaccgatttctaggtcaagggcagtgatataaccaacgttattcagggtagcttttgaaatgacagcgtcgtcgatgactaccggggtgaagtatccgacaggagtaactttaccggaagccccaacttgccattctacccgttcgagcgtagtaacctcgccttcatcatcttctttgatggcgtacgcaccacgcgggaacttgttagtccaacctgctgcgttaaattggttgttgccatccatacgaaccaccacgccgtccgttgggaaccaatctactcgactggagatatccagacaggtaacaaaaccatcaccctggaggatatgcatatctccacagaaagtagcggtcaggccaactttgccggtttcacactgaatactatatgccgtgaacatcaggccaccttccgcaatacgggagagaaactctccagaatctttcaggttaatagcaccagaggcgaagttacgcatattttcaacttctttggtgatgtgtacttcaccagtaatctgcaccggagtcttttgggagatccgtttagggatgttcagtaacttcacattatgagttacatcattacctaagacgccgttaccacgggttaacgcagaaacgaactttccgtcaatatacagaagtgaaatagcacagccatcgagcttcggcgtttcaatgccctggaagggtacttcttcgccgcggcctgggtacactttctgtagggagaacatacggaataggtgaggtacatcacctttagggccaatttcttcctctagcggaaaacgacggattaaggcatcatactcttcatcagagataatcgacatgcctttgtagtacgcgtcttggcacagcttaataaattctttaacgtgttgcattatttggcctcgtagtaatcgaacagcatctgagtcttcccttcccagtaaaagttttcgcataccgcctggaaggtggacattaccctacgcttagattttggactgtacaattcgcatactagtacgttcttctcataccacatgcctagcatctggaagcctgacattgtccgtactacaggtttgcccttctctttctctaaccaggttaggactagctcctgaccctgaagtggcgggctggagtatgcgttaagcgttatcttttgcattctttaatgcctcgttaacaattctagacatgtgtgctctcagctgttgagtgtgagcatacgtcttagcagcttcggtcagcttattaactaattgagcgatttcatgatctttcataaagatctcctttaaactatgagaatattatatcaaggtttaaaacactaagcaattgagattttaaagaaaaagccagcaacttagtcgtcactggcttgggtcttttgagattcacggtaaacttcatgaagaacctctgaattgcttagtattttagtaaatgcacggaatagcgtgctggtcatttctaacgtgtacgggaacgagaagcctgatttagtagggaaccagttatcttcaatatctagtaaccataatcggaaaccaaagtataaattgcctctaaactccgagacagtcatacgaatctgtcgcccttcatcttcaaagataacgtgggactgatcatcaatatgtccttcgtaatcctgacaaatgttttgattcatttttattgttctcagataaacaaaaagcccccgaaggggctgattgcgtcttaacgacctactggagtagctcgatcaagttcttggttgaggctggtgatgcgcttaatattcgcaatcggaatatagcggaatttatcgctagagcggctaaagaccaggatatgatctttgtcagcgggttccaggccttcacggacgattcgctcggccagatatttatcttgcttaggatcgaactcagtcgtaccgtagaggtaagttacccccttggtacgcagtttggtgtattgcatgcaaaactcaccgtgtttctcacagatagctacgacttgtgctttattcattgcaataccctcttatttagtgattttacggatagcttcagccaggtgagaggcagctttaccggtcagtttgtcaacgatcgattcgtccaggaagccatcttccagtccagcgtcgttaaatgcagcgcgcagttcagcctgagcatcagacttagaagtacggccaccagctttaggggcatcaccaccagttttagcggtagacttaccagcttctttcttgacgtatacgccagctttggacagcttcatacgaaggccgttcggggaaacaccgtgctctttggcgatctcagctacgatctccatggaaacgccaggacgctcatcttccgggaagagttcgattttggcgacgtaggcagaagtcagttcagcttcgagttcaggagaccattgagttggagtagacatatttattacttccttatttattgttaaaaagagtttttaagttttgtttcagactatgagaatattataacaagttactgagctgcaaagcaaacagaattttctaggatttggttaacagctaccaaaccattaggggacaaacgatacatcttcagcaaaccacgatcgtatttggtaagccagccattatcttctgcttcgtccatgggaagtgcatagtgcagatcccggatagctgtagcaccctcggaatagatctgaaataagttcaggagttgatatttactcacctttacctctcttttctagtttcagggctgcttttacagcgttattaaccagttcagctacgtcttctttaccccacttgaaccccagggacttgatatcaacaccaagtgctaccagatgttcgacagacgccagatcccaatacatgtagttaacatactgctggcgggcttcggacagcaggtaaacacgatacgcgcctaccggattatccagagcttttttaacttcgccaatacactgatagccaggaacccaaacgtgttcgcctacttcgaatacctctttcattgattcttctggaatcgcaggtggaaagagcgggtcaacctcgccattaacacgaagcagagcaccgtgagcagacagaaccattctgatcatgtttgcggaacggtagaaacgctcggcaattgcctcaaaactatcacctgacaggtacgaatcgataacgttggccagttcagccccttcgattttagtaccacgtttctttttacgcatttcagcggaaacacgctggttatctttccattcctcgataaggcgttccatcgtggagttagacgctacgccgaggatttcgcaagcgcctttcttggttttgccttcctctagccactgaatcgcttccttaaacttttcgtccgggatgctattagcatgaagttttttgcggattgccatgttctttatcctctctcgaatttatgaaactattataatacagatttagcttctaagcaatcgcgattttcatagaacgtagggtcgaaagtaacgtgcatgaattcagatagactcttgtaccccatgttaagttccatgttgatgcgtatagaaaggcgtgtctttcgctgagcctctagccaatcatagatatttggcatctgtgctaagcgaataggtattactctacacaattctatctctttagctttccgtgctttcgtatcgcgtttgggaaacttccttgtttcccagcgggcatcacgcttgctcattacgtactccaagttcgttttgcgcttcatcggccagcgccttctcctcgtccgtcataaactcatacggtacagagataccctcgatagaacagtacgtgcgataccagtctacgatctgctccgtctccatttccttattaatacccatttgggttaagtacatacgggcatatttagggttggcagactgtcccgtcctaataaagaagtccttcttgtgtttcttcagggcttcaataaaggggctaatcgtcacgttagaacacttcttaatatccttccagaatatatcttgaagtttatggaagaactccgcccgcttgtgtggtttcttactaatccacatctccgcatgttcctgtgtgatactcttgatagagtccaggtggaagtacttgaccaacattagcttggcttcgtatgcgtccgcatgacgtggtgcacaccaatccggggtactactcaaaatagcagagactcgttcagcagtatactctgcggccgagctatcaatcttaccccagctttcactgaagatatcgatagttgctccctgatccagcagataataccgcagagtactgataaagttacgggactctagttcacgacgtttaacatacagctgctgagctaattctagccaaccctcatcgatgttatactgctccgaacccgcagagaatccgctggtggacttatcgatgaaatagaagatattcttagctccccggtcgcgcctgattgcctggaagcgcatgtttggcgcctggttagcggtacgagtaataacgaatacgttgtcgaagtaattaaagtcaacaccactcgttactgacggactgcacagtagacaatcaatctgctgttcaattaactcattcgttgtataatccaagatacgacgaatatctatatcagatgtagagtttgagtgaatctctttaacaatcgcacctgtattgtttcttagcgtcaggcctttctcgtttaactcatccggcccacagtcggacaccagaatagatttctctcccatctctagggacgtttggagggcaacccaaatactggattcatcagggaactcatacgcctgagcatccgagagcatcttacgatggtgtttataataagagaccggcttgtcaaaatctatgagagatccatatgcctcaatggtttctgcgctgatatccccgtcagacaggataacgacttttgcagatagcagaatttcacgaagaactgagatacactcacgacgttgtttaacaactggagcaaataacaggtcattcataactgcgtcgcactcatcgataaagataacatcgatctgcccaacaaagtttttaaacttgtggattgagtgaatagtagtagacatacgatcaatggcaccgcgcttgaagtttaacatatctacggacttatcatactgtccggcttcaaacttcttagcgttagatgaaaccagggcacgggtgttagtaactgcaaggaaattacctttcagctgatcacgttctagccacttcgtcactgcggtggttttacccgtacctagagaagccttgataaacgttaaatgcccttccggtggtggacggttgatcttcaaataattcatcccgtctgggctatcagaggtcaacttgtgtacaggaacgcctttaacattcgactcaggaatatctcgcatcgagttgttcacaaacgcttttaatgcctgcttacgaccgttattgaagtaatcctgaagactgcgggaattatccttcgtgttgatataatcggacaaagctgaggtaatttctttctcaagccaggcgaaatcaacaccgtcctccagagctctgtggtacagtttaggaataatacgcagataaacaccatcctctgcttcttccagctctgcaatggtttgttccactttctcagaggctacgcgcttgcctttaatctgattaagtagggatagaaactcttctttaaattccccacgagtggcttcataatctggcatagtattgggcagttcaatcctagcaccgttaactttaaccagacgtggcttaccctccgctttaaacggatcggtaaactgatcccggaaaatcgggtcagcgaaatagtgtagctgtacagatgaataataagctaagtcggcaatatcaaaaccatacttctgccgagagctatcattgagggacgtaaatagaaactttaactgaccctgagtaacgggaatattactctctaatagcatgtgcatacgaatccccggcttaattccagccgaagacgacgcatgggcaataaaccctgcgttaagcgggaacatgtcctcgctgatgctatttaataacttaatgacatgacgtcccatacccacaatgtcaaacctgtcgcatcctccggtatcagagattccatcgacgtccatagcaataatattgctcttatggtcgattttgaagttagtacgtttacgacgcacggccttctctgcaactaagcatgtacctcgtactgctacgagatgtggatcttgagtgagctgaaccatcagctcatacgcttcattaagatttttggggtcaactgtatccactacgttaaatttgtagggcattgaggctggcttaccttctggatgctcgttagaaaactccttcgcaaaaaggtaatcagttgtcttcacttccttccagtttccggaagcgggatcgcgggaaaaacccgcgtgtccttctagaatagaaaacattacgttttctcctatgttgaagaataaagcgatctcgaactatcaaggatagaacagcttaaaagtccactgactcaacaaatttccttatagatggaggggtggtcacttcctcattgctagaactggccgcttcgcacaactcccacacagcatgtaatcgccgctaagctccatgtggttgacccctattcgtcgctattgcgcagaggtacgttgctacttacagcttcacttcttggtcatttcagaccgcggtgctatttgctccacatgactaacgaacaaatatctgagagcctcgcgatgccaacctctcttacccgcattctagatcaattatctataattccgttcggaatcaatttcccaataagccaaacccaaccaagcatgtagcagccggactgttctgtatgctcggaagtgaatgagaggaattatgtcagttttgtaactcacatcatttctctcaacctatgaatatattatataaaaatcgtggcgagattgcaagtaaaatatttaaatacgtggtaggtaactgggtttaagcatagaaaagaccagaggataatcccctggtctaagcgttcaactaggcattccaacccataatattaattgagttagaagaggcattttgtttgccctcacgaagaacctctggagcatacgtccaaggctcatcagctaccaagaaccccggagaaatacctgcccccggttcccggaatgctgcaaaattagaggggtggaacacaacgttgttcaccagaaccattagccccagatccgagaggtcatcccaatcaaagaggatctcataatcctgggccaaactacctttggacaaaccaacacacacgtcatgctggatgatgaagcaaagctcctcgtccctcaacgcggctcgcagcagattctctgctacatcaatcaattccttggggatatccgcccaggagatacgttccattttaggaatactcatttagttaacccttcaacttggaaaccgaagcgacgcagcacctggatccaaccgttaatattttccggagcataataatcttcattacgtccgacccaaatacctgctgaaacacctgtaaccccaaccgggatataggactcacgcagcagacacacgtagcctagtgcaaacaccagccccatctcagtcagatcgccccagtctaggacttcatcttgatcttcgtccataggaacccatagccccaggtgcatgttgtcataatcgaagtagacctccatattatcgcaccacacacgaagatggtccagcagagactcttttacgtccagaggaatttcagcccagggaactagcccaaccccttgattaacaaccttttcattgaccagcatattcttcccccatttggatgaattcgtgccactgctcagagtccgctcgtaaaacctgatagtcgtccgataggtgactcatatcttgtacatcactgcgataacaccaactaccgttgggccataacaggatatcatcgggatggtacataaattttctcctccagccaagcctcaacttgacctatgaaatgtttgttgctaaatacattggcagcagtatcataccaaacggggatcccgcgttcttcgtacaaactctgctccaggtagttaataccgttgttcactacccacaccttagtacctcgactatgggctgggaatagttcccaattaaagtcgattacttggttactagcaccaacaacgattaccagatcctgggttgtcagggtatcaaacaggttgatctgccccatataccacggagcggtttccccgaagaacgtaattgcaggcttaacccactcatacttacggtaatcaaccgcagtgtacccgatatcttccacgatcacatccttacctcggcgatacattatctccgtaaggtagccatgagcatggatcacatcatcatggggaatgccagcacgctctagtagatcatccacgttagtagtaaagttaacgacttgaccagggaagcgctcataccactcagcaattctcaagtgagcaatgttaggctccaccgtacccagctcctgtcgccgcatgttgtagaactcatgggttagctcgtacaggttgcgactaggctcatcatcagatccctcagaaagggcttctaacgggggcatagggtcgttcagatagtgaaaccccttatcgaacgcctgaatattgcatacttcggttagtttgtatttatcccacaggggagtgatggcacccttacggaacgttggcactcaatccagcaccacttacgataatcaatctacgcattacaggaactccatatagtttctcatttcttctttccgcaactgctcagccttttcggacaagcactcagaggttctgggatcgactttatctttccacaagtggttacggcatcgcagaagttttaccacgtcttctcgggaaatagatccgtatgctccagagtccatcataaagtagatacgcttttcatcagttttatggattttcataaatcctccgtttctcaattacaactatcttatcaaaaacggaggtatttagcaagtgatttatttcaaattcatgtgtttgaccctttgcattacttcctgttgcttaccagggttaaagggtctactaccaggactacctaagtacccacaaacgcgacgggtaaccgagatattccccgacccacattgaggacatacaaagccgtgctctccggatacagactctcctagatatccgcactcttcacattcatcaactggaatgttaacccctatgtagtgagatttacttaatccataatcaacaacccactctagtgcagggataaacttacgcatctccggaagttccacaaaggatatattacccccattggcgatggtggtaaaattagcctcatagtcaaacttcacgttaggggcaacttttgtacggacatccaggtggtggctattagtcaggtatcccttatccgttagccagtcgtactcagggtactgttcggcaattttagtattgaacctattgcacagagactcactaggggtagcataaaggctgaatccaagattagtttcctcagcttttttgttacaacggtctttcatgtggttgagaacctgtacagcaaattcaatcgcaggtggggacatggggtcggtatcctcaaacattacttcaaccagctcgttaataccgatatatcccaaagacactgatgccctgccttcaaagatgggccatacaagatcattggctttcaaccgtaccccaaaagctccgtgcatatagagaattggtgcctgtttagcacgcacacgcttcaaccgctcaatagcccaatcgtgggcagccatcgctttatcaatgtattcgtccaacaacttccagaacctatcgaagtatccctcagactctacagcaactagcggcaggttaatggatacaacccctaggttattgcgccccgcagtctccccggactcaatagctgaaaggaaagaccgacaacccatagggaacttaaaatcacctgtaacagccgttactctttcataactcacgtaatccgggtacatcctcttagaagtgcaggtgagcgccagctgtttgatatcgtagttgggatcgctgggagatttattaagcccctctttaactgcgaaaataagtttaggaaatacagcagtatgccctgaagcacccaggcctcttatacgaacttccagcatagctttctgcaacatgcgtgcctcccaggattctcctagaccaaacccaaatgtcacaaatggctgctgaccattagagttgaacaacgtattaacttcgtactctagcccctggcacgcatcatatacttctttttctgtcatttcagtagcatacactgctgccttcttactatcgtgaagccaacgctggccaatagctaagtgcttatcataggacttacggacatacggggcaaagacctcgtcaatacgatcgatagacgtacccccatactgacacgagcttacctgggcaataacttgggcagttactgcagctgcagtagagatagattttggagtttcaatctctgctccaccaattttagttccattcttaaacatccccgctaaatctaccaggcagcagttagtatacccctgcgctcggtagtccatatcgtgaatgtgtatctctcctctattatgagccgccaataggtatgctggaagctcctgtgctaccacatacttagagacttccccagctatcatgtccctctgtgtagggaattgctcgcttgccttattggcattattaaacataaggtcttcttcaccctcgttatcaaggatactatagatattatcaatcaggtctaattcgttcatatattcctccagttaggcatatattataccaaatagacacaactatgtcaaccttattttattataatcaacagtaacttgatctggatcatcaaaacaataaaaactggaaaattttatttgcttattcaccctattttatattattcgtgtgcgcccgcgcatcgcgcgaataaaggaaaggatccgtcctccatatcatcctagaaaatttcagttgcaatccacgccaaaacttggtatactggtattctaaattgataaacatggtcgaaatttgaccctctgtagacctctaaggagatcgcaatgagaaaagcagcacgtcgtaaggagtcgcgccgtaacggtagcgcaaaacgtgaacgtcacgaaaacgtcatccccgttgattttgaagcacgggaacgttttcaaccaaccgcaaaagaactcaagccgaagaacgctgagcaaaagcactatattagcaccatccgtaactttacggtgacagttggtattggagaagcaggtacgggtaaaacgtttatcccatctgttctcgctgctcaagagttagcaacgcctggttctgtgtacgagaagttcatcctagtccgtccgaacgaacctcttggtaaatccctagggatgttgccaggagatctgaacgagaagatggcaccgtggttagaaccaatcgctgacggcttcaagtgggccttaggggaacgttcttatcaggggctggttgaacgcaaggcaatccaataccttgctatcgaacatgcacgcggtcgtaccttcaacaattcttatgtaattgttgacgaagctcaaaatatctccgtagaagcaatgaagtgtattctaacccgcgtaggtcaggattgcaaattagtaatctgtggcgacgtagcgcagaaagacattaaatccgactctggtctgcaactgatcatggatatctacgatcagtacgaacatgtgcctttctccttagtagagttgcatgataacgtgcgttccgctgaatccaaagcattccaggcaatctttaacgatatgggaatctaatatggttactgaactgatcattggttatggtgagggtattacctctgaagaaaactggggctttgtaggcttcggtgaaggtatcacttctcacgacgaacgtcctgacctctaactctaggagcgcgtatgaacaacgtatttacactgaacaacttccgcactcgtaaaacgaaagtgcatccagtatccctggcaacagtcaataaatacaatgctaactatcctgaggatgagcggcgacaccatgccgctttcaagatagcaaacgaatttcctaaccaacccctcggtactaaagagttagttagtcgaatgaaaaaattacacttttattaaagtagaccgacacacaggcagcctcgaaaggggttgcctgtttttgtctgtaaaatctcatttgcaaaatggccgaaaacaaagtagaatatcttttaaatcctgacaacttccaaaaggagttaccaatgacccaacgtattgaatacgttatcaagcgtgacggtacaaaagaaccgttcatggcccagaagctgaatgactgggcaaaatacatcggaatccgaagcgatgttccgtggtctccggtagcggtagccgcagttaagaacctgccgaaaggtgatgtacactcagacgatctgcaaacaatgctgattaagtctgccgaatcaatgatcgagcgtgatcatcgttacgaccgattcgccctagagctgcgtttagcccagctccgtaagaacctgtttgattcttacaccccgccgtctctgcgtttcttccacgaccacatggtagagctgggagcgtgggaagatatgagcggctggatctctgacgaccagttcgaagctctaaacgaagttatcgaccacagccgtgacgaactattcactaatgctggtctgaagcagttcatggataaatactctagacgtaatatctatacggaagagatctatgaaactccgcagtttgcctacatgggtatggcaatggcaatgctttctcaacctcactggagtatgctcgatgcaatcgacctttataacgcgctgtcgctacagaaaatcaacgtcccaactccgccgctcgtgggccttcggagtgctgacaggggcttcgcttcttgctgtcttgttgatggtactgacaccctggactccattgacgcagcagagcacgtcgtcttcaaaatggtcgctgcccgagcagggatcggctatcatcttgagagtagatcaattgctgatccggtgcgaaaaggcgcgttcccacactctggaaaactgccatattatcgacacatcgaccgctccgtaaaagctaacactcagcagtcccgtggcggttctgcaaccgtttacactgcgttcttcgatccggaaatcattcaggtaatggaagctaagagcaaccgttcccctgatgaaaagaaaatcgataagatggactacaacctgaagtttaacagtattctcctgaaacgcttcctgcgtaaagagaacatcacactgatgagcttcctgtacgctccagaagtatacgcagcattcgactctggtgatgtagcagaatttgaacgcctgtacatcgcagccgaaaaacgtctagcgggcgttaccaaacgtggtttcaagggtgaagttctccctgtagccccagtgattcctgccgcagaactgattgagttctggaaaactgtacgtatggaaactggccgcctgtacactatggacgctggtgaagtgaaccgcaacagccgttacaaagatccggtgcgtatgtccaacctttgtgttgagattgtacagccaacgttcccgatccctcacgtagtagatctgtaccgtacagacgaagaactggataaaatggatgtttcagagtatggggaagtatctctgtgcaacttaggcgggttcgccctaggtcgtatcaaaactctggaagagtgggagaagatctcttacatcctgttgaagttcgttgataccatcatcgagattcagcactatccgttcccagctatgaagtacacggcattacgccgccgtaacgtaggtattgggctgatgaacgccgcaggagcgatggccgctgaaggcctggcattcgaaggcgaagaagcccgtaactggattcaccgtgaagcagagaaggcatcattcttccttcataaagcgtctgtacgtctggcaaaagagatcggcccatgtgaatggttccatcgtactcacacttctgatggtacactgttaatcgatacttacaagaagactgtggatgacctggtttccgtaggtctggaaatggactgggagagcctccgtgaagagatcaaaactcacggtatgcgcaactctgttctgacggcaagtatgccgggagagtccagctctgttctgattggtgttaccaacgcagtagagcctcctcgcagtgcggtaactatcaagacttcgggcgttaacaaagtaattactgtagctccgggtctagacgattgggacaccatgcagtcctataagtatgcgttcgatattgaccgtactgagcacattaagtggttagcagttctgcagaagttcacggatcaggctattagtgccaacctgtactacgactttaacaaatatcctggaggtattattccgggtactgagattatcaaagatctccttaactccactaaatatgggattaagaacctctactacgcaaactttgacgtagataccggaggctctgcagcagagcagggttgttccagtggcggttgtactctgtaattaagctcgatccaaccgaaagcaaaattttatttgcaagtaggttggattttttgttataatattcgtatattaaatgagagaggaaattaaacaatggcaacagtatttaaccgcgaatgggatcacactgagtctaaactattcctgggccaagacctgggaatcgccgactatgtaaacgttcgctatcctcgtttagaggaacttgcattactgcaacgctcgcagttctgggttgagactgagatctccctggaagccgataagaaacaatggcctaatctgccacaacatattaaaaacaaaaccctgctgaacttagcctggcaaacccaagccgactccattatcacccgtgctccggaagatgccattctgaaactggtatctcgccctgaactggaaggtatgcttattcagtggagctactttgagaatattcatagccgtgcgtattccaacattattcgtaacgttctccctaatccgggtgagttcattgcaaccgtacaggctaacgacgaagcattcgcacgtctagcactgccggtttctgttattgatgagttggccgaaattgccgacatttggctggacgctagagccaatctggaaatcgctgagaaggaaggtactctggaatacaccgaagaggcagacttcttagcacttactgaacaagtacagcagaagattctggagttctactacgctgtatacgctctagaagccattatgttctacgcgtcgtttgcgtgcacctttgctctggcagaaaacgatatcctaaccggtattgcaaagaacttacagctgatcgctaaagatgaggcactccataccgttatggctatggaagttctccgtattcttcaaaatggggaaattcccccacatgtagtggcagcagctcaggctaacgccccgaagatcctgcgcagtattctggagacagaaattaactgggcgcattatattttcccggaaggcgaagatattccaggcctgaacgccgatttgctggtagagtacctgtactacaacgcacgcctggcatttatggcgatcaacattccgtggccggaagatctcccggtaattatggaagacccgattggctggatgaaaggttggctgaacaccaagaaccagcaagtagctccgcaagaagcacagattaccaactatcgtgttggtgcaacctctcaggctaacccggacgatctgtctgatgaatttggagagttcctgtaatgattacagctttatacgcaatgcgagttgacgccgccttcgggatttttaatccggctacaatggatgcctacggggaacttccctggggctccattcccgaggagctagaacagttctacagaatcctggatacctatcaggttgttatagtgggccataatacctacgaaacagcccctccacgactgaaaaaggcactggagaagaaatccatggtgtacgtagtaggttctaaggctccagttctgataaaaaaccctccccgtaatgtgcggtttattacccacttgggttccaaaattcgggacttctgtaatgaagttgaggtagtctgcataggagggaaagctctgctagaaaccctagcaactatgggctgtctggatgcgatttatcgctccaccatttatcctaaggccggtacagtaccaagcctagaccacatcatgtatctggaacacccgatacttacgtccactcctccggatgctgtagtaactcatatagcttctggggaaaatgagcgctatcgttttgttatggaaggagtctatctgtgattcactatattaatgaaggcaaacgcattcttgaagaaggtgtatggctggagaaccctcgaacgggggttcgttgtttaaccgtaatagggtcaaactttgaatatgatgtactcggaaagaaattcccacttatcacaactcgtaaagcgtatgctcttcaggccatcatggagcttatcggatatctgcgaggatatgattccgcagagcaattccgtgctatcggctgcaatacgtggaacgctaacgccaacgaaaacgaggcgtggttggtcaaccctaacagaaagggaaccgacgatatgggtagagtctatggagtacagggcagaacgtggcttcgaccggatggttcccactttgaccaactctataagatctatgagaatttacgacgaggcattgatgaccgcggagagattctcaccttctggaaccctggcgaatttgatcaaggatgcttacgaccgtgcatgcatacccaccagttctcgctgctcaatggaaatctgtatctcgactccttccagagatccaatgacttcctattgggacaagcctttaacatggtccaatgctacacgtttcttgcgcttatggcccagatcacagggaaccgggcaatcagagcaaaccaacgtatagtaaatatgcacatctacgagaatcagtacaaggttctcatggaacatgggcaatttgaccgcaaacctttcccggctcctcgtctagagatcaacccggagataaaaaccctagaggacgtactcacctgggtttctaaggacgactttaaaatcgtggggtataagtctcatgaccctattgcatatccgttcactgcgtgaggacttatgggattatttaacagacgccccaaaataaccttctccgaaagggaggagtctcagctgaagtttctggttcaatcctcgggattacacatagatgttatcctagggatggtaaagtacaagggcatggacgcactaatgcgtcagtttgcccctaaaccacctaaagaaaaccctccagccaagcgggactataacagtaatttactggttcctccagctaaattactataactaaggtggccttcgggccacttatattaaaaattcatttgcaaaccacgtgaatttctaatataatagattcataaatttgagagaggaaataaatatgtcttttactgatgcaaaagcaatggcagctaaagccaaaaggtctaacgatatggcagttatagcagctcgcagatctattatatcaaatattgatggatcagcttcttcaggtaaaacagaagtagattcttacgcattgaatggcctgcctatcgccgcacggtctcagattatggaagacctaaaggacgcgggctatgaagtaaaagtaaatcatccgtttgaccaacgcgatactgaatcaattaccatttcctgggggcacgcataatgtttcatgtttatactgatggtggttgccgcggtaatacccgtggggtagacaacgttggtgcttgggctatggtagtttacaactccagcgaagagcaaatcggcaccaagtctgctcccaaacgcaacacaactaacaacgagatggagcttcaagcagtcctagaggctctgctatggtctaacaaaaaccctggccgaccaatgacaatctatctggactcaacctacgttaagaatggttgtgagtcctgggtttggggctgggaacgtaaaggctggaagaaggcagatggtgatacacctctgaacttagaccagtggaagtggattatcgacgaactcaagaagtatcgtctaaaccacaatgagatcccaactttcgttaaggttaagggccactctggtgtagaaggtaatgaggccgcagataacctgctaaatgttcgaatgaccgaactggaaatggaggatatgtgatgttggagaatttacgccgcctagttagtgaaatgaaatatgaagtgctcctgatggagcctggtgtggatcgagtagtaatgaaattgcgaatcgcacgtatggaagcccaaatctttgaagcggagtggaaagctctgaggggtggagatgaattataatggcaccagatttgagggatttgttcccaaacgtaccacagtaccagctcgatctctacgccgcgtttctggaagcgtcaaaatcggggaaccctctacgcgtctaccgccaagaccgcaggcacgggaaatcctggatcctgagatggctgaaagagaacgagccgctcttaaagaaattgagcgaaagaaactctgtacagcaccggcatacaacaaaggtgggtaccagtacatcagctcagaagagcaggcaaaacatatcgggcggtaacagatacgagttcatcatcttcgatgatcttgtagatgaaaatgaaaaaacgcagttgctaaacgctaaaaattaacgtataatagattcataaattaacgaaaccaatcaaaacaaaggaaataaatcatggctaagcagacctctaaaaaagcagtagaaaccaaagttgcaacttttcccaaaactgaagcgaatcgcaaagcacgtctggagcgtcatctgcgtaaacatccggctgatactcaagcagcatcagctgtaggcaaaccggccccgcgtcgtaagaaaccggtaactaagggttctacctccggctacgtctccaagatcgtcggttggagtacgccggataaggcagacaccaaagaagtcctgcgcaagacccagggccgtttcggtagcgtcaagccgaatatcttcggttgcgaatacagccgtgagaatgttcgcgctctgtgctacggcgtaggtattaaatttacgggcaaggcaaataagccccgtaatcaaaaacgcaaaccagctaagaaggcataatgcgaaattttgtagctaaaaacgatttcaatcgtgcagcgacacataagtcggccctagattattctagggtcaactcccgggaactgatggattcgtgctacgaagaactcgaagattgggcggctgactggccgtcgatggaagaaaactgggatgtgtccgaagatatgactaagccaccaccggaggtggcttctaaatgtgataacacatctagaagcaactttaataacaaaggaaacaatatgcaaaacttacaagaccgctggatctctgtttgtgatatcgaatccctgggaactccgggagattgcaagagcacctttatcgctatgccgtttttcgctttcgtactgatgaaagatctatcgttagatccgtatatcgttctaggcactcctaacgttgcccagcagttggccctcggtgctaaagtctccgccggaactattgcattctggatgaatgaggctcgtgctggtagtgctccgtcgctgtccattattgaagctctgaacgctaaagacggtgagtctactgttctggtctgcaatccgactcatgaatcaccggtatccaagcatacgttcatggatctgatctgcccgttcgtagaggcaaaacaggtaatcgaaggcattatcgatgagcaaggtatcgacactcgttccctgcgccactacggtaatggcccgcagttcgatatgtctatttacgaaacagtggcggctcaggctaatgtcttctctccgtctgatcctgcaatcgttccgtggaaattctgggatatctccagcgcccgtaacccgcgtgactatttcgaggctctcggaggagactggaaagcattggtacgttgtgctgaaatctacgcacacgacgtaatcgagcgttacaacctgattcctgagggggtctatccgtcgaaacatgatccggtgtttgacgccctggtagaagcgtactgtattaaaactatcgaatcgaaattgaaaatttgatttgactaaatggctgatttcttgatatactattattcttgaatcaaagagtaaaggagaaataatgaaagcagccattctaatgatctccatcctcactagcttccatgcgcaggcaaagattgatgcgcatgagatagagtgcatagctaaaaatgcgtactttgaagctagaggggaaggagttaaaggaatgaccgcagttgcacaagtaacgaaaaatcgtgttaactatggaaaattcccgtccacatattgtaaagtagtctatcaaccagggcagttcagctgggttggtaagaagaaacataaactcgatcgtaaagacgaagagtggaaacaagctaaagagatagctagactagtttactatatggatcttccagtagatccgacgaagggagctttgtactttcacagtaaagatactaaaccttactggacaaaagacaaggacttcaaaagaacaagtaaaattggcaaccatgtgttctataaattaaaatctcagttgcctaatgcttaaaaagttgatataatagtttcataaattagagagaacagcgggccgattacgctgaacttgttttaatgtaagactcgtcgagcattaagattcgttgaatagaatcggtgagttaagagtgatcacctgacaaagttcgtgcatccagtccggataccggccagggagcgtattggacgggcgtaggttagagatctcttgtaaaactcgggagctgtcccggagtctcgtaaactcttctcctgatttatagaaaatggtggaatctcactttaacctgttcgaccagaatgaagcatggtgcgtggcctgccggagaggtggggagctgagcctgagaaactcgtatagctcccacactgacctgcctaggccgcaaattggagacatgtgtatagcgtctggtgctagttattgccaccatagtggggtgtcgaaatcacttatgtagcaacactgccgtcctaagttaattggtagacttctgcacgcgggggagctatccccagatgcggaaagtgcaggttcgaatcctgcggtcggaaagagttagataactgatggttctattggcgaaccactcgctgctggagtacctcctcccctcccagggaaagacttgggagactcgcgggaacgaaacagctaaaccacgaaggactaggatgctgatttggctacccttacctgatatatgcccaaatcaaaagaagaactttaggcggtagcctagatagtgaagtttttcctccacgaggagtcgtttttcaagctatcaaaacttcacatcgaaaattcggaggtgtgattttaacagaccgcgtggaggatggctctccagaagtgccaaagttagtccttaaatacggcatgatgatcgtatgaactttggcgaggtgggatctcgcctgattctaagtgggaaagagtattcggatagccgttcgtacaaacggtggctccgagacctaagtgggacacggttgagtatacagctccgcggaagctcgtataccctgtgtaagcatgtgacaatggagtcatgaccggagtcaccccgagcgaaagcataaccactatttatagcacccttacacaggctagaagtgcccctgtttggagtgtgccctcgcctagaccgcattagccgacggatatccgttggccgggatctggcaaggtatattagtcaccttgactataactggaagatacgtctgacagaagggccgcatagcttaaacaggggaaggcccctacctactggcggtatctttaagagctttcacgagagttcttaaagatactaattgacgaggtctatatgaacgatttaagtatgttaactaagatacgctctgatattgagtctatggtctctcgtcgtagtgagctgactaaggctaaacagatcatcagcggtggtacacagaaacgcttcacattgcaagccggggatattaagtttgacctatgtggcagccagactcgagattacactttcgaaatgaaaccgtgttacgatatggtgaagctggggcttatcaaagctctagacaaacaaatagatcagtgtacggacgcaatcaaaaccctaaacgtccagttcgccgctgaatgcgatcgtctcaaaaactctatcaaggtataataatggtggcatctgtgcatactcctccgtatgaacgtccagcacctaatctgacacctgaacagaaacagctaatcgccaggcgcactctagagtttaaagagtcgctgcataagagcgttggccggtattctgaacaggttcatgatctggttgtcaaaacacttaaactttattaatgcttccttagctcagaggatagagcaacggtcttctaaaccgtgggtcacaggttcgaatcctgtagggagtaccactttaatcgctgcccacacgtaatattcagtgggcagcggcagaaagcccgcagggcgcagattaagattgattctacaaaatttttcttgcaattttgtcagaaattttgtataatagttctttaaatcaaagagaaagtagaggataaaatggcttacaaaattgaatatttaaagaaaggggttctcactgagctggttatcgatgcgaacatggctcgcaacgagggcactaaatccgtattctataaagacggtagcgtagctcgtatgatcaataccgaagacattcaggatctgtacgtgatctccgacgaagaagcaggtttcgtaaaagatcctgagccggctgaagatactccaactgaagacactccggtagcggataccactactgaagaacctccggtggaaggcactccggaagatgaagcagcagtataaataactaagggctagaaatagcccttctccttgggccggtagcttaaagttaaagcagtggcctcataagccaacgagtgggagttagagtctcccctggcccaccaatttcataacaggagactaaaatgtctactaaaaacgcaatcgtatccttcgtggatgacagtggtatcgtcctagagtccacagtaacagatatcagtcctaaacgtctgctccatcgtgatggggatatcctggaaatccttaataaacggtctgagactatgctggtcattcctgtaaatcgtcttctctcgattaaaatcgtgtgggaggactaatggacgctcaattacaaacccagtactatatgcttttaggcatgttagaggatgctggcccgacagtcagagggcactatgagcgtcacaaagcagcttttgaagccctactaaaagaagttaatgagaacgaaggtggtaaaggctctgactcctatgccgcattcattatcgcgctacaagttttcctaatcaatcaactcaagtaataggctaaatatgctgaatattaaacgtaaaggttttttctacaagtggcttaatttctcttccgcgtctttcacctaccggctgaacgacaacagagtcaccttgtgtagcctattttggcactcagtgtggtatttcctgctacagattggcgtaactgctattgctgtactcttctccttggggatgggaagtatcttatctacgttcttgggtctcacctttgagctgggaattactccctggtacatgcttgtagggttaagtctagcaggactatctacgataatagcgattctgctggcgatagctgggatcggctgggcctgcgctaagataggggatcggatccaggaatggaacgcgagtaaatcctttgaaagggcacagaaagagtataatgctcgcgatgaagagctccgcttcggtaatatctaccagaagatgcgaatctataagaaggacaaactttgtccgctcattcgtgtagaccacggcgagtagtttgcatagtgacctgcgttgccgggtcactaccaaaatacttgaaaaattcaattgctaaatgctctagaatttgagataatatttatattgaaagggaatagccaagtggttacggcatcggcctttgactccgagatcggtaggttcaactcctccttcccttgccaaatttaaaatgctcctgtcgtctaagctggttaggacaccactctttcacagtgggaacacgggttcgaaccccgttgggagtaccaaatttactgaaaaattcagttgctaaatgcttaacaaattgatataatatttatatagtttgttaaggaattaatctgatactgagccggaaccaaaaaacacgcttgcagcttgctcggtcattgtactgagggttcgcaagaatagcggagtggctctccgaaacgcctggtaagcgtagagtgtatcgtatttgtgaagagcgggtatcctcgcatggctaattgcttagggtattacgcgcaccggattaattgccttaacaaattattgggggatgggtctgctgggagtggacaccgcacttgcaatgcgggaatcagaacggttcaaatccgttatcctccaccaaacaaatggggatgtggcgaaattggcagccgcgctagatttaggttctagtggtgaaatatccgtgtgggttcgaccccctccatccctaccaaataacgggagttcgtgatgaacatagaaatcatgcagttggatcgtaagaaaaatgagttccgtaaggtccatacctttccgagtaaagaagctctagagtttcatattaagtgtatgggactggtgctaccggaaagcgagatcttcgacttagcatgtgctaacggagttctgtacgtctgggaaatcacgtatcatgctgatcctgatgaactccgtaaagaagtagagcaaatactaactggagagtagtgctcatgggagcaagctgacttgaaatcagtcgccatcggaaacggtgagggttcgattcctttattctccgccaaacaacaggaaagctggtgaaatggtagccacgcatcactgctaatgatgagtccgcaagggcatgaaggttcaagtccttcgctttccgccaaacaatggcccgacgagtaacggttgcccctttctagagaattttctgggcgaaaatccagaagtaatcaactagttgtaagtgggaagagtttcttagggccgccaaatttgagtatcattggtattgtaggagtcgtacgctgggactacgtagtacactgagtgtcctatgcccagtacgcggtctaaccaaatacggtgtgcgatgtgcattttatttgtggaggtctgatcagccctcgatggtactcaaatttgggatattatcataactggataatgacctcgattgtggatcgagtctatcttggttcgaatccaagatatccctccagattactgcaccattagtttaatggatagaatatagagctacgaactctatggttgaggttcgattcctcgatggtgtaccataaaatctctgctgagagtgacgaggttagccctctgggtcacatccctcttctagccgcctcccataaatgcaagcatttatgttctggccctagacacaacgttgtactcagcagagtgcgcataattggggtatagctcagtaggtagagcggaggtctctgaagccttaggtcacaagttcgattcttgttgcccctgccaattgcaccgtagaggagaggccgtcctcgccagtctcataagctggagatcgcaagttcgaatcttgccggagcatccaattctaggagaagatgatgagaatctctttcacagaacgagtactaggtactggagtaatgctaatcacttcctgggatggagatagctggtgtaacgtgacaggcttacgtaagtcagaacaaacacccgagaatatcgctaaaatcaagaaacgaatggcagaagctgctagtcgtcctggagcacctcgtaatggtaaacgttgaggtaactatgactcgctatcaaggtatgctaattaatacccacacaaaagagattgtattcttggcaccggcttttcacgacacctacaatgaagccgaggaagacgctaggatcgctaaaatacacccggacgaggaaatctgcgtccgtcagcaagaacaataatgcttcaatagctcagttggtagagcaaacgaccgataatcgttaggtcactggttcgagtccagttcggagtaccaatttttgccccctataggatatttcatcggaatatcctccagcgatggtacgtagtatagtacttacctgttaagcctagacaaagttactttgtgggcaaaataggtatagataggagaagaatagtagcgtaagattcttgaggcaaattctttaggtcagttggcagagatggtttatgcactcgcttcatacgtgagactacagtggttcgagtccactattgaccaccaaatacttgcttagctcaatcgggagagcatcgtctttacacggcgagggtagctggttcgaaaccagcagcaagtaccaatttacagtgagacttcggtcagggccgtcaaacgtccgagaagctgtaatttctgatggggatgatcccagattcgtaagaataccccatccttaccttcacaggttttagcgcaatgctgagtaaaagtctagggaatcgactccatgccatccaggagtataaatggcgaatctagggacttagacggtcattgccctagcgcgttgatgccgtgccggaatcggtatacggggcttcctaaagggcgtaagcagaacatccactctgcataagatacccgaaaacgaggctgagataaatggtctatcttgtgaaggttcgatcccttccggggttagcgtgtagtggggctaatcaatccccacgttaaacgttcaagttaagatttgttagttgcagaagcggggaggctatcaaccttcagtccctgaaagctctcagcgcttggaactctttcgtccgtaaggaatagatcccctttcgctttgactcgcaaacttcaaaccaagtgtaactaacagctgcaagcctggattaccgctctccggagcggataattcaaaaatttatttgctaaacgctcttatttactgtataatagttacataaattaatgagaggagttagcaaatggaaaagattactgcaactggtattgaatctgcactggtggttgattgggccggatgggacggagatcacgaatggatggtcttttatagctgtacgcttcagccagaactatggactaggcttaccgatgagcatgctatgccctacggtatcatagatgtagaaattgagattaacaaactggttggcaccattatggtgcatcgagccgaaggcgatcacaaggaaatcttccgtaaaagcattaaactggtagtttctaccggtgactttatttaacaattaactgaggaaatactatgtacacacgtcctactaatggaaattctgctgtagtccgcctgatgattgttcaggacaacctgtccaacaacatcgagtctctagaccgtcgtattgaggagtatcgcactgagatgctgtctctgatgcgcgaacgtgaggccaagatcgaagagcagctagaggtttgcgaagctatcgaccgcctggttgacggaaccgcagtatttatggcggaagctcccgcagagcctaccttcaccccggtagcaccagctgacatgcagtatgctattctgcctttccatctggaagaagaagatggcgaaggcccgtcgctggaagacgttgttcgcttcctgcttgcctccggtttcccgaacggaggtcgttaatggattttatcgttgtttgcggagcgaatactgactgcttcgagctgttaaacgacgccctagacaaggttgatgaacacatgcaggaaggcagaactcctacattcattgacctgtctcaaggtaaaacttacttctacccgtctcttgacgtagagcctacagttctacctatcttcatgcactccctctcgtgggacgaagaagacgattaatgaaaaaattcatttgcctagtactctgaaatttagtataatatttatattgaaacgaaagaggaaaagcaaatggaagatgaagttaaattgtacatttgttcagattgcggtgagttaagtgaatgtcattgggagtgtccgacttgtgagtcagacgacttaatggaatacgaaccggaataacaaattaagcggctatggtgttcagcggtcaacataccggcctgtcacgtcggagccacgggttcgaatcccgttagccgcgccaaattctctctgggctaagagatatgaccgtctagaggtatcctcggacacaagggtcagccctagacacaataagttagcaaatatctcgtttcgacgaggtatttgaagaggttcttacgagagcttcttcaaatacgggggaatattctgtaagtggtagcagagcggtctgtaaaatcgttgccattgcggctcgggtggttcgactccatcttcccccaccaattttgacaatcaaagagatccgggttcgaatcccgcgtacgcaacaggcggcataaaggccttgtagcttaaatggacaaaagcgctttggttgttaaatctatttgggagagaagcagtaagtggtataggcggtcgcctgttaagcgaatgacagtgagttcgaatctcacctctcccgccaattttactgaaaaggttatttaattaacctaggcacgcgtaggaatactgccaccgcaattgaaagatgtggcccggtttggagaggtatgccgctacacgctacggtgctaactccgtctaggtgaaaatcctagtcagtaatacagtattagggtaagaacagcgacttaggttgcagtgaagcgttagcaatcggtggaactccggtgcgccctaattaaacaatgcatcattggccgagtgactaggcagaggcttgcaaaccctcgaagcatggttaaaatccatgatggtgctccaattaccagaggtactcatgattaagtataaggcgtttgtaacaagagagtcccaaacaggagattcaagtattaaattcgaaggtacaacgttacatgatacatttgaagccgctttaacagaggcggaaacccatatagtatcgaaaagctgctatgctcatgtatgggaagtaaacactattttagatcgctagctcaatggttagagcactcgccttttaagcgataggttccgggttcgagtcccgggcggtctaccacattatgggacttcagctaatcggctaagcatcatagatagcggggaatcccggtctgtgaggggagtaacacgtagtctcccaagttccaccaaacatcagagcagcgtgatgtactgcaaagacccaaagaccggggtggacttcttgattcaaaggagcaggcacgaattacgcaactgtagctcagcgaggtgagagcactggtttgaaagtccaggggtcgttcgttcaaatcgaaccggttgcaccaaattaatagtatcaatagcttatggagctgaatagtcctaaagctcacggtaaagcagctggccgttagtgagcagacttggaaacgtctggtgatctctaggttagccggtgcgttggttcgaatccaactgatacttccaaatcccaagtagcccgttacaggctctctgattaaactcagacaagcaggtaatgggtgacaggataaaataagccactgatttccggccgtttgacgtggtaaagtcctccagtcaagaagaatttctgcgtgcagaaatcactgaaagcaatggggcagacaacttgagatagattgcctataacgtctcaagtagtggcattgacttagggtggcattttcccgaaagttcgaaaaattcatttgctaaacgctcttatttataatataatatttatataaattaatgagagggcttacctaatgaatcaaaaaattcttatgcgatataatccacgagctttatggttccgctgggaagtgattgtatcgtaccagatacgagtgcgtaacggtgatcctgagaacaacattatcgtgctggagacattctctaatagagatgcggcagttaagttcctgaacaccatcgacaatactttaatcaaggtatattaataatggatatctttactactcctgctatcaacttggtcggtgtcggcctattccaggcaacggtctatcgtattgatgatagcactgacgttgtaacgttcattgtaccggagttcttccttgagaagttctttgaagagtttgagcaattccgtgaagagcatgatgcttactccaatatggaagatctagcagcgatgttcccaactgtatacggctacatctttgaaggcaatgatctgcttttggataagtcagagctggtggaactcaactggggcattagctttgaagtgggctctccgttcccgcggtatttccaaggtctggagattcgataatgggcggctactctaatttcatcgagaattacattaattccgtagattcctggaatcaggaaactctagtggtagtgcttaaagagagattcaatatctctactctggaagccctagaggctatagaagcctacttggataacgattaacacccacttggtccaatctggtagaggcatgaggcttaagacttcagggttcccggttcgagtccgggagtgggtaccaaattatggggcacgactgatggggaagtcggcctggctagggttgagatacggttcgattccgtaggcaaatggtctcgtaattccgcacaggtgatggaaggttcgagtccttctcccataactatacaaattccccttagctcagtctggcagagcgggcgctttgggagcgtcaggtcaagtgttcaaatcacttaggggagaccaatcttgcctcaatagctcagccgggagagcaaccgccttgtaagcggtaggtcgtgggttcgattcctacttggggcaccattttcgctggttatggttacagtgtgattaagtttacattgtcattaaattccggttcaattccggaagccagcaaccctaaaaggtaagcatatgaggattctttccatagaagatgttatgtgtgacagatgctacggctccatattctctggtggctgtagttgtaagtaatctatctaatgaccttctgtagatgtaaaataaatatgaagggtcgatgctcgcggctaccgacagatcgtaatgatcaagtagtagtctgaggtgaagagactagcccattaattccgcgactaactgtacgggttacagcgtccgccttccaagcggtactgagtggggttcgattccccctagtcgctccaaattcggtaaaatgaccgtcccctgacgttacggggaattaaacaaggaactgggagccggtaaggccattttatcgatactacttgagaggtacaacaatgaaagcctttgatgcagaactagtgttctcactcttagctgagatggaagcctgcgtagatcgtgtacgtgcgctgcgtcttagtatgtttagctcttaaattatttgctgttctagagccaatgtagtccggggtgccgacgtctgcctggaactcgactctaggatagtcaggacgtcacttaacagccagagatggcaaactataggagaagcaaatgttaacagttaaggtaatgtcacctaacggtggcgaagaaattcacgatggttcaagcgttgggtttaatcctaagcagaagagcatctctattgctggtcttgatcagcatatcttcctgaaagaagatgaggtagcctacgttatgaatcagaatggtaagacagtatccgtctaccacggtagctaattttattccccgagtgttactggacagcacgccggtctccaaaaccgtgcagtaggagttcgagtctcctggggtttgccagtttaaaggagtgatcatgatcacttatagcaccaattttatggggccagtctccaacaattggtacatccgtatgggtattccgtatacggaagtaaccgagccgaatcgttttgcagatggcgggcaactaactcgaaaagtatttgccaaacgatatgccggtggtcgcattgacgttcgtggtactgatgactatttcggccaggaaatcggtgttccgattatggaggccgagtcttggaatgaactacagcagtttctctggacattctcgtccgataaggttctgacattggagcaaattgtacaggctctagaggacgagacaggttttcgcattgtttggtttaaggagccagcatgtacatagatcgtaaccaactgttcaagttcctagagcttgaccttcgttggcctctatcagtcaatccgggacgagctactggcaagacgttcgaggctattaatacagcctatgagtttgcagtatttaaaggtattcaagcagtatacgtagcatccggtgtccgtgaaatggcacgcctagagaagaagtataacgagcttcaacctcatgttaaaattacaacgtatagcatgttagaaccctaccgtataggtcgtcgattcagctgcatcatgtttgacgaacctagcttggctattaagtacggcgtaaacgcttacgtggttcgtatagccagagaaaaccagtgtcctgtaattatttttggagagtaaagtggaacaagaatttcaagtcttcgtagacgcctctaagagagttttattcatacaagccaccgatgaaggtcatggcctgcaactttccttcgactctctggagcaaataaaccagattgttctgagggcacaaaaatcattagaaaagaacactgaggcacctcctgacctctaaacaaaagccccttgtctctttgagcgaggggctttttctttataaattcacttgcaaaaatgccaattttgccgtataatagatttataaattgatgagagagatttccaagatgaaagtaacaatggaaaacacagaagagtttattgctatctgtactgcgtatgcagatacgcttccacctgagggtatggacgaccatacaatgcagttagtggcggatatctacagattagcagagttagctaaagaacaacacaacaggctggtgtacgtcaaagaacgcctcgaaatgatggataaggagtaatcaatgaacgaactcaatgaactgaatgaattgcattacgctgaacgtgctattgacgagctggatttcgctggtggttattatacccgacacgtcaacgcaatgaccgccgaagggcttaatagtaagtctgcgattgctgcggagttagcagttcgggactttgttattgatagtctccagaagactattagcaacttgagcgaaaacaacaaagctgctctggaagccctggataagctgtccaaccatcttctcgcattggggatcaaataatgaataagcaatctctacgtggtatccgagtatttcgctctagccttgttgattccttctatatctggggcaaggcaactcgacgcactgttgagcaagcactagacggtacgttctatgattggcgagaaaaagagcgaaaccccgtattcagccgcccagggctgtatcacgatcgtgtatctaagacagcgtggtacgaaattgaagtaactcctggcgttatcagagcgttctatacggattgggagcacgaaaagtgggtttgggacaatcagattgctcccggtgatcgtattatgaactatgccgaatataaagaaatgaagcgcatgttcgagctatacgatgttcctaggctgtctcgcccggctatcttcattgctagccaagagtactggcatactgttcgtatgaagcgtgattttaacaagcatcacctgcgctatgagaaagaacacggcacactgcgggaacgtgtggccaagagaaaagccgaactgcgtgaaaaacgcctggagaagaaatatggtgaaagctagtctcttacgcttcactcctggagttggcctccagtataaaattgttgggggccacaagttccaatacttcaccccgggtaagctctacttcgtcgagctacacgatagtagagcaggctacaaattacgaagcgacgcaaatgagggcatttgggtgagcttcacacaagttaaacgctggtttacagttgaaggatataatgattatgagtaaagttgtatatttcgtaaaatgctgccgtgacaccttagagttggtcgaccacaaaatgcagacctgtaaatgtggtgcttcctccatagatggtgtagccggagcctacgtccgttttctaggcgacaaaagtaacttcatgcgtctgaatgagttccagctcgaagttgaaaagaatcgaccggctctagaggcagaggctgagcgtctcaaagatttcgatgggaacatcgtagcatataacatggtaagcggtaaagacttctggtctgaactggctgaaaaacttaacatgccgcggcaggcggctaaggctttatatcatggcttcaactactcgccacgttggaattaagttttccaacagtaacagaacttacgtttaccgagtacctagttattggaaatactccccggagataggtgatgtagtagtcataccggggaatgttatgtttaataatcctcgtcgcgccaaagtagtagaagtgcatggtatgtatggtaagccagagtataaagaaagaaagaacatctcttatgtagagctgcatgattacttaccgaaggaggaacgtaatggacgataaaattgctcgggaagcaatagaacttgttcgtaaacgactggaagaacgtaatgtcgaggtgccgaaaataatgcttattggctacggcggcatcggcggatttcccagcttcactgacctagaaagaatggaacgagagtcccaagccagctttctagagttagaatcctacgctcgggaaatggaacacgaacatccgattggtaataactttatgccacgtagctcccgccaggaggttactcacggcaagactaattcctggcccactccgaaacgcagaggtagaaaatgattactacaggatttggatattctcacgaagaattgtgcaaaatggttgaaagcgctccgtttattaagaagttagtcgaagagcaacgaccggtgtgtttacatgctgcctgtaccaagtgtcacggtactggtgttgataaaaacggcaagatgtgcgtacatgcactgtcctgcccgtgtcctaaatgtagctggagctgttaatatggatctaggatattgtgtagtacatgaattcatggagcaggggttgccggatcgtatttgcgttgtaacctctcgtaatctggaagcagcccaatcactagtggagcgactctctggctactatcgtgaccatgaacgttaccagcagaaagtatttgacctgacaaaactgtaccatcaaaaagctctggatatgccaactccacagctggacgatctcaagcagtttagtcctgaggcctggtatagcgtcaaagacgccagtccggtagactataccgtacaggtattctcgcattatggtactcgtcactggataaaccgtaaatgggattccatggttgactaccttaattcggaactcgaaaagggggctgccgaatacaaaagaaagcgtgccgaagccaaagtattgaaaaattcagttgcattgtaggcgatttttcgatataatagttacataaattgatagggagagcttcatgagcaaactaagtattgaaagcattatccgcccgttaatgcacgggtatgtacaaggttcctgtgtaagcgaaactgaagctctcaatgttatcgaagaagagctggtggctaacgggtataatcttcacgaaggtgttatcgaggatctcttctggcagaccgcggaagatatggagatctttcggtgcgtgaattgcgggtggtggtgtcctgcttttgaaagggcggagaaccaaatagaggaaatctgccgggactgcgagccagacctcgaaggtgaagtggatgaacaagataacgaaggtgaagactatgagtaagcgttcaattgcagcaatcatcgcattcagtatgatgtactctggagtatctctggccgcagagcgtaacaaagtagagatctctgataacgggcgggttcgtgtaacaacgaatgggattactaaaggagctggtaagtttcgtaaatctgaaacccgttttggggaaactaagatctacacgaacaaaacctatggcaagcccgctgtgacactggaccgctatggtcgtcaggtagaagacgaggatgatagcgatgagtaatcttcaccccaaacttcaagagaccctagactggattaatgaagagtgtgcttttgaggaagctccttactgtgtctgggcaagagctggtgcagccccctcggagtggtgtactgtgtttgataatcgctaccggataacagttgaactaagcctaaaagaggacaaagtatacgctaaagcctctatgaccgcgctaggattatccgggttcgtggagatgcaagagctctgtatgcctaacactcaccttcgggttcagatcgagcagttggcaacaattcgtttgatgttgccggaagataacatcaatgaccatttccataaggttattgaaaatgaatacaaactacggcggcaacgtcgcaaagcacgacgggaagtagagaagactcggatgatgtgtaacatgaatccacacgtataacggtagggccgttataggagtcaccttcctgttcctatccggagtcgtgcccgcgatgaacgaagtggtgagttggtcgccgaccactaactaattcaaagacaaactgaggaagcaaaatgtttactttatttatactggcagtatcggcgtggatggcagttggtatcaatcatggtctggactctgctaagctgctgtcagctaaagccttcgagttcctggctaagtttgccacccgtaaagatatcgaggccatcatcgcaaaaggcggtgccaaagatgcatcgagtgtcctgaagtccttcgataagatcctagagcttcgtaacggtaagcatgccgcagagctacgctgtatgagtcgcaagaccataggcagactgtgtaaggccatcttcatcgtacagggggcgttgaaaggcccattcgctaagtataaaccggatagtatcaagcgagccaagatctttaacgattactgtgtggaacaccacccgttaaatcgctaactacccaagcccagcatcgaaaggtgttgggcttttcttttttaaaaattacttgcgctctcgcttaaaatgttgtataatagttttataaatgagaggagaactaacatgcgtattatctctaaattaaaggacgtatatgatctacaaggtactatgtatgatgcagaaagagcatggtatcgcgaagaagtgaaagaggttgtaaacgtatccgctgatttcgaacaaattattttctacgctgaaatcttgcgtaaccgcacttcctctggatatgggggtgttaatatgggaactctggaagttcgtccagtattgatttgtggtacactacgctggctgtacggttatcacactggcctaggagcagatgctgtgcatatccagactttcgatccagttaaggtaaaagaggtactggaagaacaaggatactacctgcggatgggttgggacatgaatacgattgagaagatcgacgctcatgttcgtaacgcaaccgccacggcttctgcgttcctggagactttcaacaagcccattgcgatggcatgggatgccgcaaagtctaagacagacccaacggttaatattaccgttaaaactgatttcaacttccatgcggaagatttcccgtggcaggaaattgatccaaacctgtatcgctggcaccagaccttagaatcatatatcttcggtgtgctgggtcaaggggaaccaaagaccgagtctacgtctgatcgtgatcggttaattgctaagggcttcgatgctaaagtttctttcaggaatatggagcggtaagactggagcaattctgtttctggcaattgcagcaggcaccttcgggggtgcctactacattaccaataagctaacagatatgtccagttctttacagtccctatcaaaccgtaatgaacaactagaaaagacagttggtaatctccaaacagagattcgaaatcgagatcgcaataccactacctacataaccaacctagctaagaaccaggaagatctggatgggcgtattaataaactggatgcagctagagccaaagagggcgtggttgccgctaaacctaaacttgctaccaaagtggcaaaagacaaagttaatgagttccaggagagactttcatgcgtaactggaaatatggactcctgctctcggctgcaattatcgcatccgggtgtgcagaacggccagacccaagtagcacagtaacgggggttgagccacagcacctaccgtggccagcaagcctacagacttgcccgtttaattttgagttcataaacgaagaagggaaagtgtatgttcgcataccttaccaagattggatcacgatgggcaagtgtaatgagcaggtctacacctacattgccaatctgactgcattaacgtgtacctatcgcgtgtcacttaatgaatatcgttgcaaaccgttcaataaggaaacaaaatgaaatacgttttaggattaattggtgatgccggcgcaggcaaagacacctttgctgacatggctaaggtttgggcctgggaagtcctcggtccggagtattctatcagtaaatttagttttgcagctccagtttacgaactcgcggctgtaatccttggagtcacgccagaaaagctggcagagcgcaggacaaaagagattaagcagtggttttgggtgactcaggaagcccttgagcgtactgctaacgtctggaagcgttttgggatcgacaagtacgccgatttctcttacgtttggcctcagtttgaagcgtcagcactatatccgttgattgctaagactgccccagacttttatcaaggtcgtgagaccccgttgtacccattatacacgtcccctcgtaaaatgctagaatttgttggcacggagttaggacgcgctctggtggatgagaacttgtggttgaatattgtggtagatcgtatcactgctaccaaagctgacattagtattatttctgatgttcgttttgataatgaagccgcgctagttcggaacttccccggtgcgcagaactctagtattcttaaagttcacgcccctaacaacatccacgctatccaatctactcatgcctccgctagaggtgttgcacctgagtttattgatgatgtggtaacaaataactttgacggactggaaaatttccgtaaaaatgtaaacgcattttgcgacgagaggattctctttatataaggtaacaatatgggacaaattaataacgtagagcagaaaggtggcaataagactcctaattacttcgcctccctagtggcgactaaggcagagtataatatttaccactatcatctcgatgggccgatagtcgatgtagactactaccgcgacctatcagtcactctggcaactatgcaagagggagacactcttaatctttatattaatagtcccggcgggtacgttgatacagcagttcagttgtgcaaccttatcatgaactgccagggaaccgtaattgggcacctggttgggccatcagcatcagctgcctgctcaatcttcctagcatgtcatggttggctggtgcacccttacgttatgttgatgggtcatacctatcgtggtgcgcactatggtaagggcaaaaatgagatccagcactatgctgatcagtttaactcgttcttcgaggatatgatgctagacctgtactacccgttcttctctctagaagagatcactgagatgatagaaggtggtaaggatatttggctgacctccaaagaaatcaacgaacgtgtagatcgtatggctgcgcaccgagaacaagaagctcgtaaggctgcgggtcaataaaactaagtaggccagggctttttagctctggcctttttctttatctaaattctacttgacatttgtctcaaagtatgatccgagcaataactataaatttttattgcaacttcctccaataaagggtataattataaatggttagaggaggttcttaatggataaatttatacagttgatatcgctgttactacaagaagcgaaggatccagcttctcttcttaaacgtttgctaaccttactggttggtctagttatctacctctttatagctaatacgagtgaagtcatgtcgtacttaaagactttctctacttcggcggtcctacaagatgttaaagtacaacgcacactagagtttccaaatgtggcacgagagaaggcaatgatcctattctcacagactcgagctgatgccgtcttcgtggttaaatacaagcctgaggctataaatgattaccaaactatcatagcttgggaaagcaacgttcagttggataaatccgatgtatccgacaaagcagttgacaagacgtctatgctctaccgagcgcatttagacggtctgaactttgcaattgatgcaagggaaaaacgaggtttatcgaagtggtctggaacgggtttgccaccgttcaagagtgcaaatttcgagtatgtgtacacgtgcccatattttaaccttaataacatctactctggatatgttgccgtcgcgtgggagaagtatcccctacaagacgaagacatgggtatgtttaatgactatatggcaaaaatctgcgcatcgccgcagagatcattagggagatcaatatgagtttcagatttggaaaccgtagtctccagcagctcgatactgtagatcctaaactcaaggctctagctattcgtgctctggaactctcaccgcacgattttaccatcattcagggcaaacgtaccgtacaacagagtgcccagaacattgctaatggtacttcatttttgaaagaccctagcaagtctaaacacgttacgggcaaagccattgacttcgccccatatatcaatggtaagattgactggaatgacttagaagcattctgggctatcgtcggtgcatttaaaaaggccgcaaatgagatgaacattgccgttcgtttcggagcggattggaataactctggcgactaccgtgatgaaatccaacgtggtacttatgacggcggacacgtagagttactgtaacattaaggggagcttttaggctccccttctttgtatggagcaagcaaataggaggtggttatgtttgcaagtttagtaactataatgctactcaagatatttcaattcggtatagtattcttttccgcaacatggattttaatacgcggtgccatttattttcgcagaacacgcttagctagggttgctagatggcttctacacttcgtatttggtattttcggtgtgttccgctgcccatgtgagaaaaagaggggaacagggttctgctggctctggttaggtctagagaattgcttctcattgtccttagcgctactatttggtatgatagtcctagctataacgctagcatttataccactaatgtacgcaggtggggtgacgtctatcctaacccttacttctcctgtgttgatgtactcagtataccccattacactatttttcgtaagacgaggcaagcactgcaattaatgaaaaattcaattgactttccgctcgatttagcgtataatatatttataaattcgagagaggagatacaaaatgtcagacagattctacactcaaatgtgcgagcattttaaagtatctccctacgagttaaatatagctttgtgggatcgtgaatcaccggagtttaagaaaattgctaagaaatcggagggtgttatgtccaacggtaagaaaatgacccgaattgaccttaacaatgcgctaaccaaactgctcggcgttaacattgagggccagaagctctctatgccaactttgactactattttggagaaagtcaaggctggagatgttaaaaaagtagcagtgcctgagggtcgtctgaaaaagccgtatcaggaggctataattgaggctttcggagaaaagctagacctggataccgcaaccgtaaaaacaatgaaagcactactggagagtattaataatgtctaagaaaattgtattccttaaaggttctagctgcgttccttgcaagcaatttgaaccagtttttgataaactcaccgctgagttcaacctgcccgttgaaaaacgcacggacgacgtagattccctacgtaagttcggccttcgcactgtacccgcagtagtcctggtggatgtggagaacggacgtgaagaagcacatcacattcttagtggtgccacgcttcgctctgcagtagttagtaaagctatccaagactttatcgactacgtagaagaataatacctaaccccggctcaatacgagaccggggttttttattatttgctaaacgcttaaaattttgatataatatttatattgaattgagagaggattacacaatgactaagcaagcatatcttatcctgaataatggttttgcagttggtactaccttcgttgatctggggtatacaaaagaagagtggcaagctctcgatgctgcccagaagaatcagcttgttaatgaagccgcctgggagtatgcagaggcttacgtggaggcggtagatgacgagttagttattgtcgtttcccttggtgccgtaggttgtgatgctcatgtacatacagacttccagagcgaagaagagtgggatgagttagatctaacccaccaaaatgctctgattaacgaagcgttctgggaagttgtagactgctacgttgcgttctgtaaggacgatgatgaagctaacacctgcactaactatggctatgaacacgacgatgtggagtgtgcataatgcaaaaattctctagagactggtcttctgatatggcccgtaaaaatcgagctgctgcctactataataagaaaatacagctcgataagttaataaagggtatcacctacaatgtagagaggggcttttctggtataaaagtagatgctaggagcctggactactcgtgcatactgtgggctaagcagaatgggtacgcgtttaaacgaataggcaatgagatactgattgcctgggaacccgaaggtctagtgcaatacgtaatatacgacccttatcgaggggaatatgtaagagatcacaggcagcagcccacagacttctcgctgccaaaacgttactatttagagacgaggtattaatgaacgtacatgaaacagttaccgtgcccgacaatgctaatatcttcttcattggggatattcatggcgagtacgacatgatgatgggtgccctgaaacttgcagggtacgaggaaggtcgtgactacgtgttctgtgtaggggatcttatcgaccgtggcccgaaaaacttacaggttctagcgaagttcctgtacaacccgaaattccgctctgttcgcgggaatcatgacgaattcatgatccaagacgactacgctaactggatgtataatggcggtagctggactatcacggaaggtttcgatacggataccatgaaaggtatcgcggaagacatggacagcaagatgccatacattatgaccgttgaacaccgtggcaagcgttacggggtagttcatgctggtatccctctgcgctaccaggctcaaggtatgggtgtaactgtaccggtgtgggacgacattgtgcacgaacacgaatctacaccagatttacgtcgtttgggtgtactgctgtgggatcgtgatgtaatccaagaagttgggtttaatctgtatcgtagtggggagaagcatccgtacttcgatcgctacgccagcttctccgaggagtgcgcagtcgatgtgcctgaaatcgtgggagtagactacacgtttcatggccatactggtgtcccgttccccattcgctggaagaaccgtgtctatttggacacaggtggcacctttaacggtcgtatgaccgtggcgtcgccggttctaggtcaattatacacattcaccacagatcgtgatgatccttgtggttccgctgacattatttaataggtgaaacatgaaacttttcaaagatctggaagaaggtgaagtattcgtagttgctggtggcttcgagttgcagaaatgtgtagcaatgctggacaacggaaactccgtgtttacagacgacgcgaatatctcggttactattgccccggacactgaaacctggaaacccaaagaattctgggagatccataaagatcgtccattggacgacctactggacgacattctattcacagcctgaggtaaatcatgaaactcgaatctcgttatattgtatttaagcagtcagatgccgctaagtatctaaccagcactgctattcgggagataaacgacagcttatccctgatctataaaggccgagaggctgacggcaaggtaggattcccgaactatatcgttctagaagaggattggccggagtatcctatcgctaaagaagctctagaaggacgtatcgtgctggaagagtttaataaaagggcggagaagaaacgtggggctaaggctgcagaagatcactataagcagcaccagtctacggaactactccggggtatttctccattctgtgcagggtggaacgactacatgagaagactggtaatcgaggagtaaccatgtatactggaatgggaaatgatatggccaagatgtttattggcctcttaatcctggctgcgttagtcggtgcagcaattgtaggcggaatctgggcgctcgtagcatttgtattttaaattcagttgcttccgagccaatttttctgtataatagctgtataaattgatgaggaagcaaatatgaaaaacgcaatgatcgaactgaatgcaaatatggaatcccttcgccacgcagttaacaccgcccgtgcttcttttaacctgctgatgcgcgatgagagcataccgctgtccgctcgtgtcaaggcatttgaggagttcgccgatgagcttcttcatatgggagactatctcagcgactccccgtttaatgaagatcgccgggattatcaacacgcctactgcaatcgtggggaaatagtttacctgaccgatgttctggagagtgtgctggagtatgcgaactctttcatgcgaactcctgacgaatgggaagacgcttcgaacgactatgttctagacgagattcaaaagaactggccagaaattaagaaactggtagaagaacacattcattctgaagtttacgcttaccggatcgattggtaaaaagtttaaaaattcacttgctaagtagttagaatttcggtataatatacgcataaattaacgaaacggacggaaatcattatggctaagaacactatctcttacaccactggtaaaactgctgacgaacaagctaacaccctgaccaaagacgaaatggttgcggtactggtaatcctgctggatatgagtgggttcgaaggtcagcttgctaaactgtctctcccggcacttcgtgctctgtacgaaggcactaacaaaaatgctgcggcctacaacctcgctaaaaatgaagcgcgctgggccaaggaacaccagcaggttgctgaacgtcgtgctgagagtttcgaacgtgacctgaaacgtgaaaaggcgaagaaaaagtaatggtactagaaattctctccgggctgttaatagcagccctagtaactggaacgggtctggcggtttgggtatcgatactgcgggaaaataaccggagaatgagattaaccaacaacgggctacacgagaagttgatggatcaagtacaagatgctgatgaattctctgctgcggctgagcgacttttagttcgcctggcgaagattgaagagattatcggccaagattccacaatgtcgaagacaaccaaaatgcggttgatcacggagattaagaaatgatctcaccaattgtagcggcactttacttagtagttgttggctacctgtccgggaagtaccacggcttcggtttaaaaggtactattaaggcagcaatgctggttcctctgtatcctctggcaattctgttaaccgggtactacgcctgtgttttaagaatctttggccggggcaaagttaactacgataactgcacagcgttgctggacgatattgaaaacaccattaagaaggaagaaaaatgaaccttaactccaaagaacgccaagtgttagtagatgctctgcgtcaggtagtagaccacgatttgctttgtgatgaagatatcgttgagtcaattgccctaatcgccaagattgagcttgctgagaaggactcatggcgtcctttgagtgagcttcctcctctaggcttggcaatcgtagtacaacgtgctgatggcgctccgtttaacactgtgatggttcgcagagatctggcaaagtcctactccccggatatcatcacgttgcacactaagatcaccaacgaacctttcgagtttaatactcgtcactattactggagactgaccaatgcttaatcagcttcgaatctataatttcctggattgcaacttccaggtctggcgagaactccccagccgtttcctaggctgggcattattcctctccatggtggtttcagtcttccataacgtcccagcgacgttctatatggaagcaattcaaccagtcactgtattcatttacgagatgtacctcgtagcaattaacgggtggaaagatggccgcatcaactgaagttttaaatcaatattttaatcgtgagcaccaagagttcagcgatctgttcatccagatgttcgtcaacgctaataacgctctggactatcgtttcttcaacgagttccatgagaccacgttcagccatcaggatattaactccgctctgaaagaactcattggctctaaagtgataccattccgacagactgcaaatgcagagacactagagcttagtgtcgtttggggcttgttcaagaaagcatatgagtttggcaagtatcagaacgcacgtcactggatttacgaggtgtatctaaacactgaagtcattctacctcgccaaatgatgttgggctggattgcaaaacaacgtcctgaacgcaatgcaaaatcattcgcaccaattaacgacgggaacttataccatgcaagtgaaaaatttgatgctccaaaatccgtggcttgatcgcctggcgcaagtagagaagatgcttctggttgaaggtctgaccgaagaagacatttgtctgaactccttctacaactgcaaaactcatgtaatgcaggcgctagacgaagaacgtgttgaactgagtaagtttatggtgaacatcgccacagctcaagttcactggcaaacccagggcttatccgccgacgatatcctgaaacataccctgaacgctattgcagagtatgggaaagctcgtggtgaagctctcttggcttcaaagaaagagtttgataaatcggagtcaatgctgaaaatggcaatcgatatccatatggaaggcatcgacggtactattcactaagagggtgacaaatggctaagaaacgcgttgtggtaaacttcctagaggaagattctggggactgcgagtacggttgctggaatactggctacggtgttgaggttatggtggatggcaaatgcgtccaccgtcaggaagcctgggcaagctgcactaacaacagcagcgtagactttgacgtattggcccatgttcttcagggcatcaagacgaaagaaggctacccggtcaaagcagatcacatcgactttggagatccttccgattatccagaggagtttctggatctgttcacctaacaaagaggccagggctaattgctctggcctttcgtggtttaaggatattaaatgaaatctatagacaactatttgcgcggggaaaaccctgtagatcaagcagcagttactgttgaaaaggtcaggaaagagtgttttatacttactcaacgtggaggtggtaatcggcctaatcgagtgtatcttaattggactcagtccaaagacctgtatgagaggttgaaaagggaatttgagtagtggaagaattaagacagaagataaatcaagagctagtatgggaagctaaatccttccccattaatcaattccttaaacgtgacggttcgatcaaccataataagataaagcaacttaggccagatttcaggcaagatgctaagaacctcatctttattaaccgtgctctagacgctcatggagtattcttcggatatgagaagctagtgttccacagcctaaatcagctggtggaaatatggtgtcccgaccatcaagattactttatgcaaactgctagaagccaccttgagggtaacggttgccaaaaatgcaggcaccgcatggttaccagagttacggattatggaagttacaccgtgccagcatactatcacaaattttcaattgacggagactccattatttggtataataactccagtaaattgataaaacctttggaggttaaagatgaaatacgattccctgaataatccgagcaccaactatctgactgaccagtcagtttctgagatcaagttccatccgaactactccccggactctagcaagccgagtgtagcagctatctccttccgcttccgcaatctgcgctttacgttcgttggagaggaagacaagatgatctctataattgacaaggttaaagcagtaagcgagctgtccggtagcgataccgttaagttcgaagcattaacctcgttgctgctgactagtggggctaccgttggtaagttcgaacttattcagccgcatgtttctgcactgaccaataccagaaacttctgggatcaagccaatgtcgagagtctcataaaatgggatagtgctactgagttctacaacaagtaagagggctaggatatgttattctgtacagttgattttgaagaagctaacgaaacgtatattgtctacggtatgtctgaaagcaaagtacgtatcctctggaatcagttccaattagaagtaccggacgacatatccaagactccgaaagacttctttcatttaatagatattaaggcagtaaaagctcgtaagaagctaactccttatgtgttcccaggtgcagtattcgtccatgagttaacagcgtatactaacgtggttctcaaaaagtctcgacagcacccaggctatctcacgatgttgacgtacaaagttggagctattcacgacggtgagctggtggttcgggtagatgcacgcttgcagcaagaagtcgaagaaatgattaggcagtgccaaaataaagcagaattaaaacaaagagcacgcctattcgacatggcagcacctagcgaggcagttgccgcatatcacggcttttataaagaaatagctgaatccgatgaagatttctttatgtaagaggataacacaatgaacgagaaatatgaagtatggactccggttggggagaattgtagctatcttcttcgtaccctgtgtactcgggaagatggcacatctttctcagaatacttgagtgaatgccacgctaaggcccagcaggacaacccgctatttaagatcagaggagaggatatcctcaaagttaacggcgtgccgtacacgccagtggacagtttcgccgctcttcaggtgtttaaggaacacagagagcgggagcaccggaggatgattgaacgcttgacaggtagagagccgttttcacatcctaggtggaatgaggagacataatgagcagagttgaaaagctacaacatatctataacctggttaagaaagctgaccaaaagaaactctcagagctgagtgaagaagagtatcaagcagtcctcttctgttgttcggcaatgccagcgaagctcgatggagtactggcaaagtcagacatccacaacggtaaggaaacaactttccagccgccgtataaatggctagcgtccaacatccagcaaatggtgggtaaagttacgggattctcaaatagaaagacgcctaacatctttattgacattactcctagaacccctgagtttacgaaggactggagagacgcattggattcatttccgtcatggaaagtcttttataaacctgacgatgaaacgtatgcacatcttccctttttgaagcacccaggctacacagttgaagacccaagttctggggttaatttcaaagacttcaagtgtactgacgagaacattgcttacggactcatgagaacatccgtgaggattgcaatggatcatgaactagacaaacaagatctagcagtcattgcactttgtaaggatcgttatattaaagttaagaggatcgcagagaaactttccgtactttcttgctttgaaacaatccgagattgtgaaccagagggtgaatatcctaaaggttccctctactggaaagatgttaaacatctaggactatcagaagaagccgtattcctaggcttagtagttacgggaagattcctgaggctacaggagaaataatttgtacttcgtctatattttcgctaatgaagatcagcggcttatccctaggcggaccaaggtgggttactcgcgtgacccattttatcgtctaaattcgcttcaacttcacagactacctcatcgtggattacaggatatcgttattcattctgtctatataatagatgacgccagcgagttctcagcaaagttgctagagaaggccgcgcataaaaagtttaagcctatgcgagttaatttcggtgacaagtttgatgggcatacagaatggtttgatgttgaacctcacgttattgagaagttcttcctgtcagttggggcaaaacaagtacctattgacaaactcatagcccaagaacaaaagattcgtaaatccacgaaaaagtagttgaaaaaaaataaaacgcatgttataataatctcatagattacatacaatttgaaaaatttatgaagctaggcggattatgaaccagaatcctggactcggggcgaccaagcctacgatgtcacagagactttctggtctcacataatccgcatgcctagcgcttcgtaatctcacatgaacgatggagaacctataactataataaaactaaggagaaaatagggaaacgtgggaatgaactcacgattactcacgtttaaaagtaggtaatccttacacaccatcgtttcgcggctctagggttgaactctagtcatctttctatacagggcggttctttctacacacctaaggggagggcggttattttccaaccctaaaaatccataaccattttctggaattgcacaaattttcacaccgtctcacatatcccacgaagccctcacacatctcacgcaatccctctagtacgcccaagttctaagcgtcactccacaaagtcctcacgaagtccccacacaaacccacgtcattcacccaagttctaagcgtcaaacattatcggatttgcacattgctcctagatattaaagaagccaagcatttctagatttctagcaattgtcggatttgcacatgacaaaacgattgtcggaaatgcacattaactctgaatccaaaaacacggtcgaatttgcacatataaaaactactatcggatttgcacatactcaaacgcttgtcggaaatgcacattattactgaagtacggtagctgtggatcaaaatcttcgattctgcgaatataaaatatctcctgaaatttcaagcctttttacacggtgtgtcaccgtgagttcgcttgttttttagagccacaggaattttttctgtgtcaacccctttacccccatttaactcataatattttcccttatctgccccctgcccccatcatccccgaattgccccaattaaccccctttatccctcccccaaaaatacccatcggatttgcacatactcacccaaactcgcgcccaccgctgcgctgcagcaaactgcgcgccttccccctaaaaattattatcggttttgcacatattagtatcggatttgcacatgcccctagggcggtaaaaataaattttcatcggatttgcacataccctagcagcctcacgtaatattttgcttgacacattgtcggattcgcacataagcgcaggaagggccgggggtcggaaatgcaaatacgaatgagagtgattcgcatttgagaagttgaatgcgaatgataattattctcgtttgataagctgaatacgaatgagaatgattcgcattccggaaaggaagtgagaaacactatcatttaagttatcaccagagttatacaaaattgtaaattagcttgacgcttgagaaggtcgcagacgagttatccacagacttattaacaggttatcctactggttatttatacagtagttcccggcaacactttctgctaatgtcgattttaagcgccctaggaagcgttctaagcgatttaaatttcgtgggggtattttagtaaggggtcacgcggtggaggagggcggcgacactcttacatatcgccgtggaaacactcaggccaaaagtgatttacaactgaaactattagcagggtaatgattgcgctaataactatcatgcccaaaaacattaggccgctcattattggcagctctgcaaaaagactagggtcataataataaccatgatgacacgaaaaccccactcaccgccgccaccgtcaccgcctttcttctgaccgtcacgaataacgttcaattggtaagtattgtggctacggcttttgggactaccaccgcgtaaagttcgcattaaaaagcctccttattaaacaaggtatcatagagggcatagccgcaaaaagcgataaaacccaaaaccatcatagaaccaactaaaccgagcgccaacattgaaaaagccatttttcgatctcctatatgggtgagtcataataataacataactctagcgggaagcaactactatttttagtagtagacaagcaaatccgatttccctatagtttgatctcccggcaagcatagaaaaattttgcttgctaaaaagcggagaatcttgctataatagattctcagccaaacaaaggagtaacagaagatgttacagaaatttacccccgttgcaaatttgcctatggttcgcggtggcgctcgcaacctgttagatggtagtaaatgcgcctctatcggtcatattttaggcgtttaccgctcgaatatggaaagtagaaccagccgcgcttttgaacatagccgcgactacgttctagccaaccccggcgctgcgattgttatttttcacgacgatcaatatttagttgacagccagcctattgatctgatagtatctaccactacggacgcttatttgtataaggcatccgaaggtaagcaagcgtcaagacgtttttgctaccatgaaagcgaactgctcgctttcaccgatgcccgcgcatggattaaaaacctgtgcgatcatctggaactaccaccagcacgaatttctagcgaaatgatgatttttgtgcttgacaaagacggaagcatcctgctaccatgtgacccttacgatattgatatcgaagaaggggcaaggactggaaattatcgttatgatggcgagctagaagaagtcgccccggctgttactgaaaatgtagttaaccctaataattttgagactggagcattacaaatgaatactatcaaatctaccgctaccgctatcgttgccgctaacaaaaacgctgctgtaaacgctgctaaactggaagccggttctatcgtcctgaaaaaagtttccggcatcgccgccagcaaagcgccgtttatggttcgcggttatgttgacacggcggtaggtcgtgtggtaattgctaacctgctgaatttcgcggttagccagtatgcgccgaacaaccgcaaagcggtgattgcggctgacgctgcaatgcaagccgccatgttggaactggtacaaagtttcaatgtaggcgaaatgattgacgaagtattgaaaggcgtcaatctttctagcctgattgaaagcgacgtagcagaataattatatctagcgcctctataatggggcgctataataattaccctgctaactaactggagacaaaaaatggaacggctaaccgctactttcgaaggcgaaaagatgacgatcgctaatgtatggcagcgcctgcgccagaatggcgatcgtggcaattttgctattttcatcgagccaaaaaacttggataatctggctcgccagattgaccgccgggactgctacccggatacagatgatatgctgggaatccccttgcggattatcggggtatatggttacggctttgatatctgtattggtgatagtagctttgaaatcgactgcgaatccggcgctaccgaaatcgaagtattcctaattaatttaggctcgctaacgtttttggatacgccaccagcggaaccggaaccggaaaagctggaggtgaaaacgtccgttattgttagttcgctaactatggatgagctggcggatatcgtgtcaacgtatgacgaaattcacgccgacgcgattaaagagctaaacaaccggcttgatactttccgcgataagctgtaaaatccctcccggcggctaaatctctagccgcccccattattggagaaaaccatgtttcatgtgaaatcttgcgtaccgggcattaattatacggtagaagcggaagaaggtttatatttagagggcgggcgaattgagtctcaggaagtcgccgccgtcctcaaatgtgacactaacgtttgcggtacgtcctggactgaccttcattttttaggtcgtggaattgacgtcgattccctttcctgggaaaaggcttgcgaacatgctgaaagtatgctaaacgaggatgattgggatgatgacgacagcgacgaaaaatacgcgaatgctggggtagaagggtcgttttatatgtactggcccggtcattcctgcaacctcgttaatggtggttcgcccctccattccgttctagagcgggcaatctatttgggctatatccagatagttgacggaaaggcagtcattaatctgcgcgaattgaaaacgtttatctatatcccggatgctgaaactatccttcatattgaggaaggtttaaaatccggttggaaggttagcggggtcgtatacctatgatttacatctatgtcaacaaatattttctggcgcactataaaacgatggaatctgtgatccagtacgttagccgccagaatgcaaggcatattgatgaagtggctaccctcaaaatcggattgcggggcgatgctatcaatattagctggcctttgctaattctgatttgccgtgatcttgtagcgggtaaacctgtttccgtttccgcgctgggggaatcttacccgctttccgatgatctggatctctatgatctgctaaccaaatataaaactgaacgcctgttttatcgtggcgggtcggtatgctctagcggcgaaacaatagaaacggtattccgctaatagttagctaactaatgataagcctgcttataatgagcgggctttttatttttctgcgcccctctagcaatggcctttaatatggcctctaaatttaaagcgcttagaatgcgttatagagcgttctagaggcatattagagtattaccgctgccggaatatactgtataaatatacagtaggataacctgtggataagtctggggatatctcgttataccgcttctcagcttgtcaagtcaaaacgtgctgtggataacttgcccggaaaacaggagtgcagcataaaataaacgcaagcattattttgcgttttcataaaaataatcgtttgtctagtggataactaattaaatttcatttttgctttttgtataagttattaacagggtctaaaacgccctagaatcgattctaagcggttttagataaaagccgatgaatcataccgggtatgaggcgatctcctcacctcgtgtgaaatagattttgtcaaccccttttgaagaaaaatagtaaaaatattcgttgactttctttaaatattgtgtcacgtgcgcgcgcttcctatctatcgtgggcctgttttctctttacgcttctttacaattctccgcttgcggctaaacgccattgtgttattatttatctcgtagggcggcaagacgaaacggaaacacgaaagcgtttcactagtagttaggtatctggaggcggcaacattgccccgactaccgcgaaaggaaaggccgaaacgatatagtctgcccccgccctacactgctctttaaaaatttgggattctataaaaagcgttatcggctttctttacttaataagggaaccgaaaacatgttaaaagaaaacgtaatgagtagcgagattgtaaacgagtttacagtagcagacgccgaacattttatagagacttatttaaatgtgtacgacgtagatttagccttcattcataaagacggccaaatc

SEQ ID NO: 2 - DNA, 31078 bp, Unknown
  Description of Unknown: Bacteriophage F394/08
aaacccggagcaaggccaagcagcagccgcagaaagtacgccagcagatccggcggctaatgtttcacgtgaaacgaagcccgaagatttaataaaaaacgacgtggccccggctgaattaaccccggctttttatgtggtggctgaaggtcgcgcgattacgtcaaaacgtggcattttggccgctggtgaagcagtagaggcccgcgactttgtaggcggtgaagaaacgctaaacagccttttagagcgtggtttagttgaatgaatatccgagatttagcggcccaagatttccttaatatcgtgaatgataaaaatagcggttttggcgttcccgtggtgttaattgccccggatggtaacgcgcagccgttaagcggattaaccacggatatatcgagctatattgatccggaaacgggcgttttagttgcgggccgtgttgcatcggtcacattcgcaaacaaggcaatccgtgccgctggattcgcagaaatgcccgtagcggtggccgattcaaataaacgcccgtgggtggtgtgctttcgtgatcctgaaggcatcccgtatttgttcaaagtggttaaggctatgccggatcgcgcgattagtggcatagttttagaattggaagtttataagcgttctatttacttcaatggggcttataaatttgatgggacgacgttatacgatggagttttagacttgttatgaatatagaaggctttaaaaaactgcaaagcccgattaacaagctagatagttttgaaatagtccgcgaccagatcgcggctattttatttcttgagcttgaaaatcaaaaagccattgctgggcgcgcgcagattgaccccgctagatttgatatgaaagtttataaagagcgttctaatccgtgggatctattcgacgatggcgaaaataagcccattattaacgtgtggtttagtaatagcgatttcgattacaccaatagcagcacagtcgataagcagaaaaccacggctatttttaatattgattgcatagcgacggctataagccaagaaacagcgaccgggcaaacgctgggcgatgaaatggcatctttagaggtgcagcgcgtggctaaagtgatccgaaatattttaatgtcagatacaaatacatatttgcaattgcgcgggcttgtttggtcgcgccgtgtgctgtcattaaacatatttcagcccagcgcagaaaatggaatgatgcaaaatctatgcgcggcccggcttgtacttcaggcgacgtttagcgagttttcgccgcagtatgaaccccaagagctagagattttgtccgtaactgtccataattgcgatggacaaattttatttaacaaggagattgctaagaatggcaattagtaccgctgttgatataagcgcggtggcccgcgttttaggtatcaaaacaaattttaaaaatttgcgggatggtcgtgtggtgattttgccgcagcggatcgccttaattggtcaaggttccacggggatggtgtttgcaacgtcaaaacgacaagtaacaagcgccaatgaggtgggttcgctatatggttatggttcaccgcttcacttagcagctaaacaactatttccgaataatggcgacggagtggggacgatcccggtaacggtttacccgttaagtgatgcggacggatcgcaagcggcgaccggatcaattgagcttctagggacgcaattagaatccggggcttatagagttgttgtgaacggtatccgttcggaacaattttcaattttgattaatgaggccgggcaaactgttctaaatcgagttgcggcggctattaactccgttttagatatgccagtacgtgcgacggcagattcggaacttcaaaaagtaacgcttgtttcaaaatggaagggtttaagcgctaatgctatttctgtccaagttgatggggatttagggcaaggtatcgaatttgcagtaacgcagccagcgggcgggcttattaatccgagtgtttccggtgcgctttcgcagtttggcaacgtatgggaaacaatggttttaaactgtcttaatattcaggataccgaagcattaagcgcttattctgattttggggaagggcgctggggtgcgttggtgcgtaaaccgcttattgtatttacggggaatactgaagccgacgtaaatagcgccgtttcagtcccggacgcgcgaaaacgtgatcggacaaatgttcaacttgtggccccggattctatcgatttgccgttcgttgttgcgtcccgtcaattggcccgtattgtaaaaattgcaaacgaaaacccggcttgtgattacggcagccaagtagccgacggcattaaccccggcgaagatgggaaacaatggctttataacgtgcgtgatatggccgttaaaaaaggcagttcaactattgaaattcgggacaatcaagtatttatcggggacgttgtaaccttctatcatcctgaaggtgaagaaaatccgccgtatcgttacgtttgcgatattgtgaagctgcaaaacattatttttaacttaaatctaatttttgccgtgccggaatgggacggagcgccgttaattccaaacgatcagccgaccacaaacccacgcgccaaaaagccttctatggccgttgccgctattgccagccttgtggatagcttgggcctaaatgccattattagcgatgcggcatttaccaagaaaaacacgtttgcacaaattaatgaacaaaatccgaagcgtttagacgtttcgacgactgtaaaacttagcggaaatacaaacattttaagtgtggatcttaattttggtttctatttcggtaattcggtaattgtggggtaaataacttatgtcagttggtggcagcattgagagcttaactttagacggccgaaccttcagcgtagcagcggacgcggattcaacgcgcaatttaggcggcacggataacgaagtagaaatgaacggggatggtacttatcgaattgtaaaaacgcgcgtaccgtcaaaactagacggtatcacggttgcaattgatgacgtgcgcggggatgcagaatacttgcaagagctaaaagatcgaaaagagggctttccctattcgattacatacgccagcggtgtgatttatcaaggtacggggacaatcgtaggagaaacgggaatttctagccaaaacgcgaccgcttcgattactatttcgggatcggctttaactaagcagtaatttacagcgcggccataagattggccgccctttcttaatcatttagggggtttcacgtggaacatatcgaaaatactgaaaatcaaactttgtggggcttgcctgttaaggttgcgcgtgaagttgcggaggctgaatttatccgcttttgtgatgctatggacgtggattacaacacggatcgaatgacggacgaagatgcaaaagactttaacgaaagtaaagggcttttgcttgatgcgctgcaaattggcgttttggaaattgatagcgacggcatggccgttgtttacccgaaaaaaggcgatattaagcaaattaaatttaatgagctttgcggggcggattacgtggcaatggacaataaaaaggatacgcaaagtttcgctaaaatgttcgcaatgatgggatctattaccaagttaccgcccgcgactttctcaaaacttaaaaagtttgatgcaaaagtttgtttgtcgattgctaaactttttttggtctagtcgataccgttttaatcataaaggggggcgaggttcgcctatccccttcgagagattcggatggtatcgagcgcgggaataatacgagatttcaagtttattcaacgatgcttatgcagatcctaagagattataacttgccgaattttagaaccttaacaagttcagaaattcggttttttatgacggattgcgggccgagttgaaagaaacaacaaaaccgaggaattaatgagccgttacagcgtagaaacaatatttagggccgtggatcgcatgacggcccccatatcccggatgcaatcgggaattagtcgatttactcgccgggctgaaagcggacttaggcgcgtttcagatatgacgtggaatatatccaaagtatcaggcgcagcagccgcggccattggtggcgcatttatggcggccgctggtggtattgccctctttgtcgcagaaacaaaccgggccaattcagaaataaatgaaatgtccaaagctatgggggtttccgcgttatccgcaagggccgcagattccttgcttacaccgcttgggatgaattgggaaaattacacggatcttattgaagaattgggaaataagatgggtgaattaaaaaacacgggggaaatgaaaacatttcaagaggctattggacttactaatattaaaatgaaggaattaaaagccttaaagccggagcagcaatttacaagaattatggattctttggcaaaaatggaggatcagcaaaaagcccaatttattgcagatgaaattttcgggggtgagggtaataaattcgtttcagcgttaaaggcgcgcggcttgactatgacgagcttgattgaaaattataaaaagtacaatttttataatgagcaaggcgaaaaagcaacggccgcttttaatgcagctttaaccccgctaaccacgacggcaaattcggcaaaatcgcagatcgcggccttaactggtggcgcgatggttccatatattcaaaaggcgacggaatgggctgcggcaaataaggaattaattaatagcaaaatcgaagtattcgccaaaggcttggcggattcgcttgtttgggtggtggttaatttttccgagattgtgacgtgggttaaacgtgtcgctattggtatcggcatattcttagcgcttacagccgttttaaaaactttcgttttgattatgacggccgttaatttagtaatgatgatgaacccgatagggctaatcattatcgccgtggtcgcgcttattgctgtcattgcgtatctgattaataagttttttgggttgcaaggtgtcattgccgcggctaatggtgtgcttatggggattggggccgctattttggtggcgatggggccaataggctggctaattggggccgctgtcttgatttggaaaaattggggcgttttaagtggtttctttagtggtttatgggcgggtatcgtttcagtttttcagggcgcgcaaaatattattatggggatcattaacgggattatgggcgcaattgataacgtgattaataaagcggtttcgatgggttcggctgttaagggcttttttagctttggcggcggtggtggtgatcaaaagcaagcagcagcagcgggcggacgtgtggcaagcccacaagagcgaaccgcaaaaagcgtaacggaaaataatagccattcaacggtaacgatccaagacaaaaccggacgcgcgaaaatgtcaggtaaaccggggaatggggttcgattggttaaaacggggactatgtaaacaatgagttgggaagatcgtttaaaggaggcggcttacaccgcccccggaggtacacgggccacgttcttagttgaggacgtttcccgtagttttgataaaaaaacaaatggtttcacgttcccggatgcgtccgggacttatgttcaagattcaggcgtaagcgggtttaaatatccgctgactatctattttagtgggccggattgcgatgtggaggccgaagcgtttgaagcgcttttgagagaaacgggaatagggcgtttagagcatccgctttatggcgttattaacgtggttccgttcggtacgattacccgtaccgatgcaattaaaaccgaggcaaaccaaacaaaaatagagctggaattttgggaaacaaaccttttaatttacccattaccgcaagccgaccaattaagcgccgtatttgaggctatttccgacgttaaggcggctttaagcggtgatgtgctagatagtatcgacgtaaccgacgcgagcgccctagcgcgatttaaaaacaaaataacgggggctttaagcaaggtaaaaaccgctttagggaaaattaagaatttagcggacttgccggggcaattaatggacaaggtaaacggcttaatttcgcccggccttgagtttatttccgatgttaaagcccagcttggcgatgtggttaattcattttttgagcttgccacgttgcccgaacaaattgtcgattcattcaaagagaaaatagcggtctataaggatctctttagcgaattaacttcattcgagggcatattccccagcaatgaagaatacgaggcagcttgtaccggggtaacggtgactttatccggcttagtagtggatttggttgaatctgaatttaatacacaaagcgaagcattggaggcggccgaggatctattagccatttttgatgatgtaacgggatggattgaagaaaaggcgcaaggcttgggccgtaccgattcaaacgcggtttatcagcgcttacatagcgccgtgatgaccgcggccagctatttggttcagcaatcttttaccttaaaaaaagagcgtaaattggttttaaaccgtagccgtacaattattgatttatgcgcggagttatacggggaagtcgatagcgctttagatttctttattacgtcgaatgatttaagcggggctgaaatattggaaattccgaaagggcgcgaggttttttattatgtctgacgtttctatgatgatccacgggacgcgctttcatttttggagtggtgtaaggatctctttaaatattgacgcggtggcaacgattagttttaacgccccgtttgaccatgaggcccccggatttaagcgcaatttcgcgccgtttggattttccccggttgctatcgacgtggacgatcagcgcttatttaccggaaccatgttggacgtttccccggtgattagtgaagatggtaaaaaagagatttccgtaaatgcttatgcaaaatgcggagtgcttcaggattgcaccgccccgcctgaatccatgccattagagttcaataaattaaacctgttggatattgctagaaaaatggcctcttattttggggtgggtgtggtatttaatgcagatccgggaccggcttttgatcgcgtggcgtgtgacccggataagaaagttttagaatttttagcggatctcgcaaaacaacgcggctttgtgatcggtagcgatgaaaacggcaatttacttttttctaaaagttcaatcggcggcattgttgctaagttggagcaaggcgtatccccgcttttaagtgtatcccctacttttaacccgcaggaatattattcgcatattacggggctatcccctgtcgaagtggcaaagcccgcggccaaaagcacggccaaagtaaaaaaggacgctgcaacgcctgaaaaagcagggcaggggagcgaaaaggcgaccgataaggcgggccaagccgaaattaaaaaggaaccaaaaaaagaggaaaaaaccaaaaaggaaaagcaaaaaccaaagcccacgacttataaaaagtttacagctatcgacgaggcccccgtatatcggccattggtttttaaaattgatgatgcagaaggcgcgaccgatgtagaaacggccacaaaagcaaaaatggcccgaatgcttggcaatatgtgtacttatgcaattacggtttcgacgtggttcgatgcgtccggggatttatggcggcccaatactaaaattaaactcaaggccccggattcaatgatttatgattttttcgagtttgatattaaaagcgtggaattgtcggccgatgaaaacagccaacaagcaaatttaactttatgtttaccgggttcgtttacgggcgaacccccggagattttcccgtgggaattgtagcgactgtattaagtaatgatggtaaggatttaaaagtagatcggggcaacggggacaacgtaacggcccagcagttcggcccgtccggtgatgatgctcccccgcttaaaaatgattattcggttttaggatcggccaaaggttcaggcaatgccagcgccgtggcctatcgtgaccaaaaggccgaaaactacatagccaaagcaggggaaaaacggatttattcgcgggatgaatcgggggcggtaaaagctgaagtttatttaaaagcggacggaaccgcggagattaaaaacgccagcgggctttttgttatggagccgggcggtgatgtggtaataaatggggttagaattactaaagccggagttattcaaacgccgggcggggcttcaatgagttctgatttcacaaacgcgggcggaataactttgggcgaccatgcggccgatacaagtttacataagccataagggggaatagtttttaatgtctttttttgatgtgcatttatttgattcagtcgatggcggcaatgtaacggatgatttagaaacgcgggacggcctagaaacggctgtttatctaagtctttttggcggtaatgccttagatgatggaaggccccaaaacctttcgacgtggtgggggaatattggggagaatgaagcggcaaagcaatataaaagcgaagccgcttttttgcttcgcacggttccgccgaatacagccaatttaaagcgaatcgaagcggctgcatcgcgggatcttgcttggttgattcctgaatatgtgaataagattcaagttaaggcgtttatgcctaaattgaatgcggttaatttaacggtttctttggatggtttagatccgttgcaattccgtacaaattggggcgaaaaggttaaagagcctgtttatagactattgccgcctaaagtttcccgaaataatggggttaatttagaaggcacagcagaaacaaaaactaaactaattcttatccgtgccgatggatcaagattaagtacgctggttgatggttcagggaattggaaatttgatttttaccctttatatggtggtgaacgtgcccggatgtatgttgagggtgtagggggtaaaatatccgctattgttacagttatcggggttttaccgcttcgctatgatgggatggcaatttatgacggtacgcacaaatataacggagttagattaaattaatgagtacgccaacgactaaagaaatatcgaaccgtattttatccaagttagaaacgacattcgggcaaagtttgcctaagtcttttacacgtgttttatccacggttttggggggtgtgtttgtaattttatataaatacggtggttttattgctttgcaaatgtttgtttcaacggccagcgctaaagatacggactttaacggcaaaacaattaacccattacgcgaatggggccgcctcattggggcgggtgatcctaatccagccgttaatgccattattttaacgcggattgtagtagaaaagccgggcgagatattgcccgcagggacgcagctagtaaacagcggcaacggtgttacatacattacccaagaagatattgagctagtcgaaggggcgcaagatattgaagttttagcggcttcggatacttcgggaaattcaggcgcaggcaaagcgggcaatttaaatgcgggggatgttttgacttttgcgaacccgcttggatcggttggccgttattcgactgtggtaactacaattcgggaaggcctggacgctgaagctatcgaaacatatcgcgcccgtgttgtttcacgtttccaattgcgcgctcaaggcggggcaatggtggattataagatttggggcgaatctgtttccggggttagtcgaatttatccttatacgtccgatttgccgggccaagtggatatttatgtagatgttttggagggcgtagcaagtcaagcgattttaaatcaggttaaaaacgccgtcgaatttgatgcaaataacgggcttgcacaaaaccgccctttaaatgcgctggtaaattatttaccgatggagtttgtagaatttaacgtaacgattagcggtttaagtgttgagggcgcgctatctgttagggctgaaattagagcagctttagaacattattttaatatccgtgcgccgtatattgtgggcctttctactgattcgcgcgcggaccgaatcacattggcggccgcgtccggtgttgtggacgatgttgttaataaagctgggggcatttttaacgatatgcagttatttaaggggcaaacgccaatttctttttatatgttggggattggtgaaaaggcgactttggtaaacgtcgagtatctataatatgaatatgtttaagcacttgttacccagcggccgcgcttggaacctaaccgcggaaaagccactaaaggcttttttccgttgcttggatgttttgagaacggacgcagtaaattattttaatttgctttttttagatataaacccaaaaacaacgcgcttacttgatcaatgggagcagcaattcggcattaaccgaggatttttaaccgaggcccagcgccgggaacgtgtcgcggccgcttggcgtgatgtgggcggacaatccccggcctacattcaagaagttttaagaaataatggctttgatgtttatattcacgaatggttcgatccggcagatcgcggggaagtaggtgaaaaacagcctataacgccacgtaacccgctgtcgattatgtcggcccaatatgccgaggttttgcccgttgtggattgtggcgaaccgctggcgctatgtggtgaagaatttgcacatgccggaaattatttgggccttgttgggtatccgcttgttaataagttcgtttatgacgcggataaatacggctacactgtccccgttgatccggcttattggtatcactttttttatgtttgtggccctaattttggcgatgtggcccaagttgaagcaacgcgacgcgctgaatttgaagcgctaattttgagaattaaacccgcgcacttatgggcgggcgttattgtgagatacgtttaatatgtctttagtgtttaatgagaaatttcccggaaaaacggcaggggctacacaaaattacccgtatggcgaagcgcgtaacgtatcaggccccggaaatggtgacggtacgccgtgggatgcggccctagtgaatgatatttttggattacttcaagggcttttagttcgtgccaatattcagccgaacggccagtcggacacggctttaaactcgcaatatttacaagccttgcttgccctgtttatgccgaaacaaacgccaatttccggaaagttagagcaaaacggatatttaactatccctttccctgttgtaataaacggccaaacggtagagcgtgaatttacaattcaatggggttctaaggattggtctagttatccgggtgaaattcaagattctattgtttttgaaaagccttttaaaacagcctgttttggtgtttttccaatccgaaaaatgtcgcagcattccgcttatggtgatggtggtgttaagcctatttctgtttctaaaaccgggtttacagtttctttgcaagcctacgggggttctgtgggccacttgttgggttattattggttcgctgttggtgtttaagttagttctgattttatggggtaaatgatgaatctatttatacaaggcatttatttactatggaaccaatttcaacgggtggcacagccgcttttttaaaggtttatggggtgtggttggcggttgttaccgctttggtgtttgttgctactgtcgttttaatgatgcgtttaccacgtagcccacaagagttccttgtgggcattattacgactgtcgtttcaagtctaatgggcggatcttttttaattctttattttgatttacagatttgggccaattcagcttatggccttatggtaattggtgggctttactttgtggcgggtattcccggctgggctttggttcgctgggtgtttaattttattgatgcgcgggaaggttccacactattggacattttccgcgaatttaatgaagaatttagaggcgggaaaaaatgagtaaaattattgcgatttgcgcggggcatagtgataaagatccgggcgcggtaaatggtaaacgtaccgaggcggccattgttttagatatgcgtaagatggttgccagttatttggaaaaagcgggcgtgaaatatttaacagacggcaaaggcggggttaatcagccattggccgaagctatcaaagtggcaaaacaagccagtattgctgttgaatttcactgtaatgccgctacatcgaaaaaagcgaccggggtggaggttttatccgctgaaaaaaataaggccctagcgaagcaaatagcggccaaaattaacggggttttaaatattccgttacgtggggaaagtggttggaagtctgaaggatcagggcagcatagccgcttaggttttattagttccgggggcggtttaattgttgaattgttctttatttccaatgatgacgatttagcgaaatgggacgcgaaaaaatggcttgttgccaaagaagtggcggccgtattgattgaacaagtaaaaaaggcggaggcggcataaatggcagcattaacgatatttaacgcgatttcagaagttacaagttttgcaggggtggcccgtgagattttcgacacagcagccaatgcaatggacgcggcccaaaatgagaaaaaaggcggaggaaataaaaaagtttgggtaatggcttacatggaatcatttattaatgatttgggcgaaaattgggaacgatgggccaaagctattttttcttttattgattttgccaagtcgatttttaatagtaagcgctaataaaaaagccccgtattaattcggggcttttttatggttccacgtggaacggtttagcttttctttttgcttgccgggtttcttaataaacgatcttttttgatctcgcttacaatcccgtcgattaaaaattccatgcttgttcctttggttggtgggttggttcagatgatttaattcgagttcttagggccgcttttacaatcttatccgccatgcgccctatttgcgccttgtggcagttattacacgcgcatccggccttatatccccgaacggttccgcagcctttaacgggcttatatgcgtcccctgtcgtttcttcaataaaatctatggttgatttgtccgccgtgtttcgcatcctttacccctaagccgcagcgggagcaacggccatttttaaataaggtgaatgtttggcaaataaaacaaaagttagtcatttttgccgtttgccttagcgattcgcattacattaagggccttttgctttagatccgcgtatagctcattagtaaggtaactttgtgctacatcgtgaaaagtagataaaaaatgcgtgtcttgttttaccttgctttgtttaagttccgcttggtttacctgaattaagccaatagctttgtttgcctttttgattaagttattcacgtcgcttaattgcgcgtttattttggcctctttttcgccttttatgtgtgctggggccttatccatcaaaagggcttcacgttggccgtttaggtgggtttttaggcccgttaattcctctattgagaattgccccgccacttgcaaagtggttaatgctgaaaattcaatgattgcggttttaagttctgttttagtcatgggtagcacttcatttaaaaagtattaagcccagcagcagccgggcaatggtgggttagatttcggttaagccgtgttttttcattttcttaataacggttaatcggttaatgcctaatattcgggatacttcggcaatattatattttgaatatttaagcgctttttccaaaacgcacttttcaataggatctaatgcagccgctagagcttggccggaattttcataaaaaaaattcgcgtccaaagcatccgggttaaataaattagtggtttcgctcattcggatattccttaaattgcgcgttatattcagcgacaaattccgcttgtttgtcgatttcatcggcttgtttgataatgaacatataagacaaagccgcaagcataaaacagaaaaacaacgtgcttaaaatctcttttatttttgcgccgtggttcgctgtttcttgtgaaaaattgcttaattgttgacgctgaataactggctgtttcataataatcggactccatgaaattagaaaaaagccccgtagccgtccaaagttccggggctttttgctgtctatgtgttgcataatatacaatataaataaaaagtaaatagagaaattatagataataaataaaataaataaaatagataaaaagtattagttttaattgtggcatgaatatttgataagtgttaaaatttgttctaagcaatcatgctgaaaataaaaaacccgccggacggggcgggttttagtttgtcttgagggtataagacgtgaaaaagtttaacacgaaatttaagcaaaatcttgatgatgcaaataacaacgcatttattccgaacagctttcaaattacaaatgctttcgttgataacatcatggataaaatttcggatgcagcagtaaagatctatttaattacagtgcgtaaaacaacgggctggggtaagcagatagattcgatttctttaagccaatatgaagcgtatagcggcaagtcgcgccctactgttgttaagtgtttaaaagagttggttaaggtgggtttattggtagagcataccgggacacggtacggtaattcgtattcggtggcgcttgtaaatagcatcggtttcgagcttttatctgctagtaaaaaaattttactagtaaaaagttttaactacactagtaaaaaatctttactgccactagttaaaatttttaacacacaaaaacaactatcaaaaaacactaatcaaaaacaaataaataagcgcgattggttttctttaaaaactttaaaagatgaattgtttaaaaccgggttgcaaattgaggctgaagatctaacagcggctaaatggttcgatagagagaaaacagcctttgaaaactatgcacctaatcaaaacctttcagatccgcaaaaaatgtattacttcgttgattggcttttaaaagcaaagcgcaagtacgacgcagcagagcgccagcaagcagctaaggcaaaagcggaaggcaaaaaccaaaatcaaaaccctgaagatacaaaaacagaaaacgacccttttaaactttctactaaacaaatttcattctttgctagtcagttagcccatttaccatcatttgcaaaatattgcactggtaacaaaggctttaaagaatttgaaatgtggattgcttcaatgttgaacaatcctgaaaatgttaaaaagtggaataaatatttaaatgaattgggttatttgatcgggtaatcagggggattaaaaacaatgaagatttcaaactttcattttcaaatgcaaattttacttttgatttctaaaaacacggttttagattttgagggattaaaagagaagttagcgccgtcgattacagacaacgcattaacggaatgtttagaagaattattgatgtggggatgggtacaagtacaaaagggcctttacatggtttcaggcgttgcttatcagatcatgggggatatttgccaatgctgatagacaaatatttctattaatcggcttcgatacggatgcaatggaaaaatacaagtattcagaatcaaacgccgtattaagcccgcatttaaattgcggcctaacttcagttagtcgcgttggatcttcaggccaagcaaagcataaaccgcataagcgaagtgaaatagcagatcaggcagaaaaagagatttgcaagaattgggcgttaagacaacaagcatttttaaataacagcgtaagcaacgcggtactagggggctaatatgaacaagtttattcacattgagggcaaaccaacggcccagcaagtacgcgaagcgctggcaatgtatgcaaaagacattaaacgcccggaattttctttaattgttcagcgtgagcttatcgaatcattccgcaacgatacggcccacgcccttaaatccgcagttgccttttattttaaaaatcgtgtgatccaacgccccggccttgtgttggcaagtggtaaagatcaagcgcttattgttgagagttgcgaaaataaggcattaaagcgccacttggtcgcggtgtcggggtattcatcgcaatttctgcaaatggtgatagatcataaaacgccactttcagccgttgccgcgcgggatctaaagcaggcattaccaaaagcggaaaaactctataaggccgaatgcaaggaaaaagatgcaaaattaaaaaagaatatttgcggttttgtcgcttgctatagaaatggctgtcattgcacaaaatgcaccacggcatataagaaatatcgctaaaagcaagcctatcttttaaagagaaaaagcgcagttcgcgccgtggccgcttagtgtttcacgtggaaccaaacaacgccccggattaaacgtccggggatctaaaaaagagtaaggaaaaggaataaaaatgggtgtttcgattattaatttagttttattggttggtgtttgcttattgctaacaaatatcgccttaaattgtttgtttcataccgaaaataaaacatatctagtctatgcgtgtggttttagtgcggcttcggtggcgggtgccattgctggcgttattggttgtttggcttatggggtaacagtgtaatgaaaaataaatcaattcttatgggcctattcgttgcggccgctggtgtggtgttttatatgggggcggatagtgcttgcaatcaaaaggctgttatagatccgggcgcgcttatgtcgcttggtggtatcactgttgaaaataaaaaagcctcattggttcgcgtatgtgatacgccagtaaaagaaaaccttgtgagctttgttttgattaaagacggcttgcgcgtgggtggtgtggtcgataaaagccatgttgcgctcataggtgaataaatgagtttaggaaaacgccccgcaggtgcgacgcatatagagagcgacggcacatattggaaaaatgaggacgcggattggtatttttggcgtgacttgtggggctggtgtcaatatgtcgggccaaagaatagaaattttttaaataagttttcggtgttggggtgatggatttatatattggtcagattgtcgggcatagttcgcccacttgggttgttcagggaaaattgaagataaccaaaattaacgagggtaagcgaagcggtttaaagattattacggctacagatgaatcgggtaaggaatttaccgcagtttatggcgtgttttttagtgttgatagatattaattaaaattttggggtaatacgtgagaaacgaaaactttgaagattatttaaaacaaacggatgattacgccgtattactgaataattacggatctagtctatttatccatgaaaatggcgtttatcgcgctttgcctgtccgggtggcttatgccgcttgggtatcgggcggggatcgctggggagaggtgcagcacttgaaaggcaaaattaagaaaatggccgaacgtgcagcagaaacagcggatttttaccataccaaaatagaaaaattggaaagtagcacggttaaaaaggcgggtttattggatatggccgaacaatgggacggtttagagttgcgcggacgtgatttggaattaaaccgggtgcaagaatcaatttataagcgttgtgcttatttgttgcgggtggctgttaatgggtaatcggtggacgttaagcggaaaggtaaaagggttaaaagatttgcccgaaagtataaccgcggcacaattcagggaaatgatagaacgggggcaagtcaaaaacacgccacaagccccaaaaaagcgccgtagcggaaaagtaagtagtccgggggaggctacattagcccaagccttaaaagcgcttaaaatcgaatttgtgcaagagtatcgcttttgtgaatatcgcaaatggcgcgcagatttccatataccggggacaaaccttttaattgaggtagaagggggcgtaagatccggcggccgccacgtgcgaccacaaggctatataaacgacacggaaaaatataatgaggcggctaagttgggctttgttgtattgcgctttgatacggaaacggtttcacgtggaaccgcaataaacgaaatagaaagttatttagaaaggcgcggatatttccaaaataaggggcttacttgtgaagaaagttaaaaagtttaaatacgattggcgcgccgtgccggatcatattaattggcttgcaacgtatgaaggcggggaaatggcctgggggtatgtgaataaaccatatagaaaagaaaacgcggggatatggtacgaaacgggcggagagtggcggcatcgtgtacctgttgccccatatcgcggccattggacgcaatcattagaaaaacgacctagcaaggcccagctagtcgagtgggttttaaatggggctgtagtggtttaatattcacgaaccctcatagagtgttttataacattctgttttacaagcctcattgcctatagtgaggcttttttttgctttgcggtttgattggatttttaattgttctgtgaattttgggctaatattagaaaaccgcataggcggcaacgattgataaattagagagtaaataatggctgaaaatagttttattcaaccaattgcaagaaaggacgcgattgcccttattggccgtgatgagcttgtggaaggtgggccggaaggggcagcgaataaacaagcaattgcacttgcaaataatattaagtatttaatgggcttaattcctgaaaattggggggtggaaaaaaccgaatatggtttagatgaagttgtaaggctttcaaatggtgacgttgttaaatctgttattgatgaaaatatcaataatccgaacgagaatttgtcgggttggtcttttgttacaagtaattcagtaaatactatttctgatttattaagtattaaaaatccgaaaaatggaatgaaagtttatgttcttggataccataaaccggataattttgctcttttaagcccgtatgaagggggcgggcttttcatatatagcgggaataaggcagcggaaaatgatggcggcgtggttttaaatggctggattcgtcaatatgttggcgatgtggatatttcttggttcggagcaaaacaaggtcaagacgcttcgccgtttattgaagcagctttaaaagtgaaaatgtcaattgtgattcgtggagaatacaagttagaaacaatttgcggcataccaagacaaaataactatgcggcaaaagttattagaattaagggggaaaatcaggcttcgcttactgtaaattgcccggatggtgctgtttttacttcgttagatgcaaaagcaaaccctacaagtttatccaatatttttaccgcaaaaattgacgtattcgggattaactttgtaggtacaacggttgcaaattctgttctgtttaatggtgatcgtttatacaatattaatattcatcacaataatttcaaaacaaatattacaattgttaaagcgtatttaaagcgcgaggcatcaagacaatatacgcaaagcgtttctattaatcataatcacttagcggaaattcaccgggttattgagtcggacaagtcttataacttcgattttgcatacaatatgtgtgaagcgtgtaaaggtggcatgtatatcggtgttgatgcgccttatgatccttcaggtatttctataacaattcatcgaaatttatgggaagccagcggggttttattaaaaacaaatggcgggattattgctggtagtgtttcaaaaaactattttgaagctaacgtatatcaagatgcagcaattgataaatgcttaatatatatcaaccgaagcggaacgggggcgggttattccggtggtttaacttttgaaaataatttattttcagggacttcgtcgattccggattatgttgatgtgcgcgttttgggtcaaagtacagaaacatcgggaaattcaaaatctgctactacgcgaccgcctgtatttattggtaactggtcaaatagttacatgctaacaaatatggcccaagctattttgatcggtaataagtgttctaaccgcgaaaaaatgctgaatgcttacagcccgcaagaagcgcgcgttacttactattccggctattttactaagcaattggctaatattttaaccgataaaaagttaaatttattaaaggtgaatacttcagcagttcatgctattggttcctctcaagctaactttaaaactacattagacgttattgtattctttaaaacatccggcgcagttggaacagcaatggcgacttttaaattagatttatttgtttacgaatcagtcggacttggcgctggcaatgttccaaaagcaaacttaaaagccgtgatgtataattttatgcaatccaccgcagacgacaaaattacaccaacggttaatatgttttcggctatttctgatccgttaattaatgttgttgataactcagacggaacgtatagcattgagctttcgagttttactaataaatcatcgccaaactgggggtttgtttctgaattgcatattgaatacacggcccaagcgacgcttatagcttcgcatacatccagttattcagcggctaacttattaaccatttcataaacttaattaatagctaactaagggggagcgccaattttgtttttaagattggcgctttttttattggggttttatgtttgatatagatacaaagcaattgcacggcctggagaggcgtttagagcgattaaaccgccgtggcttgccttatgccactaggcaaacaatgaacgatctagcgtttgaatctcgcgccgtggcccgtgccgagttaccaacgcgcatggttttaagaaataaacacgcgattaatagcattcaagtaactaaagcaacatcgctaaacatttcccagcaagccgcgcatgttggatctacagccgactatatggcaacgcaagaaacgggaggcattaaaaccaaacaaggcggggccgccgtgtctattccgaccacgacggcagcagggcagggcagaaacgcaaagccccgaacccgtttaccacgtgcagcgctcaaaatgggcgctattcacctaaagcgtatagcggcaagccgtaacgctaagaatcgtaaacaacgcaatgccattgctatggctacatcggataaatatgtatttctcgatttgggccgccgtaaaggtatttttagaaaggacaaggggggaggggtaacaatgttgcatgatcttacacgcgcatcggtgcagatccctaagaatgaatggctgaagcccgcgaccgaggcagccgaacggaagttaccgggattctatggccgtgctttagagttccaattaaggcgcttttaattaaccaaaaacttaacttcgggcggttcgggcgggtagccgcccgcggttaagttaaagaatttttcgcacaaaaagccacggttcgcgccgtggtttttatttgtctttatcattcacgtgatgaatggatttatttttaaaatcaatagtctgaaataaaaaaaggtactgtgccgaccccccacccccttgccgttttgattgcgacgcgcgggccgcgcacaaattcagaatttttaacttgtcttaacttcgggcgggttaaatgttaaatttcgcatcatggttaaaaagttaatttctcgcagcgattttgctgctaaggcgggggttagcggggcggcaatcagtaaggcatgtaaagggccgttattagatgctgttgagggtaaattcatcgacttaaaccataagtcggctatcgcttacttagaatcaaagaaaaacggcaagacaacgccagcacttgaggggattgattcgctatatgaggaagcattagaagtttgcagagaagcgggccgatgctcgcaaacattgttgcgtgacaaattaatgataggcagcgaccgggctagaaagttggtcgctttaattcaaaacgcaaatatccaagattttgaaaaaccagcagccgaaaaggtaaaaagagaggagaaagcgcgcccgcatacccgcgggacggctgcaaaaaaacagcaagcaattcaagaggacgacgaagaattatttgagctgttagatcggaacgtagcgcaatatgcagatatgacgctaagggacattgttaggaaattcgggacggcaacgcgatttgcggaatatcttagagcaatgaaagaaatatcaatgattgaagatcgggaaattaaaatagcccaaacaaagggcgagctagtccatagggatctagttagtcaattgatcattgagccgatagattcggcccatgtaaaacttatgcgggacggatctaaaacaatagccgtgcgaatggcagcaatgcacggcagcggggcggacattaacgaaatgcagttagtcacatcagaattaattgcaagtttcattaaacccgtaaaagccaaagtaaataaaatcgcaacggaattaaaacgaggggctgaagcgtgaatatgaattttataggtatggattggctttgcgataaagtcgagaatctaaccgagtatattaagcacgtaacgcccagccaatttaatgaagaaaatagatatttgcccgaatctgtgaccagtattccgggctttatccgttacgacgtaaacccgtttatgcgtgaaattgtcgattgctttgatattaattcacctgtccgggaagtgaatttaaaaaagggcgtacaaattacatattccacggttttagaatccggggctttgtactatatgggccacgttaaaaccttgcccattatgtatatgacggccgacaaggaattagcaaaggcccgtattgaaaacaactttatcccaatgctggcacagtcggacatggcccacattgtccgatcaagcgacgaaggtaacagcagaaaaacgggtaaaaccgataatcatatccaatttgagggcggcggctatttggttccattcggggccattaatgcaaataaaatgcgttcgttttctattgctgtcatgctcaaggatgagattgacgcgtggccggatcgcgtcggaaaagatggcgacccggataagttgagtgatgaccgttgtagcgcctattgggaacgtcgaaagattttccgaggttccacgcccttaatcaaaggatcttcaaaaattgaaaaagcatacttgcgcggggatcaaagaaaatatcacgtactttgtaaaaaatgcagtttcccgcaggaattgcgatggagtacgccggacggtgtaggcggttttaaatgggacacggacgaggacggaattttaaaacttgattcggtgcgctactgttgccagcaatgcggggagccacatttcgagcatgacaaagagcgcctatttagtgagaaattcggggcaaaatggataccaacggcccgccctgttgagccggggattcgttcctatcatttacccgcgttatattcgccgtttgggatgcaaccgtggtacaagtgcgtgattgcttatttagacgcattcgacccggtagagcgcaaagtaaaagacatagagctttaccaagtattttataacaacgtattggcggaaccgttcgagattcaaggtgctaaggttcgctttgaaacggtttcgcatcatcgccgcacagtgtaccgattgggccatattccgaaccgttacgcggttcaatatgctggatcgcctatcctatttctaacctgtcaagtggacgtacataaatcattcttagccgtttccgtgatgggttgggccaaagatgctaaatgttttgttattgattatttgcggatcgagggcgaggacttttccgatagcgcggaaccgggttggggtaaattgcgcgagctaatcgaagaaaagcaatatattgccgatgacggtaaaaaataccgcgttgctttgaccttcatagattcgggttatgctaacgataccgtcgttaaattttgttctgaatattcgagttcagtctatccaattttgggccgtgaccgaccaagtaaaaaccaagcaattaaagaatttgccgactttaaaacgcaagaagggacaacgggctttagaattattgtcgatcattataaggatcgtttggccccggtgttgcgtcgtgaatgggacgagatgggcggaggtttacagcctgtttatcattttaatgcgcctgtcgatttgtctgataagtcattaaaagaattgaccgtagaaacgcgcaaggagaaaaccgacgcaagcggcaatacttcatatttttggcatcgccccggcaatgcacgaaatgagctttgggatttgctttgctatggacatgcagccgtcgagattttcgcgtggtcgctatgcgttaaaaatatggaacaaaaggaagtggattgggcttggttttgggaatttttggaaacagaagccccgtattttgagcaaggcgaacccgtcgccagtgagtaacaaaaagcccgctaaattagcgggctttgtttcacgtggaaccttataaaacggctataaaatcgaaatgctttaggtttaagtgatccggggtaaaccaagttttaacccacataatgcgattgaaggttagcaagcggcctttttgttcagcctccttaaaataggcgattcgatccccttttactgcgacgatggtcgcgccttcgggtttatttcccttcagcttttctaaattattttcatattgcattttgttagatccttaaaaaatgtttaaaccttgattattaaaattaggcgtttggcattgcggcatatttttagcgatgctgttgtaagtgttttgcgtcatgtaaattttaccgtcaaaagcaatcgtgttttgatcggtgatttgcaccgggtagccgtgttgctggatcgttgcgccagcttgtacgatttcgattttatggccgcgccaattgttaaaagattggttattcatgagtttggttccttaaattaatttgttgctggtaggttatatttaccgtttgtttgtgggcctaatttaataagattgtgattctcattaagcccataaggtaaatgggttcgcgggtttaattcggttttatcagtaataaaaatacattcatgcggattcacgttgtaaagataggcgaccatgcgcggggctacataatgggattgcttatcatgttttgagcgaacccagccgccgaaaactaaatattttttatctatcattttttggaaacagcctcattttttaagtgttggttaagcagatcccggacaagatcgcccacgtttggcactgtttcaatgtattcgattaaatgcttatcgcgttccttgagtagagaaaaatttttaattacgcgctttttctcataatcgcttttttgcttttgccttgcttcgctttggcccattatttacaccgttttacagcttggttatattgatttcttgcaatgttggagagcgttgtagttttggaattattccgacccgcttggcgtgatgaaccaagcgggcttttttttacatttcttcagccataaacacggttaagaagccacccatatcattggcaaaaaggccgatagattcaataatgcgctttgcttcgtttagatttttaccttcaaccataagccaaacatcgcgtttcactttatattcagggcctagaatttttttaagtggcttggtcaattcgcgtggtgtttttacttgagtgtttccgatcattaacattttgcaaaactcttatttatctatttgatgtgtcaattatgtcgtattacgacaagcaaggcaatagggaatgtataaaaaatatatattttttaaaatggttccacgtggaaccgtggcgggcgtttatgttgcgctttcgctttattgatatactaaaaacaacatagcgggagtatttaaaaaattggatcaagcatttttaaaagaaaggatcgaagcgacaaagcggcaaattgtggcctatgaggatgcagtaaaccagctttcaagcggtgcggttcaatcgtactcattaaacacggggcagacgacgcaaaacgtgacgcgctttgatgttgcgcgcctaaatggggatattgacgggctttataatcgcttggcgacgcttgaggcgcgtttaaatggttcgggttctactttggttcgtccgggatggtaatagatgaattatgattttagccgtgggctggtaaaggttccgacggtgggtttaaaaaccgagtttaaatattcaggggctacaattgcaccgccgccaatgcagggcgcaaaatccgacgctatcgaaataaacgcgctgggcggtgggttcaatcattccgcttttaccggggaaaaatttataggcggtttcgggcctacaagtttatttactatggattattggacgttacgcaaaagatccgagcagctatttagcgaaaacttatacgcggccggattaatcgagcgtttagtaacaaatgaaataaacacaggattaaccccggaggcttgtcccgatgaacggattttgggattaaagccgggtgatttagaagattggacggaattagtagaaaaccgattttctatttgggccaatagttcggaatattgcgacttttacggacaaaacagcttaggggaaattcagcggatcgcaagacgcgaagcccttatttgtggtgatgtgctggtggtgttacgccaaaaccaaagtaccaaaatgccgcaagttcagcttgtaagcggatctttaatccgaaccccgccggatatcccgcgcaaaggccacaaaattaaacacggtgtcgaattagatacgcaaggccgccagtgtgcttattgggttttacaagacgatggaacctataagcgtttgcccgcgtttggtgaaaaatcaaagcgccgcattgcgtggatggtgtacggagcgcaaagacgtttaggcgaattgcgcggccagccgcttttaagtatcgttttgcagagcttaaaagaaattgaccgataccgcgacgcggcccagcgtaaagccgttgtaaattctattttggcaatgtttattgaaaaaacgcaggataaaatgtccacgttgccaattaccgggggcgcaatccgacgtgataaggttacggataattcaaacaccgcggccccgcgtagctttgaaatagcttcgcaagttccgggcgtggtattgcaagaattacaagcgggagaaaagcccgtaggtttccatagtcaaggcacagatattaactttcccgcgtttgaggaggccgtgattagtgcggttgcttggtgcaagcagatcccgccggagattctaaaactgtcgtttagttctaattattcggcaagtcaggcagccattaacgaatttaaaatttatttaaatatggtctggaatgaatggggcgctaacttttgccagccgatctataccgagtttttaattagtgaggcgcttttagggaaaattgacgcgccgggctttttggacgcatggcgcgacccggtaaaaatggatatttttggggcttggttgtggtgcgactggttcggcagtattaaaccgagtacagacatgcgtaaaatggggcaaggcttggcgcttgccgtggaacaaggttggacgaccaacgcccaagcatcgcggcaaatgttcgggactaagttcactaaaaacattgcaagacaacgccgcgaacgtgaattacaagccagccttttaaggccaatgcttgagctgcaaaaagaatacggcataagcgcggagcatttagtaaatgtagcccatgcgattggcgggacaatttcggcacaaactgaagaaacagaggaaatttaatggattggtttttaacgcctgaagccctaaaagaaattcaggaattacacgcccgcggcttggttttgaccgcggagcaaatgacggaatttaacgcgctttattcggatgatttccccggatcgcgtatttttcaaaaagtggggacggttgcacaagtaaacattgccggagttctaacaaaggaacctaattggatgtatcgctattacggtggcggtaatacagcatatagcgaaattatttccgcgattaatgaggcggagcgcgacccagccattaaagaaattattttggcgattgatagccccggcggacaaacaaacgggctttgttcagcgatggacgcaattaaaaacacgaaaaaaaccgttttggccgtggtggaaggtcaggcagcaagcgccgcttatggccttgcatcgcaagcaaataagattattgccgcggatcgcggttgcatggtcggaagtgtaggcgcggccgcttcgattgttgttagcgaaaatgttgtcgatattgccagtaccaacgcgccaaagaaacgcccggacgtgaccacagacgcgggtaaagcggtaatacgtgaaacattagatcaaattgaaagtatttttattgctgatattgccgccgggcgcaaggtaacggccgataaagttaaacttgagtttggtcagggtggtatgtatgttgcggcccatgcccttgagcgtggtatgattgacgaaattaaaacggctgattctagcgctacaacaaacgcgaaaagttcagcaacttacacagcaagcgaggaaaattcaacaatggatgcagcaactttaaaggcgcaattcccagcagtttacacagcaatttataacgaaggcaaaaccgcagaaaatgagcgcgtatccgcgcatttaacgctgggcgaggcttcaggcgatatgcaaacggctatttctgcaattaacgacggttcagaattaaccgcaagcattcaagccaagtatatggcggcaaatatgaagcgcggccaagttgctgggcgtgaaacagacgacacggccgcggctaatgctttggatggtgttaaaccgggcgcgactgctacagatgcgaatgcagttacaaacatggttgctaaaaatttgggcgttgcataagcccaaaccgtaaagacattttagaaataaaggggtaacagttgcatgatgcaggtaacgcagcacacaaacagttcaattaattggggtgaagtagcttgtcaggatgacacgctaactttaggcgcaaacgcaacgctaaaagaaggcacaattttagcccgtgcagcaacgggaaaacttatcccgtttgttaagggtggcgcagatggggcgggggttcctgttgctattgctatgcacgaaattaaaaccgtggccgctggtgatgtttcagtacgtgcgggcatttccggccaagtgcgtaaaaataacttagtgatccatgccgatggaaacgcgaccaatatcgacggagcagtaacagacgctttgcgtagttatggcattgtcgctttcacagtaaacagcacaaacaaaccggataaccaataaggaatttttgatttatgactactagcacaattgccggggtatatacacaagttgcaccaaagccgctatttttatcgggctttttcaaagcaccgccacagaatcattttaatactgaatctgtcgagctggacattgagcgcgattcgcagcaagtggccgcggttgttcaatcgcttggcagcgactacaacaaaaacgaaacgggtgaatttaccaataagaaatttacgccgccagtttataaagaaggcttttcgcttaatgcgttcgatttgcttaaacgtgaagcgggccaaagcggttttaatacgcctagcgaacagatccgcggcaatttgattacccgctttattaaaggcgcgcgaaaagttgaagcaaagattttacgcggtattgagttgcaagcatcgcaaattttgcaaacgggtaatttgttgctgaaggatcaagaaggcaaagacgcttttaaaattgattacaagccaaaagcaacgcattttgtgaatgttgcgaatgtttggacgggtgcgaatgccgacccgatgaaagatcttgaatcattgtccgaagtaatccaaaccgacggccttgtaattcccgatattatcattatgggcgcttcagcactggcagcggctaagggtaacgagaagtttattaaaaactttgattctcgcaatatttcgggcaatgttttagctgatatgcaaattacggcccgcggtggtatctatcaagggacgttgcgcgtaggtaatgccgtttgtgagctttacacttatggcgtgggttatcaggcttcatcttcagcagttgcaacgccgtttttaaataccaataaagtgcttatgcttagttctgaatcgcaattagacgcgctttttggtgcggttccaaacattgcggacattttgggcgtgagcttgcgcgaacagcttttaccggaattgccgacgcgctttgattcaaacagtaccgatttatttacaaatgtgtatttgtcggcaagtggtgagcagcttatgggcggggttgctagtcgccctattcttgtcccgacggctattgattcattcggctgtttaactgttgcataaaaattaaaatgaacccccttcaatgggggttttttcttttaaatttggagatattcgacgtgactaaaaccgatttaattaacgcaattaaagccattgattcaaacgcgaaaacgtccggccttgataaagacgaattacaagcccttttaacagaattacaagccaaagcgac

SEQ ID NO: 3 - DNA, 167285 bp, Unknown
  Description of Unknown: Bacteriophage F488/08
tctgaacgacctgccattttatccatgtctccaccgtcaattattcttgcttctttttcatcttttgctacagtgtaaggatttgctgataaagcatatctaactaataaaccgatagatggctgcaaactttctgggtcaactacaactttaaatgcacctacatgttcagggtcatctaagtcaagaccttctgtatacggagcatagaaaattgatccaacaatttctttttcaccgatattttctactacaccaacgattacataatctaatgggctgttagtatcgcaataaagcggtaaaccattagctaagaacccataggcattttgtgaaagatatttatcatcttctggtttatgttttaaccaacctgatgcagcaagaatcgcagcagcacgagctgaagcaacacagaacgttgctgtataagttgattctttttggatatgcgaaaccatttcacataccattcggtataatgaacgaccagcttcaggtgcagatgcataactcaaatcgatgaatccagtatcagtaattcctgtaactttatagcgttttgacactgtaatcaaagactgcagaatatctttattgatttcatctgccatttcagttgcaagcaaatcttccaagaaattaggagcatcgaatccatttgcttctaaatcttgtgctaattcaactgtgataccagttttaagtttacgagatttaactgcggtttgccatttattaatctggaatctagcatccgcaatttcactatcagagctttcaaatttgcttgttgacgctgcgtcagaaaatagacgaacctttaaaagaacaattgcaatctgaagagctaattctaaatcgctttcttcaatatcagcaaatggtgtatcttctaatactttataaacgatattattatatttgaataaatcgcccttattgagagttaatttagactcttctgttaattctgtgatttgttctcggtctacatatccagcttcgccggcgtaagtagcaccagttttaaatgtaaattcgttatccgggttaaggtatttgataccataaaaagcagcaacaggttgattagttctttgcgttgctacaatgtcagaatatattaatttagtggtagcgcgagtcaaagcaacgagatttgggcgaccgattgagttgctattcgttgtggttgattcgcgcagaagttcgttgattttagccattgcgctttcctttcagtttatatgatttatttataccataaaaacaactaaagggacccgaaggtcccttaaatcgtcaaagattagatacctttaacatatacacggcggaagtaagcgtttttaccaaggctattcagaatagaaggcataccgctctggatgcgagaagccggagcctgagcagcggattctgcaaatgggttgataccgataccgtaacgagttttgaatcccattaccggttggaagttcttcggatcagaaccacgcagcggagtcagagctacatatggagcatagtaaataccagcatccatttcgttcggacctttataacctacggtgaaataatcctgtttagcatactggtcgatatatacacggtatttaccacccagaacaccagcaaatactgacttggtagtatcagtgttaaagccagtagccagaccttgtgcagcataagaaatgccggtatcaactgaagccagaacgttaactacgttacgggaagcgataatgaagttaccttcgccgcgaccagtctgacgagcaatttcaactgcttctttgtcaatctggaacaacagagctttaaaggattcacctgcccagcgagcaccacgaatatcgattgggtcctggaagtcaaatacaccagctttagaacccggagtcagggtcataccagatttaccaacctgagcggagtagttaatccaatcaacaacttcgcggttgatttccagcataatttcggtagccagaataccagacagttcagcatcagcatccataccgtgaacagcgcgaaggtcttgtgctaattcaatagagtaagcagctttcagctgacgagatttagcttcgataacttgtttatcgatacggaagcccatttcattccatgggttatcggtagaaccgttgaaaccttcctgaagttcagcgatagaagtagccataccttcagcgatttctaccagtacaccagcttccatttgtttcttaatttcagcatctaatttgtctgcgtcagatgcgcctgaatcaatttgtttagctgctgtagcttgcagatatactgtaccagtttcctggaagaagtgagtgtaaatagttccgacttcaagagtatcacttgctttcaaagcagcgaatttcttagcagcaccctgaccagagaacattgcatctggaccatacattgggtggaatgcttctttagcgccggaagcgattggatctttaccatatactgcgcgcagcgcgaatacctggccagtcgggctgttcattggctgaacaccacaaatatcgaaagcaatcaggttaggaatagcacgacgtaccatacccataacagctgggccaatctgagttactgcgccagaagtctgacctgcggcgatgttggtagcattgtaaccgtggtcaccaccgatttcagcttctgttaagaaagaaccgaatgcctgagcaattttttcgtctttatattccggagctgtctggaaatctttttcctggttttcaaagattttagcgataatcgcttgtttgctattagcaatttccggtaaaccttcaccttccagtaatggcttccatttgttcaaaagttcagctttagttttgatagtcatttgtgttaacctttaaaattagaaacgagatgcgactttcgcatatacacttacaatatcttctgcaccttgtgcagatttatcttctacagcttcagtgacgaaattcagtccggctgcttcagtatcaggagtatttatactctcagtaatagtgctttcatctttattagatttcttcaccatttctacgattgcactcaatttacttgagaatgcatctgaataatccataccttcgaccagagcagagactttttctttttgagactcagtcagatctttagtactttcgctcaatgccacttcacgctgcacataattgatatatgcgtcacgcttattgagttcttcgaacagacgagctgattcttctttatgttcttgcagttcttcttccatttcagctacaacatcaactgattcttctggaacaacaacgttgtgttcaacgaagagctctttcaatccaccaagcatggattcaaacagttcggctttgatacctttatctactgctaatttattttcagtgagccattcttttgcaagatggtcaaggaatttagaagcttgctcagcgattttcttctcagctttttcttctgcttcttctttatttttttctacttcttcttctgctttttcagcaattttagcgatatgagattcagctaatttaacggcgtgctgcttgacggtagcttcgaatacagtgccgaaagtttcttttgcttccggagaaatattaactgattcgaaaatactatcaagagcaacggaagcatcaattttctgcgcttcggcaatcagttgttctttaagcattttgtagtcctgttgtttagataataatatttataacgcttttttcatggcctctgcgagagccatataggcgtcatcggcacttgtatcggcttccgccgtctgtgattcggtaatttccttaggagttacccatgcatctggagcacttggaccccatactgcatcaacacctacagttaatttgaatccttcgtttacgatacgataacctttatttgtgtcagtcaatgaacctaatccacgagaagaaactcctggaatccatccggcacgaatattagctgctaatttatctccaggaccgtggtcaccttcaataacacgagctcgtccgtatacgtcatttcctttccaccacatatcttctataatgatagcggcttgcatcgggtcaacattagcgcgtggaggatgatttaattctccgagagcttgtttagttaaaacttgctcattaatatagtcttttaccgctttttctaatatacgttttggataaagacgtttatttctattgacgacttccgcttgcatgaatattccttcgatgtataaacccggttttaaacctaagtcttttccatcatgagattcaagcattggtacgccatcaataatttcgccaggttgaccccaagtttcaattagtaattggggttcattcattagcttaatcctaatgctttacggcgtttaagagcttttttacgcttacgctgagcacgagattgacctgctggattggcaatcttcgttttggtagctttacgagcaatttgtctacgttttgctttagacaacccggtagtttgaaatgcattacgttcgcgggttttgcgatctttagtgcgagtaatttcaccacgggcagaaacatgtttaacgataaattcatttaacggcatattttcattaatagaagctaatgcaaccgctaaatcagtttcatcatcaagcatattctcgacaattgtatttatatcgtctttatttaaagcagaagacaattcgtcaaagcgaccctgtgcttcaggaataagtgcttcgacattctcgagaactaattcatgagtttcagggatcagaagcattattcatcatcctcgtcttcgtcagagtctttgtcttttttgtcgtctttatcatcactatcttcgtcttcgtcatcatcctcgtcatcaggttcttcaccttcgattaagaaattacgagcgatagcgattttttcttctttaattaaatcagtcgttcttgcagccatggcttcagcaaataatttacgagcggctacgaggtcgtttgatttaatagcttcaattaaaccttccattaaaaatcctcttgttcttggtcggggtcttggaaacgagcctctttagactcttcttcaatttgcttggcttcttgttctatttcttcatcagtcatctgcaaaatatctttcatagcagttctgtgagaaatatatttaccaataaatggttctgccatggttagcatattaattcttcgttccaaaatttctgcttctttgagctcagcaaagtagctatcccgatgaaattctatcttaatattatttatttcatcattccactcatcttctgtgattatacctttaagcaaaagatttgttttaagtggatctaggaaaacttcttcaaacttgtgctgtaactcacgaataaatttagcaaacgttaattcatcacgtgtaatgctagttccagaatcaaacatcacaccgccttgttggtcttgtggaatgcgtgaaagaggaacacgtaatgccatgtaaagagcttgtctaaaccaacgaatatcttccatattgccagtattatcagcaccaggaagagtatcaacttctgtcacagctttaccatcacggcgctgcaaccaatagtcttcggtcatagacatattatgttgttgattttttattttacctgttgatgcatcatatactacacggtttttcatcgtgttcataacatgttgcatgtgctcagcagctttacgagcaggcatattacctgtgtctacataccaaacacgacggtcaggagcacgagtaatgcgataaatgactacagcatcttctaataattttaattggttagcaggtttaacagcacgatgtaaatacccgatgatatttttgccacagcaatcgactaatccagaatgggcataaacaacagcagcttttggaatttttatttttgtgccagcttcatacattctaccatcacatgcatatgactcatgggcagtatcatatataaaatattctttgtaacctttaactatttttgtgccagcttcagtttctgttataatttcgcgaacatactgaacttggcgagggtctaatctacgtaattcttttatgccttcttttggacgttttggatcaatgattttatgaaagaaaattcttgaatcaacataccaacgtctaaaatgatcagaaccttttcgttgaaacgatagatgatttaatacatcactaaattcatctaacatcatatttttaatttttggactaaatttagatttatccaaatttaacgctacgacttcagtatcatcttcgtagacgatagcatctgaaacgatttctgaaactgcattatctacttcatagttattcatgagattacgatatgtatcaataagctcacgagtagttttcattcctggttcatatgaaccaaaaattgtttggaatgcagcattataaggagaagcagcttcattcgagcttacttcaaattctcttgctccatcatcaagctttggggctgtaatggaaacaagatcttctttttcttggtctttaaaatttcgttcgtccattttagcccatggagcaaacaaacttaatacattaaatttcattgtattctccaaatgggaattatagttatatttataatggacttctctgctttaagcaggatggggatttctccccattcattttattcccaataatcgagagcaagagttacttcaaaggtttggatttcattgtttgaatcccaatctaattgaagttcacccacgttagtaggccacagacctttaatttcaatttcttttgttactgttttagcatcacgagcatattgacgaacaatagcgctctttttatactctgcaggttttccaccagtaatttcgtttccttgaccagcagcaatgctttgccaatcaacaaacttctggcgagcatcatgagcttcatcgttcattactgtaacagtccagtcatcgaatgtacgatcgcctgctacgttaattttacggttcataaatccgactggaattttttctacaataccagctggtaaagcagtggctttacattggaatgtaaaattttgtccaagataagaaatttctacttggaataagttaggtcgagcaaaatcaccagattcaaacgctcgtgttacatcatctacaaacatattagcctctgtagtatttatatccctatgtttaacctagggcatatagaattaaagaattaaggatatagtgtatttatatggcctgccgaaacaggcctttagaatgcaccgtattaaccagcaagaccagttaactcatcgaaatctgcaccagtagcagttgctacgaagttcaaggtaatgtagttaatgcttctagccggttgaatgtagaatgttgcaacaaactcatttctatcaattactgacggagtgttatttgttgtatcgcaaactacacgatattcataaattccaccgagagctttaattccctgtaagtattgggcagtttctgtgcggaatgatgaacgagtaaacgcgttgtttaattcgaacaaacgatattttgaactacgtccgatattcgttttcaacatattaaacagacgacgaacgttaatacgatcaaatggagaaggaacagaagtagctgttttatcaccatacaatacgtaaccatcgccacctgtaccagttactggattaatagcttcttggtataaacggtcgcgctgagcttggcgagtttcaatagcaagtttaataacgttaagaatctggccacgattataaccagctggagacatccaagtctgagatacgttatcagttcttgcgcataaaccagcaatatcagctgctaatggaacccaacgattcacatcattatatttgtcatactgatatttgtagttaccatcaattgctgcgtaggttgaactgatattaaagttattatcagtgtatgaacctgctgcagttctccagttaactaaattatctactgcacgagttacaggaattccaactacagtttcacgcggaggtgagcacaatactaagcaatcttgacgagcatcaccaattgaaacaacatgtttttggacagtagatgctgtttcaagagattcaccggcacaagaacccgcaataaacaactgaacgtcaacagattcgcggtcagcaaagaagtcccaagcttccatcaaatctcctgctgttacttcagcatttgatgataatccaccagacagagttaaaattccagagaagccttctggccagttttgcgcagttgcgaaaatatattctgaaccaccttttgcgaaaaagtcatcaatatagatgttactatcgtaaatatctttttcaccacgcttagttgaaagaacaacgctttgaacaatagcatcatttcgacgaactataatagcgtactgtgagtcagtctgcggcccatatccaaatactgccttggcagtagatgcacgagtaccaccacctggataaattggcagtaatgcagaagcgcctttcgcatagtcagctttagatacgatttcaatttcaattttatcgcctaattcgcctggatagagagctactactcctggaattccatatttttcaagatttgcctgaaaatcaactgctgtcatagcagtttcagcgctctcgatttcagctaataaaataccggaatcagtaataatttttccaagagttattactgcagctaaaccggaagaagatgaagaaatttctgcagtccagttagaacctaatgttgggtattcgccaacttctttagctttagcaataatttttgcagtaggaatattaattttcttaatttttccatcagcatctacttcggtaattttaccttctgtttcaacatcttctgaaacatatttgaccgtgattttatctccaaccgcgtagttactacctggggtagaaattgtgtattcaatattaccagcaatcggagatgagtttttagcggtatctctatcgacagcgcgcacaactcgcaaatcatttccatattgtaagaaattcattgcagacataaaatagtcagcagtttcagctgtaggttgaccaaaagtattaactaaatctacttcgtttgtaacctgtttaatctgaaaagcaggaccccactggaatttaccggccaaagctgctgtaccagtagagttattaaccacggtgctttgaaccgtagtttctttgagctcaatgcccggagataataaagtcatttttaatcctctttaatatgctttaatatatttataccattgacataccatgagatactggaacatactcagcagaatgaaccgaatcaacaaatataactggagcgtattcatcccccatatcttgaagctcttttgaaaacacttcagatgctaatcgcatgtcatctttgtcggcataatcaataaattttgattgtgttgataaccatccaaaaattactaaagacattactaaatcgtcatgataaccttcttcagccgcccaagacacgcctttttcactaaacgttctaaattcttgaatagttgcacggtgatgaataataagcttatctttttcaataaggtcttttaatgtagagcatcctactgctttcgttcgtttagtttgcttcattcctaaatcagtatatgaatcgcaaataacgccttcgtattctaaatccatgtaaagtgatttcgcaactgacacaccagtactatttaattcaatataaactgggcattcattatattctactaaataacgcataacgatgtcaggcagaattaaatgagaaatggtatttgaatgtaaaacaccaacctgttcccacacatcatcggtaacatcaataatatgtaaagcgtggtaatcttgcccacgaccttctgaacagtctaaagttgcaatgtattttctatctggttcaggtcctttaaatcgatgaaaaccatgatcatctggagttacttcaatgaaatccataacagccaatttcattcctgaaattaatgtaccagaagtcccttcaaacgctgcggtatgttcttgacggaattgtgctaaagtagaaccattaatggtttgtatgctccattgccatccatcgtcaaaaatatcttcatcattataaagacgttctttaactgaattccaaatagcagtgtatggttcaaatcctgatttaccttcaacagcagcagtccaaatatcataaaaatgatttaatccattaggagtcgtagtaataataatttttgaacgacgaccagatgaaattactggttgaatagcaagccaggaatcatggaagtttggaataaatgcacattcgtcaatataaatcattgcgaatgagttaccacgaactgcgtcaggagaggaagcataagcgccaattgaagaaccattatctagttcaatagaccctttattccattcaactataccaggctgtaaaaagtcaggaagcagttcaattgcttgcttagtacggtctaaaacttccgcagacattgagcctttgtgcgcaagaatacctacagctttatccttgttaaaacatacaaagtgtgcaagaaaaatagctactacagttgttttaccaagctgacgtgatagattacaaacagtcatacgtttagatgacattattttgagcatatcacgctgatagtcacgtaattgaacctttatgacaccatagtcgatatgagtaatggcgcagtatgtttctgcaaaatatacaatatcatctcggcattttttccattcctcaaccatttcacgagtccattgtgttttaatattagctcgttttaagttaggaagacccatataccgagatcttttattattcttatctttataagtttgaaataattcaggcttatcagaattatttgggatttttactattttgtgtaaacgaagataatcactgaatttttcaggataccattttccatcccactgtgattttatccaatgaattccatcttcatcttttctttctgctaagcttgggtgttttattaaaatttttccagcttcatttaatggatggaaatcatttaatgcattaatcggttgttccatttatcaccttctcacgagcttcttgagcctcgtaagcatcaccaatttcgtccattaattctgttggtgaacccatgaatactgtcgcgttctgaatattcatttgacctgtaggaacagcgcctttagtgccaacctgctcagatgtaatatctttcatatctttatgaagcttcagtatttctctgttcgtcgtagtcatttgccccataagagttgcaaatacttccatgtgacgaggagaatcagcattctttgccgtctcaagaaaaatcttggctgcgtccattagcatttgttgttgaaaatgcatatttcgacgaactactccataatcatcttctaagtcaggagtacggttttgaggattgcttttaacttctactaattgtagaggttcatatactttaatttcctccccgtcgattccggggaggtcagaaatatctaaaagtttgtttatatcaagaccttccataataacctctatgttcttgggccaggaggttctggcggtgttggtctatttacattgctagtgaaagtttgttttactgttccatcccagtcctctgggttaatatctcgaggaacaacttcgctatcaacagattcaaaaacaccttcgccatcaggcaaatctcttgtattggcgtgaaaatctgtataagtagtacgaattaatccttctgcatcatctactggaggatacatccatccgtttacttcaaatgttagtgaccattcgattctacgacgagataaattatctccatctatagcttcatctatagcagcagacatcagtacaattttaatatcccttttaaatggaatatcatttccaaactgttcgtacatagttgtattaaaatgaggttgaaaatatggaagaatctgttcaactatttgaaacatatcgtcttcgtaacgagtaaagatactcaattcataaatcattttaataggagatggattatactgcgatactacagaagttgtacctttttgcagtaaattctgatttaaaatgtttgttttaaatggagcgttatagctaaaatcaactaaatgcaaatttatacgaggtagaatagtttcaaccttggccacatcttcttgtgaatttatcgatgtccatttattcaatttcatcataaagtgttcctttgatgcatacgtaataggaacacgtataaacttatcaccagattctaactgacgtttgatttggatatttgaaaacaaatcgcccatcaaggtagcatatcgtctaaaagacgaattataaaaataaccaaacatgatttctcctaatctgggctttaattagtttataatatttattaatccatgaaatcattatcaaatgggctagattcaaaagatttgcctctgttattgacaacaacataaggttcaacatattctttagcttcagaattaatttgatctacttcagcatattgatcaatattaatatcatgaataccgttaagattgcgaacaggatttagttctaattcactaaattctggaatgttaattccttcatttttctgtagaactggattaatttcttctccagaataaatgaatttacctgctgtaattttacgaatagcgttttgacctaattgataaaatggatcatatggttcaacccagttaatttcaaataagctgttatccataggaaaatatatcaaatcgccttctttcggttcttttccattaacttggtgtttaaacaagtttggattaatggacaaagtaacttcatcctgtacttgcataccaaagttactaaagaacgatttagctccttcatatccttcaaatgaatttaaatatgcagcgaatttccaagctttagtaaatttattttttaagtcttcgccaaatatcaaatcaggggaaacatactctcttggaacataatagcattctacacctcgcatttgaatgctttcagctactaatacatcagctaatatttgactgtttttataatgattgaaatttacataaggatttagtatttcagtttcattggtctgagaataaccagtgcggttttccaatttagcaaaaagatttttatcataagtagccatattaacctaccaaaattccaaatggaggatcgagcaagtataattcttcacgtaatgcttctttttctaatcgagcttcttctattaagcgttgtccatcaatcgtaacaccgccaggaagcatcataccttggtggcgtgctaaaatttgaccattcaattctttagctaaagcagtagcatagtctttcacccaacgattattataagcaccctgtttaacatttgggtcttgaccaacaacacgaccaactaaattgtggtctgggttattatatcgttcagataatgaccagctatcttgtggaccgactgttccatatcctactgtatttccaaccattttattagtatcaatgtatgatttagtccagctttctacgataattaaatcatatttttggaagtttcccatgactttgagctgttcatttgctgaattaaaccaaaagtctggaataggagagagcatatcttgcatcattcccatgtaactggtaagctgggtaaaatatcctaaatcagctccaaaggcatttggtccataaaatctattacaagaagtccccataccgccattaataccagccattcctaaaagaaaatcagtaaaccatggatatgtagcgtttccgtccattgacgttattgatccaatatttgttcgcaaaatgcgagttactgcgaatacatttgaacctcttaaatcgaagactccagttttatatttttcttcgtcatctcctacataaaatacatgaaaacctttgttaagtccatcaaaatggtattcaccgtataattctagggcacgctggatacaatcataaatttgatcgggtgttaactcaacattaataattggagcccctaaacgtcttagaatgacatctttgagttcctttggattctgagaattatatcctgacatttaaaatcctttggggccttgcggccccatgttatgctggtgataaaaaggtagaaagtagtacccattcgccgtctttacgaacgtaagcttggccatcttttggagcttcaggaatataacccgcttcttgtagagcttgaacgctgctctgtaaagaggatatattgtctttagctgtatttacttcatgcgtgactgccgcaatgttagtttcattcgtttttatagaattagttaatcctcgttcttcaacagttgatccgtcaggattatttccatttataagtgaagtaagttcaataacttgacctttaattcctgttctattatttcctatttcaacttgtatattttgaacattattgtttaaaactgaaacttctccttcaagcactgaaactttatttaatagagatccagaaggagacggttgtcctccgctggagtcagttccaacaatttgatttaaccacgaaacattcgctcttaaaccagacgaagtgttttcaccaacaattccgtttaaagactcaatagaagttgtgtgatttttaatttttcctttaatactagaaggaatatcatctgaacctatagaagtttcaatagccgttaagcgctgtttaacaccttcactctgatttaattcattattaatagattcaatgctacttttgttattattaatttctgttattatagaaacattttctgggtatccaatagaagatttaatttctgctatatcagaatttattaaagtttgtttatcatctatagtgtttaatctattataaatatttggtccaaaatctactggtttattaccaagttcatcgcgtaatttaccaacttcaaccgtcaatgatcctacgtcagattcagtaaatttattttctaattcacttaaacgaatgccttgtgaagataataatgtactatttgttattattctatgtttcattcctgtgctagcattaccaacaacaggaagaccgttaatgtcttggccagaatattgccctagttcttgtttaatccacaataaatcatttctaattgttctataaacagagttttcttcatcattaaatggacctatatcagcaataattttgtcaactgtattattagttccagttaatatatcagtgtgttcattagtaagtgtctttaaatttgatatgtcatttttattaacactgatctgcgatagtgcttctatatctcctgatacatctaaaactccttgaattgttttaatatctttctgcgatgtttcaatggcagttttaagaattcctatattttcgtcaagaacctcaacatttttaaacacggaaacaattggtctattcattgatccatcgtttccatacttagtgctagctcctagtatttcttcaccatttttaatccatgaaatacgttcctgaccttcatcaggaacgctatcaacaaaaggtaaatcttttaattcaatcatttgtaatccttagtaatgaactttaataatatagtttaatgatatattccatggtctagtttcataaccaattaatccttcacgattaagtgtaccaagggcatctctcggtccgcctaattcaaatccatcattagtgaagtatgaagcattatcccagtcggcatattttctagttccaagatatccttgataaacagacgcgccaaatgggccttcacttctgttatattccccccaaccaccggcgtgtttatggtatgacatttgttgtgcttgaacaccaccaacatgcattccgtcacatcctacgccaagtctatcctttccataaccatcttgtcctcgttgatttaaaatatgaccgcctgtgccagctcctctgacgaaaagaccccgcatatcaggaacgccaggattattccaatcgccaccaaatcttgttccaactacgtttctataatcaggaaattggtcacctgacacggttccaccatgacacataatccaacctggaggtgctgaatcacccgcaaacatcataatagttccaaccggaactcgttcggacgcatatctttcagtggcaacaggttgatcgccatttttccacattccaccgcgtgaccaaattccatttgctgtaagatggtctaaatttaaagaaccattaatagtttgtccaccacgcgtattaattacatctgcgttccacgctaatgctccagaactatcaccttcaggggcaataccggcttgcgtcgttaatttaactactccacgcatagaaccagtagctcctcgaccatttagtgtttcacctgttactgcaacatctcctaaattactgttaatttccgattgtgttcctaaacgtataacacccttatattcttgtgttgcaacagaattcataaaggtatacggagaaattgcatatccttcgcggagagttccttgacgagtttgcgcaacagttgataattgaaccacacctctcacagattctgatgcagtatcttcggaaggagctatttgtgaaattaattttattgcgagtttttgggtttttagcggagtcatcgccgtagtatcatcaacaccagccaaagccgcaggcgtagatgatattttaataaccccgtttgatgactcagatgaatatctatttcggaacacatcatcagtatggtatttcagtttttgcggcgttattgatgaattattatctgagccttctaatgtttcttcatttgttgaatagcgcgttaaaccatatttagtttcagtagcatttggatacaataatcttgttgctaatgtagctggtgtaacgattttagaattatttgttccatctaaaacctcttgctctgatgcaatcattgctattcctttaacttccatagttgcatcaggaataccatttacgccgatattacttatttttgataatgcagactgtactgtcgtaacagtgccaggaaaattcgatcctactggatcgaatttaacatattttgattcatttgatacgtgctgatatgtattgttactcatgctattctctcaaaataataaaatactgtaggttgtgtgtgactatctagcgtaacagtttgcgcacctaataattgccaagttccatacccgggtttagaaggagaaattatttcttgtttgaaagtaattcctttatcagagtattgttctaagatatgttcttggttatctaaatacttaacttgtattttattccctatggtaggatggtcttcaaatgaatcaattgcaataaattttacaaccatttcctgtagagctgttctaacagcactagtaaattcaattgaagtcattccattagtagctttaactggaataccaaacatgttaacaataactgggtcacctggtttggctgaagtatcagtaacagttccttcaaatgaccaatagtcggtttgttgcacgccagtaggagatacgccgcttatattaattaatacagctccaacctgttgctctgccatatttctaacatcattgatagcagattctacatttgagtcataaaaaccttttgctatttgtgaaattgttacagcgcctaccggctgattattcataaccgaaatatcatttttcttagttctaaaaccaagaaaatctgctaagcgggaaataactcccgctttattattaagtaaactcattatgcaatccttatccaacggtatacagtaatagacggttgaatattactaatattagtaggaggagtatgtgaagagtttgttgttgcgtagtcttcacgatattttgtatatataggaccagtttcgtctgggtcatattgacatcctccaataataactgatccattttcgtcttcaattaaaactctttcatcagttttagtcgcaggaagatttgcgttttcaagcgttactgatgttgtaccaactgttccaccggcagtatgtgaaggatttccgctagaatctaaatcattattgtttaaagcaaagtttggatccgtaacatcatcattccatcctactaaaacttgtcctttaccaaataatttccatgaaccaaatcccatataagtcaccggattatttgggtttatagcattttcataaattgaaccaacaggataaatgctgtcgaaaatagatgatattgaattatacgttctagtataagaatcaactttttcaacatttggccaaccgattttatcaaaatctgttaaggctacatccccagtaacttcagtagatgatcctttactaacataacggtcatcagttaattcaataatgtcatctttttctaaaagagttcctaaatcattattaaaccatgttataacgattatatcacctgattcaaattttctatcaaataaaagactgacaggttttccatcttcatattctatagaataatctgtgtttgattctttccattcgccaccaagagatatacatccttcttgcgtatctgaattagcgccttcgcacaaaaacagaggatacccagctgttccagcctgttgctgtaaaattccattaaaacgaacctcaagagaattaggattaatgggttcgccaggaattaatccaaaagctgaaaatggaattgatttcatcgccgataaatcagtaacataaatgcttccttctaaagaagtctttgatgttagttttgaatctagcacttttatttggcgtcttgtatatgaacttctccattgtgatacaccatccataaacgtttcaatttgaacagtgtcgccaatattacaaggctgtcttaacctaatattaaatccatcaagaggaattaattctccttcattttcccccggagagccaaagtcactgttttcactaaatacatcgccgtaatataattcgttaccgcggtgttttactctgatgttattgacattataactagttccatggaaaacatctaaaaagtcagtttgtccttgaacttctactaaaaattctttgcgagctacattactaatatctgaactaataattttatcaatttgtttgtttttgacatattcccaacgtcctggagcacaataaactaactctaaatcgctaaattgaacattaatttcaactgatgacgatgatcctttaatagtatcaccagaagcggctactagagtaactggattaacattccatgttgcaaatacatccctagctttaattactttattataatcattaacggttcctttaggaagttgtagagttactcttccagatgaagtgttaatagcatatgattttccccattctgctgttaatgtttgtcctgatgaagcattataagttttccaggcaccggctgaatatggaacatctccatcaccaagctcgtaataaagctcatcaaagttttcatttatttttataccacctttacgcaggtagtcaccggtaccatcatctacaacattaccgatattaatattttgtttcattattgagccaccccgattttctgcgtagcgataactttaactgctgctctcataccgacagttgaagaacttatagtcgctgttacataatttgttttaatactaaatgcaatattagcgatttcgtcttcttcagtttcattcccaactcgcatgacagcatattcagaagaaatgacttctgaattaacagcatctacaagaatatttatttctgccgttttaatttttcttccatctaccgattggcacgtaactaacaatttagccatattgtattcagtgcgatgaaatagtggaatatcaactgatccggatgtagaaatattccatgtaccttcagctggtgattccttttgtccaaacatactttcaatagaataattccaaaccgatgtagaattatcagatgaaatacagcgtaaagttactttactatatgggctagttactactaaattacctgaaacacctttaattgaatcaatagcttgaattgttaaaggattagtaactgatattgatccattagagttaatgaattcaacacaatcgccgagttcgcctctttcaataataactttaacacctacagtagaggtatcaatatcatgtctagtgccaactttcactggagttgcgtactctgtaatagagtgtttttgataatacccagtagcatggataatttgaccatctgctccagtgccatttgctactgccattttacgctgatcgccaaacgcattataaattgcgttaaaatcactattaattttattaccaccgtcgaataagatatcaccagtagaagcgttaccaatttcgccggtatcaatcaatttctttggttcttgaatgaacatagcggtttccttatgagtttatagtatttataaagaaaaagggagcccatgggctcccttaatttaaaatgtaaacagaatattgatttcttctgtttgatccattgccataataataggtggcctattttccatataaatcatttcgcccgaatgcctcattaaatcttctgggtcataataatccttttcagctttaacgtttgggtcatttggatgagctttagcttcaagaggattcgtgattattgatatttgtctaaatcctttatttcctggcaatgcagcatcaggaaaataaactgaatctaaatatgctttaaaacggatagtatttgccttaacccggtaaattaatccaaaatcatcttgttgccaagtgagattatcttcatatccccatctagtcgggtcttcttttaattcctcaggccaaggaaccacaatatattcattcgtgcatctatttatagatacatcgggtggaatctcaaaaagatattcccatacatacccgtccccaggttcaattgttccttcagcatctcctcgaccttcaggaggagtcattgacctaacagaaggtgtccattttccgcctaatttaaggcattcatccttatcagttaaagatgcaattgaacacattccagtatcaggaacatctaaacaacgatatactaaccagcctgcgcctgattcagtagcgttgtaaggagctgagttacacactacaatatcgttaattctaaatgtgtatggatccggatatctagtatctccccaatctcgacgaggaataactgcgtcaagcattgatggaagaacctttactgttcccatcatatgcgtccacatgtcagttacgcctaatacagaatcggttggataaggtggggcaaagcccacctcattttcatttgatgaccacggttctgatcttccaaatgtgataaagatagtgtttttatccggaccacttccaattgaattataaaaattcaacattttttctgttctaaattttgaagtaactatcgcacgatagataacacttgaatcattcatctattttaacctgtgttggattttcagggtctcttggatttcctatattatcttttagacgtttattaactaaatctctaaattgcgcaaatgttgttccagatgcatcaaataaaggactcattaatttacgtcgttcagacggcaattgaccttgaaatattgaattattattttcagcattatagtcatcaggaagaggatattctacaccagccattgggccaggctcataaattgcttcgcctgttactgaatcatgctcaatttcaccggttggagttaatttagctactctatcagcatattcagtaggcaatccagaatcccatttatagtttttatatttattaattattgtctctgtgtgtttaagagttaaaccaacattaataaacatcgttaaaagggtaattgctataaatccaaatcctactggatgaacaaaacgaataacgtcagatttccagcgggaagaaggtaaattggatttaattttcattacatagtatgatctacttctattaatatagtctatattgttttgaagcaaatcctttcctttaactccacgaataatttcgccttcaaaactagggagtctttctgctttaacttcttgaccagcaattaatcttcccaaaagattatgaatagttacggtccattgcaatttaccattagaataacttctttctatataagtaacattacatcttcctgttgccgtataaatcgtttgtcctactaaatcttcagtcaaagaatcagattgaacgattatgtcatattcagtaccggccccagattcaatttcaatttcaacttcttcattataaagaactttaaaaagaaacttgtatgatgcttcaattcctttagtagaataaaaatcatagctacgtgattcaaagaatctcgcaacagcatcacgtttatcagcatttaaataaatgtttcttttatatatctctgaccacaaatattcccacgcatgctcttctcgtggatattggttacgaattaaatttcgtaaattgttatactgagttccatatccatcagaaagatactgaatatatgcttcgcaaaatgcctcaaaattcgaatcctgcaacaaataagaatcaggcatcattgtgccaattaatggtcttaaatcaggatcagctaatccatgctcttcttctggtgaccaaggagtctcatgctcttggttttgtaaaaatgcttttaaaaatactccagtcggcttccaaataatttctactgtatctctcacacgatagttaaaatcatagtaagaaattatttcaccagaagatttataaaaaagcatcccagacgcatattttttaaatcccgtgaatttaacatttggcattactatcgtacaatcaccatcatcccagtattcatgaactaatctatctggtgatgtttccggaatattttctataactttagtgtattttaaatcagcataaactactacagctctattagagttgtttatccaacagcgtgtgttagattttttagaccaattaaagaacggttctgcgtagtatttcattggttgaggagtaaaagtctcccaatcagatttttcatccgctataaatgccatcatatgataatgcttatcagctaaccattcacggggaaattcatatttaacagcaccgattaactgatatttcaccatagtttcagggtcattaacaacattatcacttaaaaatttaaaattactcgaagacagagaaactaatttaccgtcagttgacatgtttgcgtatccaggttgaatacgtcttctttcttcttcggtattaccgaaaactcttttccatgttttttcgtcatgatttaaaacatatattcctttatcagcagaatcaattatttttgaagttctcggattggcatttaatgtttcaacttcaccaataataagagcaaaaactttatcaccgatagaatccattttatagcatactgctttaggatttccagttatagtcattgtatcaggttcaaaaagtctttccgagtatgttggtgataacgggtcagaatctataggtgcattactcgtttttatatatctaactttatctctggcaacaacatagatataatcatccgtacaagtaatggcttcagctatacgatatacattcgctggtaaagtcgcataagtaccaaagatttctacatcaaatcctaaatgtaactggtcgccaagtttagcaaatgttatatcctgcgaactgaatctgacatcatctgctgaccatctaacgtcagtcgatttacggccatagaaaatcttgtcgtatcctagaacgtatgttgtgttcgcagattggtaatatactgtcttagataaaggatatcctacacggtcattgaagagcttcacagctttccaggtttgtcctttatcattagatactttaaccacgggttgataacgctcaaaaagatatagaatcccttctgattccatcaaataaactcggttaatatccttacatacttgctgaatggaaccttgtatttcatgatactcattttcaccaataataaaattactgattgatgaaacatcaacatatgatgggctgaattggaacgattcattcatcaatgcagccattatagtgtcattattaaaattgacataattagaattgttaagagtaaatttttcctgaatgaatttattggctaattgcatttcaatcatgttttgaaatgtgtaagcattcgtagcaaaagtttcaaactcttccgtataaacccaatcagattgctcaaaatcttgtgcagctgtagctactctaatgatgtatgatgttagtggatcagcatcatcaaaaaagaaactattgtttgctgtatatcctaaattaatccaacgatattgatcactcgggagattttcccccgagtctgtttttgtctcagcgatttctacaaaatagtagaaattagcaccaacgtcatcccagcgtacttgcacctgatttgcggataacttggaaattctgagactagtgactgaaggtgcttttactgtcattgtgatataggctccaaatcgatagttaagtattgcggacgtaaatcattttcaaatacaatcagtgaaccatcacgggtaaagataacatcatcggttgggtcagaatataattcaatagtctgaacctcaaatttttcagatgttaaattaattttagcgatattccaataaatcatgtcagccggataatttatttcaccgataacatagtatttgtcgcgtccatcagaatttgctaatttattaaaatcattgcctgtatatggctgaatgttttcattttctgtaacatcgccagaagcaaatggaccaataataactttaccaattcctttagaatctcggtctgttgatactatacgaacatcatataatacatcttcttctaaaccagtatcaggatttacaacctttcgtccagaattaaatgaaaacgtattagattccatagaacgatcttttatttgattattgtatttaatacctgcttcaggtgttttatagaagttttgtacttcacgaaccatttgaatagtcgctgatgaaccaatgacagaatgatctgcatcatctacataagttaacatcttagatttagcgaaagacgagttaaaaatttctacatcttcggtataatagcgatcaattttatcaattatttgaccttcaagccactgctcggattcttgtagtttatttaaagcatatgtgacttttaaattagtcttaataaaaagataattaggagaaataattgatggcgtaataggagctaaattatagtctttgagataatttttaatatcttcacgctgtacagtagttaaatacagacctgatttaggtttagcagcaataaatgcatacccaggtttagtagaatcagtgaaagtctgaactgcctgaataatagaaccaaatctctctgaaacgaatgtatcgtagtcagtcgcagttacgcatcgttgctgggtttcgcgtttaatagtacccaattcgcgaatacgctcaatatcttctggatcaccgcctccatctgccccaacaaaatctgggtcaccgtttggattttcattaatattgatgatagttatatttgttaatgtatctgcgtatgaaaatccgactgctccgttcgcgtcagcaccattagtactaatgtactcaataacaatcgtagagttctgagtaggtttgagacctccgatataattagcggtcaaagctccttcagaagcattaacagaaatttcaccttcaccaaaatagaattcagtgtttccatcaatagtttcacgcatgtagtaaattgttgatgtagaaccagcatgaaccattgactttcttgtccagttaatccattccgctccatcaacgtataatttaacctggtttctatcaatatttttatcataaatgataataggtgtcaatttatcataaatgatttcagttcttactatacgtccttgggccaattttaatcgtggaaaatattggttatttttatcacgaatagcaataacatcttcggtagatacaaagttatatggattaacagaagtatcttttgcatatgctaaaaagcgagttccgcgaggaattgtaatgtaattcctattcaatgcgtcggtgcatgttaacataatttcggtctgcgcagcggattttgaagtaggtaaatatccgttatcttgtgcagcttgaacaactgaacttcgtaagttagcagtacgcataaagctttcatacacagcagcattaccaaactgctgaatgtacaatgtattataagccaaaaggtcacacagaacgtttaatcttgagccttcaaaatcataatccaaaaattcattttggccattaagccattcaatgaggttttgttttatttcagcaaacgtacccccgacgaatatctcgggaatagcatttgctgttcttgttaattgataatttacaggggtatttgccattttaaatcctatttaatgaatactttagatgatgcctgagccacagtatcaccgcatgatattggatcagccatttgaacagctttctttccagtgacatataccttagaagttctgggttgtgtcactccgccatgtgtttcatatggctttttaatttctgtatgttctgtaattggatcacctgctacgagaacagcaattcctccagtgaatactttactttgtgtggcattcacaactgttggaggccatgcttcatggccagcagtaacacacttatcataacttaatcctgacatctatgacctctcatacacatagcttcttaatttattagcccaacgactccaatttccaactatagtttttgtgtaatttttaactagagtttttcttactggagcaggaggatccgtcggttcagtagtatcagaggatgacctagaattactgccagaacctccagattcactttgttcttggtagtcatatattaatgttacttcgtaagtgaatgtcttctggaggttttgaggagctttccataaatacaactgagtatcagaatcagtaggaagttcttcccatgaagcagcagttttaaattcatcgcctaaacgatatttcaacgcgtcatttccaaatccaaacacagattcatatgttccgtataagcgattttcttctactaaaaccccaggagtttcttcgtaactagttatatttatagatactaacgtttcacctgtttctaattgagcggtaaaggtgacgtcgatagaagaaccttccatggattctcctaaatcagcgctcattggaagtatattagccaatgtcaatcctcgatccatcaattgtgtattgaccagatgaaatagaactcatagatgccattttttctgtccaatcaccaccaacgtcccaatcaactgtcccagcaactttccaagaaagatttccatttactgtgttagtttgatttccttcaactaaagtggtagcatctcctttaactgtaatgtcagcattaccttcaactacaatagtaacattacctttaactaggatagttccattgccttcaactgtcttagtttcatcgccacgtacaaatattgtattgcttccatctatttggtgaagacgattatccatgttgtaataaatttctgatccaccgacgttagtctttttatcaccggctaccaaaaaattaccatcagcgttggttatatcatacaaattatcgacagtttttcttgttcttcttcctgacggtgatacttcttcataagttccagtcggatgaactaatctgtatcgttcttgcccaggagtatcatcaaattcctgaatatgtccgctttcagtttccattgtatgcacataaggatattcacctttatatgaagaaactggttctttgaataaaattctcgagtcatttggaataggagggtcagccgggtcagaagatttagctacagtagcagccattgctgatagagacctagctggggttttcacttcaacaccatatgattccaaattccccgtaagaataatcatggtaacacgggatgcacggccttttgtttgttgataccacaatgaatcacgaccggctttatatgctttttcccaatctccggctaacatagcagttaacattgtgttaaatttagctacaccgccaacacccatttgaaatgccatattttctaacgccatttgacgagaacggttgacagcttgccagactggtcctactttagaatgtgatttaatgtcccgttgcatatcagccaaatcacgttcaaataaagtcgtcgcctcttccatcgtaatagaacctgggtttccagtaatttcacgaccaacttgttttgataaaactttattaatttgagccatatcacgaactggctgcttcatgataagatgaccaataccaattgtcggatatccttcagtatcccaataaacttttagtcttaatccttcatcacggcgaagcatgtcagccattgacatatttggattatcatcggttggaatctctgatagtggtctatcatcgggatttattgcagtgtctaagttactatcttggataatgttagaagacgaatcatatcctacttctccgccttggtttaatacattagtatcatttcctaaacgtctaggatattgcccagttgggtcagaaaatccttcaagtctattcggtttttcgcgaactattccaccatacgtgccaaggacaattccgttagttttccatttgtctaaaaaatgaccataaactctagttccttctaccggtccagtaacagaacctccaattccagacattgctgcagaagttataggttgaataactgacatccatggtaatttttcagttggaatacccattacatcgccttgtgctctttgaggtggatgcagaccaaccacacgaacacgaacacgacctaattttaatgggtccattctatcttcaacaacaccaacaaaccaattaaggttattacttatcatttccataagatttctccattatacgtataaggtcgttcataaatgaattaatgtctgattttgctattatttttatttgacgaagtttttcattttcaagaacagcatcttcatacgtattaacagcagcaagtgctccttcatattgaggatattttctagctttatcacctttatcataccaaacatatggattatcatcgtatgatattaaattataaaatttttcaccgttctcattcacatgatatactatttggtctccacctacatttttgtatttttgtatagatgcttgataagctgcttcttgtgaagtaatccatccataatacgggtcataattatcattacacatcaataaaacccaatacaactgtggatttccatatatagtatttgctaattcttccgggcgtggtgaacctttgatataataagtacgtaagcggtatcccgcaagagcgcgtttaaaatagtctttatagtttctaaaaatatctgtcataggaatagtcggcgcgtttttattcaccgttttggccgcatattcaatcggatcaaaaaatgtaaagagcatgggccctcctgtttataaatatattatctatttataaggagaatccaatggcatattctggaaaatgggttcctaaaaatatatcaaagtatagaggtgaccctaaaaaaattacgtatagatcaaattgggaaaaattcttttttgaatggttagataaaaatccagaaattattgcatggggtagtgaaacagcagtaattccttatttttgtaatgcagaagggaaaaaacgtagatacttcatggatatttggatgaaagattcttctggacaagaattttttattgaaataaaacctaaaaaagaaacacaaccaccagttaaaccagcacatctaacaactgcagcgaagaaaagatttatgaatgaaatttatacatattccgttaatactgacaaatggaaagcagctcaagctttagctgaaaagcgtggaataaaatttagaattttaacagaagatggattacgagctcttggctttaagggggcataatggctatttttcaaataattaatgaaagcactccccaagttccaaaggttaagcaatcattaaacgaaaagaaatggattcagataggtcttgaatataaaaaggccaaagcaaaaggaatgaccggaaagcaatttgctgaagaaagaggaatcaaatactctacgtttacttcagcaatgtcaaaatatgcttcaggaattaaaacggctgaaaagattcaaaagcttgaatcaaaaccaatgaataaactcaataagcaagaaagacaactgcttatgataaattcattcagacaaacattgcgcgataaaattcgtaatgaaggcgcagcaattaataataaaaccagaaagtggtttgctgaaactattaagcaagtaaaaggacataaagttgttcgcccgcagccgggacgaatatatgcttttgcttatgatgctaaacacaaggaaactcttccttactgggataaatttcctttgataatttaccttggtttaggtaagcataatttaatgtacggattgaacttgcactatattccacctaaagctcgtcaacagtttctagaagagcttttaaagcaatatgcaaatacacctactattactaataaaacgaaattaaaaattgattggagtcaagtgaaaggatttaggggtgcagaccaaatgattaaggcatatatacctggtaatattatgggtagccttgttgaaatcgccccgaaagactgggcgaacgttgtgttaatgccacttcagcagttcgtttcaaaaggaaaacgtttctctgcaaacaaagtctggtcaaatatctaattctattatcttccattcttttctgttgtttgttctaaatggaattgaatggaagggacttagacccattataccaccaacagttataaagcattatgaggaatatatgtcgcaagcactgcaacaaatttttaaccaagcaaatacaactaactttgtagtatcaataccacatagtaatactacatctgcttttactttaaatgctcagtcagttcctattccaggaattagaatacctgttactgataccgtgactgggccgtttggactgggccgagcacaacgtccaggtgctacatttgagtacgatccactcatcgtgagatttatagttgatgaagaacttaagtcatggataggaatgtatgaatggatgctaggaactagcaactatcttacaggtgaaaatactgcccaaaaaacaggtcctgaatacattacgctttacattttagataatagcaaaactgaaatcgtgatgtcaataaatttttataagccttgggtttctgacctgtctgaagtagaatttagctacacagaagattcagacccggctttagtatgtacagcaacgattccttatacgtattttcaagtagaaaaagatggaaaaattatagcggaagtttaatgcttcagtttcatgtgttataatcttaactaaatttgaggagaaacatatgaaactaatctttttaagcggtgtaaagcgtagtggaaaagatactactgctgattttatcatgagcaattattctgcagttaaataccaacttgctggtcctattaaggatgcattggcttatgcatggggagtatttgcagcaaataccgactatccttgcttaactcgtaaagagtttgaaggaattgactatgatcgtgagactaatttaaatctaactaaattagaagtaatcacgattatggaacaagcattttgctatcttaatggtaaaagcccaattaaaggtgtgtttgtttttgatgacgaaggacaagaatcagttaattccgtagcatttaacaagattattgacgttataaataatattgaagatcaatggtcagtccgtcgtctgatgcaagccctaggtacggatttgattgttaataacttcgaccgcatgtactgggtaaaattatttgctttagattatcttgataaatttaactcaggttatgattattatatcgttcctgatacccgtcaagatcatgaaatggatgcggctagggcgatgggtgctacagtaattcatgtagttcgtcctggtcaaaaatccaatgatacacatattacagaagctggattgccaattcgtgatggcgatttagtaattacaaacgatggttctcttgaagaacttttttctaaaattaaaaatacactaaaggtactataatgtctgaacaaactattgaacaaaaactgtctgctgaaatcgtaactctgaaatctcgtattcttgatacgcaggaccaagcggctcgtctgatggaagaatccaaaattctgcaaggaactttggctgaaattgctcatgcagtaggtatcactggcgatactattaaagttgaagaaatcgttgaagctgtcaagaatcttactgctgaatctgcagatgaagaatgatggaatttaaagacttttcaacgggtctttatgtagcagctaagttttcagaattaacacttgacgcgctggaagaactccagcgctctttacgtgttcctaatccagttcctagagaaaaaattcattcgactatatgttattcaagagtaaatgttccatatgttccatcgagtggaagttttgaagtagcttcttctggacatttagaagtgtggaaaacacaagatggatcgactcttgtacttgtgctagattctgaatatctgcgctgtcgacacatgtatgcgcgggcactaggtgctacacacgattttgatgattacacaccgcatataacattgtcttataatgttgggcccttatcatttagcggtgatgtacaaattccggttgtacttgaccgtgaatacaaagagcctcttaaactcgattgggcagatgatttaaaataatttcacaaagttgtttacatactgatgaggtagtgatactattacctcatcaaaattaattaggaaaataaaaatgaaaactttcaaagagtttgctacaaaaactactatcactgaatcttcccacggtatggaagtaaagcttggaatggctttagctgaagctgagcgtcttttctctcgtattaaagaacttgctgctgcggtcgatccttcatcttttaaaggagaccaaactaaagttaaagcacttttagcattatgctccgatgcaggagaaattgctaaaaatggttctaagatgaagaaacgattagaagatttaaaataatttcacaaagttgtttacatagggttttagttgtgatactattaccctatcaaaacaaaaccaaatggaaatcaaaatgaaaacttaccaagaatttattgctgaaactgctgatgtaaaagttgagtttatttacactggcaagaaagataaaatgggtgaaatgcctcatggagttcttcgtgatgcattagataatttcggtcaactcgccgcagaagattacggtgataaaattgttgttactggtcctgctgcagttattgaaaaatgggcagcagaaaataaatcaatttttcgtaaaaaataagtttacttttagatagggtagtgatactattaccctatctactactgaggagaataaaatgaaacgttgtgaattaattcgaaatgttgctattgcaatttctgcttccgctttcagtttttcaatgtttgttggatttatatgcggattattgactacggcagaaaatgttttttcacttgtagtagcatttttaattggtttaattgctattgttatggataaaatttctaaaggtgaataatgaacgttgaatattatgtatatgcggattacgaaaataatccgtctaaagatgaagataatcgtttaggtgtagatgctttcgattcccctgcggcggcatggcaatgggttgaaagaaccgatattccttaccgttatattgaagtggttgaccacgcaggaaacaagtatcctaaggaagcatatgttgcttccgggaaggtaaatttccttttgtttgcaggtgataattattatccccgtggtgggtataccgatttaattgctaaagcattctctgaagatgaactccgtgacattatcaaagaaaatgaaaacaaaccgatggattctaatcgctttgattggtggcaaatcgtaaatgctaatactcacactattgttgatgaaggctgataatgattctttatgcgaaagtatcatccattgaaaatggatataaatatgatcaagacgcggctaaagctttgattgatgattatggcattttaacatgttttgaagttgaaaaggtttacattgaccgttcatcttctcaagttaaattagtgaaggaagaacgtaaatttaatacagtaaattttgatttctttattgaaacagaaaaaggtcctcttgaatatgatattttcaagaatcctttgggtcttgaatgcatcgtaaatatgtattattataaatggtaaatatgctttaagaattatttgttattattaactcatatcgcactgattaataccctctatcatcaagggttcttgcttaagagcctttgttaataattgggaattagccaagttggtaaggcactggattttgattccaggatgcaaaggttcgagtcctttattcccagcgcgagaatggccaaattggtaaaggcacagcacttaaaatgctgcggaatgatttccttgtgggttcgagtcccacttctcgcaccaaatttgcggatatcgtataatggtattacctcagacttccaatctgatgatgtgagttcgattctcattatccgctccaatttaatttactccgtgtagctcagtttggtagagcgtctgctttgggagcagaatgtcgtaggttcaaatcctgccacggagactggaggcgtggcagagtggtttaatgcaccggtcttgaaaaccggcagtcgctccggcgactcataggttcaaatcctatcgcctccgccagttttgctgatttagctcagtaggtagagcaactcacttgtaatgagaaggtcggcggttcgattccgtcaatcagcaccaaggccctgtagctggaaggttcaagcaagcgactcataatcgccagatggtggttcaattccacccagggccaccaaattaatttggggagttatcccgtagaggtagcggtgtggactgtaaatccattgtcattgcgactcgggtggttcgactccaccactccccaccaatttggatgtgtagctcaatggcagagcgatcgcctgttaagcgattggttataggttcgaatcctatcacgtccgccaaatttgtgacaactgtcacattaatatctacttgacgcgattataggggttgaactgatcactcttctcttaatttcgtgtgaagacatcttgattgttggagtaggtattaatgtggccgtagttcagttggtagaactcgagattgtgattctcgtagtcatgggttcgactcccatcggtcaccccaattacggggcatagctcagaaggaagagcaaggaccttctaagtcctaggtcgtaggttcgatccctactgcctcgaccaattataagtgaggaaaatatgaaaggtaatgtttatttagtagttcatgatttaacattctattttaatcataatgatactgttatttctgaacgtgtaattaatttgctttatcagcatgcagattatgtttatgtcgaaaacgaatatggtcattggcaatttctcaaaaatcgttcatttggtttagatggttacgaatattttgatcgtaaagaccttttagatacaattccgttatctacacaatatcaaaatcataagtctttacataaatgccggctaattcgaaatgctgaatccgcgtatgaagcaattgatttgtggcgtaaacgccgtgaatatattgattctttaaaagaatattaagaaaccgggtcgctaccggtaagtcgtcggactgatgttccctggagtatagtttcctcccacagttttactgtgttctggctctttactatcacagcagaaacggcgcaccgaattatcgattcgaggaaatatctttgccgtaagccgagtagcgtttttgacggaacgttcggatatggtcgagatatggccttttaaaaatattgagtagcgtcaactacttaataaccgggttcgaatcccggcgtttcgtacaaacacttgccttagcaggtggaaccccgacaaggttgccgcaaggcttagccccgaccgaaaggttggggctttttggtataaatattagtatattaaatctacaaattaaaacaggaaataagatgaaatcatatactcaatttttaaatgaagcggtgttaaatgaagcatctagcaccgaaattcaagctgttgcaaaagctgccattgccgcgggtaaatattcctataaagatgcttctgatgaatcgcgattccagtttgcacgcgacatgaaagcggaaggatttacgggaaatgcagttagtatggcctggaaaagtttagttgctactggcgctgcttttgcaaaggcttcgggtaaacctgctcctaaagcagatcctaaagcggcacaagaaaaaaatatcgttaaaggaattatcgctaaatatgaagctatccttaaagagcttttagtaatcaaaaccgaaggccaaaagttagcccgtgcttatagtttcaaagataatccacatgttcactctcttgagtatgttgaagacatccaaaaaattattaaagaccgcatttggtctgctaaacaaatcaaatgacattcttagccccgaccgaaaggttggggctttttagtttgaatcactcggataacgctgttacggatagtaacaaagtaataaataattaataaccaaccgataaattatttcaaggattttaaatgaaaacctatgccgaatttttaaccgaagcagcaaaattaccatctgaagcagatcttactaaagtattcttccaattggacccaaaagaccgcggcgattttcttaagtggaaagctaaagctattgaaatgtacaacatcgataatagttcttttacaatgagtcaagaaaataaattcaataaagcatttttcaaaatttctaagaaattggcatctggcgctcaggttcctaaatctgtgttagctactcctgaacgcgcacctgttaaaatttctaagaatatgttcgacactaaaaaatacgttaatgctttgaataaagctcttgatgcattggatgatgcaaagaaggcagcccgcgatcttcaagacgtgtacaccgattttgaccgcaaaactaaaggttctatttcaaatagcgaacgcaatagtgtaagtgtttattctgatagccttgatgttcttggcgatgcgtatactgaaattaaaaatcgtattaacactgcatctaagctaaaagctgctgcagaagctataataagtaaactaggtaaataattttaaatccctatctaaatgatagggctttttggtatctaggcctttctggacctctctaggcatcatttagtttataccctttataatatattatcctatcctttaattgcccatccctgccctagaattccctaaaaattttttcacaaaactgtttacatctctgttcttccatggtactatacaactatcaactactgatacagaaaacaacttggagaatgaaatggataattacggcgaactgttcaacttctttatgaaatgcgtttcagaagatttcggtcgtacagtgaatgatattaaagttatcggtcctgatcatccgatgtttgaaacttacgcagtaatgggtaatgaagacggtcagtggtatactgtaaaagttgtgattaatatgttcacagcagaaggttatgttaaactgtcttctaaagtttaccatgataacgacgaaatcgcggaagaatatttcaataatatgaaataagtttacgcaggctcatgattgagatattatgagcctataatttgacgatagagtattatactcctacggattttaaatctcaattaacctaaggaaatactatgaacacactgaagaaaattgttgagtttattcgcactaaacttggttctgctatggctaaaaatctatctgtcgaagaacagtatactgctgcagcagcaaaactacttgataaaattaaagatctaaaaactgcttctgttaaatctattaacgaagaaaaacgtattcgtgaacttgttatcgaaaagaatcgacaggccgaatcaaaagagcgtgaaattcgtaaacttctttccgaaggccaagatgtaacaatgcatgctaaactcggtttactatatcgtcgaacagctgagcagttgactactaaggctgacggttatgctgaaatgcgaattgaaatcgccaagaaagtagttgagttagatgatgctcgtcaagaacttgcggttaaattggaatatatccgtgaaactcgtgcagcaaatgcccttggaattagtactgctgatgatgtagttgaaattgcagcactgactaaggttgatattgaagatacccttgctcgagttgaaacctttaacggtaatatttctggggttgaaactacctctgccgatgttcaggaatacattaattctctgaaataatgataaggggcttcggccccttatacttggagtaaataggaatgaaaatgaaaatgcaaagtgatttcaattcaatgtttgaagagttccaaagacaggttgatgttccagaccaattactaaatgctcttaaacgcatggcagaaggacgtaattactattgggggtcttcatatgaaactgatgaaagcctttccggaagattttctagaggtaaaaagtctttaatacgtcctggaatactcattaacagtattgaatcaattcattcattgacgtgtgattttgatgttgaatttactgatttcatttctcctgaatggacggtttgttatttaaacgacgattttgattatctcggtgtttatagtttaagtgacgcatggtttaaacgtaatttacaaaagtcaaatttattttatattgatactactgtaaaatttcagggcaagaaatatttctttactcttatagttgattctgaaacgaagcatgaaaataaacgtattcttagtaaaaagaatatcttaactattgttgatgatctttttgataaatttgtagaaaatcccaattttgaaagtgatttattactagaaaaatttgttaaggaatgtagagaatatgtcaaaaccatcactataccttccaagtaaacctgtgaagtatgaaccaaagcgtcagataatttctactgatgtgttaataggtcctgttatactcatatcatttgtaattctattgattattggaggtgttttagatgttatgactgatattgattctggcgaaatacttgtgttaatgctaattcttccattaatagttccacttttattagtacccgtaaattgggtaggatactggtatcaaggaagacattatcgtaaacgtgtacgtgattggaaagctcagtgtaaaaagattaaaaaggaacaccagcttaagctagatatgtatgaatttgatgaaattatgaaatttgttaaggaatcacgatgcaaaagccaaaactaaataaagtcaaatattcgtttcctgaggcactattaattcttgctgtatcagtatttacagctcttgcgggtagtcttattggattgttaattgactgttttattttaaatatcgacggcacagtaattataacagaggtttggagtgaacttcgttttactatagcgatttcattattttcattctttggtaccatgttatattttcattatgataattttaaaataaattggcaaagaaaaaaggattacaaaatacaattaaaggaatataatagctatatgtcttatattgaaaaagaatcaatggaagagtttgtgagtgattgtaggaaaattaaatgattttaaaaactcgctggtatgatttagatgatggggacgatggcatttcagttgatagagttgactggagcggctgttctgaagatacaaagaaacgattaattagggagtttagaatgggatatcaagcagttaagccatctactgtaacagatgataaattcgtgtgtattcataatggtcgtgctaagttaacgaatgctgaatggttcacagataagattatgattctgtggtatatcattagtcttcctgtgtcatcattcgtattttacttttttataaaaaatccaatggacagaataggagattggattcttttaaccatacttgttaatatttttacagcatcaatattatctgggatatggtacacgttcattgaaatgccatggcggctacgcagacaacaaaagatttttgatgaaaagaaatatactcaaaatttaaataactttatcactgaatgcaggaaattaaaatgaaaacattatcagctggtattatcttcatgacagaagataaagatttatttatgggtcgggttactggttctcgtaagcctggaatgatggcacatcgctgggatattccaaagggacgtgtagaaagttctgatttgaatgcactggaagctgcaaaaagagaatgcttagaagagaccggttttagcaattataatccagaccttctagaagacctaggtgtatttaaatattctagtaataaagacttacagttattttattatacgattccagtagagcatgagatgtttagaaattgccattgcgagtcttattttgaaaataaagatggcgttatgattccagagatggatgcttttgctcttattcctcgtactcagtggcaatatgtgatgggtccttcactttaccgaataatgaacagcctcttttaatttataaataccttctataaatacttaggaggtattatgaatatatttgaaatgttacgtatagatgaaggtcttagactcaaaatctataaagacacagaaggctattacactattggcatcggtcatttgcttactaaaagtccatcactaagtgttgctaaatctgaattagataaagctattgggcgtaattgtaatggtgtaattacaaaagatgaggccgaaaaactctttaatcaggatgttgatgctgctgttcgcggaattctgagaaatgctaaattaaaaccagtttatgattctcttgatgctgttcgccgctgtgcattgattaacatggtcttccaaatgggggaaaccggcgtagcaggatttactaattctttacgcatgctccagcaaaaacgctgggatgaagcagcagttaacttagctaaaagtagatggtataatcaaacacctaatcgcgcaaaacgagtcattgcaacgtttagaactggcacttgggacgcgtataaaaatctataaagttgtttactttctcctagaattgtgatagtatattcacagttacttggagggataaaatgactcgtattaatttgactttagtatctgaacttgctgatcaacatttaatcgcagaataccgtgaattgccgcgtgtttttggtatagttcgtaagcatgtggcaaacggtaagcgcgttaaagattttaaaatatcttctaaatttattttaggttctggtcatgttactttcttttacgataagttagaatttttgcgaaagcgtcaatcggacattataacggaatgcttaaaacgcgggttcagtataaaagatactgaagttcctgacatcagcgatattccagtagaatggaaaaatgattataatccatgcaaatcagctattaagttgagtcaacaacgactcgatgaaaaaattttaatgaagccacactggtataagtattacggcaaaaatatttacatttaaataacatgggaataacctggacctcatgattctgtgagggattcccgccaacctgtaataaggtcgagcccaagtgcggtaatgggtaaatacagaaatggacaattcatgcgccatggaatggcccaaacctagagagaacaaaatgagaacatttttaactggtccttatctatccctgatgaatgcttttacacaccattctgatgctagagtagaagaaatttgtaaaaacgaatatatcccgccatttgaagacttacttaaacagtattgtacacttcgactagatggtgggcgtcaatctggtaaatcaactgcagtaactaattttgccgctaattggttgtatgacggtggaacagttattgttctttctaatacttcagcttacgctaaaatttccgcagataatattaaaaaggaattttcgcgttattctaatgatgatatacgttttcgtttatttactgattctgtgcgcagttttattggtaataaaggaagcaagttcagaggtttatcgctttcgcgaattttgtatataattgatgagcctgtcaaatctcctgatatggataagatttatagtgtccatattgacactgtacactgctgctgtaatattaaatgttgcattggtggtattactcgtccacagtttttcgtaatcggaatgcaatgatgacagacactcagcttttcgaatatctttatttttcgccaaaaactattaaaaataaattggtgaatcattttgaaattttggcaaaaaataacattttgagcgaattttatcccaagcaatacaaattacaaaaaggcgtattcaaaggatgcagagttttgtgcacggctcctaatgcacggctaatgaataaaattccatattttaccatggaatttattgatgggccttttaaaggactaatcacacagagtttaatggcatatgattctgagccatttttaattaaagaacaatcttggataaatttattttttaattgaggttatatgaaagcatatcaaattcttgaaggcacacataaaggtactatttattttgaagatggtattcaagcacgaattattgtctctaaaacctttaaagaggactcttttgtagacccagaaattttctatggtttgcatgcccgtgaaattgaaattgagcaacagcctacagttaaaattgaaggtggtcaacacctgaacgttaacgttctgcgtcgtgaaactctggaagatgcagttaagcatccggaaaaatatccgcagctgaccatccgtgtatccggttatgcagttcgctttaactctctgactccggaacagcagcgcgacgttatcgctcgtaccttcaccgagagtttgtaatggcaaagataattattgaaggttctgaagatgtgctaaatgctttcgccgagtggtttagtaattcaggcgaacagcaatttaacgaagcatggaacatgggtgatattaatggaatttatcctacgacagaaatttctgttcaaggatatggcattcatgaacctattcgtttagttgaatatgatttgggaacaggtgaggaagtaaaatatgattgaagacattaaaggttataaaccacatactgacgataaaatcagtaaagtgaatgctatcaaagatgctgaagttcgtttagggcttatctttgatgctttatatgatgaattctgggaagcatttgatagctgtgaagatgatgaactcgcgaagaattacgccgaaagcctcgatcagttaactattgctaaaatgaaactcaaagaagccagtatgtgggcttgtcgcgcagtgttccaaccagaggaaaaatactaatggctcaattaagcgcagggtttggttatgagtattatactgcccctcgtcgtgtatctgttgctcctaagaaaattcaaagtcttgatgacttccaggaagtagttcgtaacgctttccaggactatgcacgttatcttaaagaagattcacaggactgtctcgaagaagatgaaattgcttactatgagcagcgtcttgaacagctcaaaaatctacatgaggttcgtgcagaagtttcaaagtctatgaataaattgattagatttaaagaataactgtttacttttcctcttgactgtggtataatttttctatcagttaagaggagaataacatgactatcaatacagaagtttttatccgtcgaaataagcttcgtcgtcactttgagtcggagtttcgtcaaattaacaatgagattcgtgaggcatcaaaagcagcaggagtctcatcgtttcatctaaaatattctcaacatcttcttgatcgtgcaattcaacgggagattgatgagacatatgtttttgaattattccataaaataaaagaccatgttttagaagttaatgaattcctgagtatgcctccgcgtcctgacattgacgaggattttattgatggggttgaatatcgtcctggacgtttagaaatcacagatggaaatctttggcttggatttacagtttgtaaacctaacgcgaagttcaaagacccgtcacttcaatgtaggatggcaattatcaacagtcgtcgtttaccaggaaaggcttctaaagcagtaattaaaactcaatgaggtaagcatgagaaaagcactactcgctggtctattggccatttcaatgatggcacatagctccgagcatactttcagtaatgtccaactcgataacatgcgttacgcgtatcaattcggggaacaattttctaaggatggaaaatataaaacacacaaaaacatccataagagcggattgggtcatataatggctgctattttgtggcaagaaagctctgccggagttaatttaaaatctaaaccaaagcatcatgcctatggaatgttccaaaattatttgcctactatgcgagcgagagtcaaggaacttggttataatatgaccgatgctgaaataaaaagaatgttgaataaacggtccaattcagcttcctgggcgtacattgaactttcttattggttaaatatacataagggtgatataagaaaagcaatatcatcttataattcgggatggaatgttaaagcaggttctaaatatgcttctgaagtcctagaaaaggctaattaccttaaaaataataaacttttggaaatagtaaatgactaaaattttggttttatgtataggattaatttcattttctgtgttagcagatacatcatatactgaaattagagagtatgtaaaccgtactgcagcggattattgcgggaaaaataaagcatgccaagctgaatttgcgcagaaattaatatatgcatataaagacggagaaagagataaatcaagcagatacaaaaatgatacattgttaaaacgatatgctaaaaagtggaataccttagaatgttcagttgcggaggagaaagataaagccgcttgtcattcaatggttgaccgtttagtagattcttataatcgaggattgagtactagatgattgtaaaatatatcaagggcgatattgtcgccctatttcttcaaggtaatattattgcgcacgggtgcaattgcttccacacaatgggctctggcgtagcgggtcaattagcaagagcctatcccaaaattttagaaatagataaaaccactaccgagtacggttctcgtgataaattaggcgatatgtctattgtttttaaacatagtcctacgggatttggtatatgctataacctgtatacacaatacgaaccgggtcctaatcttgattatggtgctttagtaaactgcatgatagaattaaatctacaggcagaaacccttttgtttaaaccagtaatttacattccacgcataggttgcggtattgctggcggcgattgggataaggtttctaaattaatcgacatgtttactcctgatattgatttaatagtggtggattatgaaagtacattacccgcatccgtttgatcctaaaaacaaagtggaaattattcgtcaatgggaacgcatttgccgtactaaatgcccaattaatagtccacatgatgtagataaagactatattggaacattcgttgaatatacctttattgataggaaaggtcgtaaacaacatgtagaagaatattgtttaaaggttacatggttatgagccaaactagtattcttaaaaatgcccactgcgaaaagtgtgaatggccagttgtttttgctttatgtaatgatgaaatggcttgtgatttcgattattggtgctattgttctaataaaggatgcatcaatcataaaggtgaaggattttattcaggattttatccttatcctgatttcgttaaagaaggtaaaccgaaatgaatagttttgagttacagtatgaagtgttacgtgagcttgataatttaattgaactcgctgtcaataaaggttttgccattggaatcggtcaaaaagatactggtcatttaactatggaaatatttaagcaaaagcgaattattttaaaactcctggaaattaatatatgagtctgagtaaagaacaaaaagataaattgtttgagcttatccatgaacttctagatgagcatacagaagcaaacaccttttatgatgaatacggcccgctatctcccgaacagcaagaagaatttgctgatcggtttgataagaaagaaaacgaattaatagcttatgtgaatatgctttaagaaggtgatatggcgagtttaatttttacttacgcagcaatgaatgctggaaaatctgcttctcttttgactgctgcacataattataaagaacgcggaatgggtgtattagttcttaagcctgctattgatactcgcgattctgtctgtgaagtcgtttctcgcattggaattaagcaggaagcgaatattattacggatgatatggatatttttgagttctataaatgggctgaagcacaaaaagatattcattgtgtatttgtagatgaagctcagtttttaaaaactgaacaggtgcatcaattaagtcgaattgttgatacatataatgttcctgttatggcttatgggctaaggactgatttcgctggaaaattatttgaaggttctaaagaacttttggcgattgcagataaacttattgaactaaaggcagtttgtcattgtggtaaaaaagctattatgacagctcgattaatggaagatggaacaccagttaaagaaggtaatcaaatctgtattggtgatgaaatttatgtttctttgtgtagaaaacattggaacgaattaactaaaaagctcggttagtgcaaaagttataaataggtttatctaactaaaggggtatatatgctacaattaactgaaaagcaacttcgcaatcttactgttcttcaattagatgaaattcgtagggaagttggaaatatcatttcagctttgcgtcgagaagtatcactcaaccaatctccggcagactatactagattgcgaaattttgaaaaataccttgataaagttaaggccgtgcatcggcataaagtaaatacaggacaaaaatgataggaggcctttatggccttaaaagcaacggcactatttgccatgctaggattagcgtttgctttatctccaccaattgaagcgaatgtcgatcctcattttgataaatttatggaatctggtattagacacgtttatatgctttttgaaaataaaagcgtagaatcatctgaacagttctatagttttatgcgaacgacttataaaaatgacccgtgctcttccgattttgaatgtatagagcgaggcgcggagatggcacaatcatacgctagaattatgaacattaaattggagactgaatgaaattcagcgacttttcacaaagtggaaaaccttcaaaggcagatgaatacttaggtttattaatggctgcacaagcttattttcattctgcgcattttgaaactaaaagttatgctagacacaaagcatacgattttattttctctgagttgccagatttgattgataaatttggtgagcaatatttggggtattctggtagaaaatacacgccttctattccagatgccagtaaacttcctaccgacacaattaaaatgattgatcgcatactagaccaatctaacagcatttataaagaaatgcctccagccattcaaagcacgatagatgatattactgggatgttttaccagagtaaatatcttctttccctcgaataacattagtctccttcgggagacttttttcattttaccggtttactttccatttgagctgtgatactatacaactatcggataaagaggagaacatcatgaaaattgaagcacttaatcaagaaggaaatatctacgtcatcattaatggtgattttttcgtcgacatggatgaagttactagtgaagaacttgtagaacttcttaagaaacgttatgatatgtgtgatgaagctgcaactcatatggcgtgtgcaatattctctctttcatatgtggtggaataatgactagaattgaacaagcagataaaattaaagaattggtagctttaattcgcaaagcagatgaggaacttagtgactttgcttggttttcggcaggcattgcaaataaaggtattgaaaaatttgaagctaaagttgataatgctttagaagcgttagatatgtttcttgatgaaattatcgatcataatacgagagtgtaagtatgctaacacgcgaacagtttgaaaaaatcattaaattagcacgtgatattgaaatagattcatatcaattagcagttgagcattgtgaaggatattcatacgatggtatagaagcagctaaaaaggatttggataaatctaaagctaagttagttcaatatcttgaaatgattaggtggaataatgaaaactgaaaagcagatgtttttaatgaagctaattgaagaatatgctaatgcagtttctgactatgaatgttcttctcgtgaaagaggtacagctttcgctaaagaagaattgaaaatcatggttgatgctcatacaaagcttcagaattttattgaaaacgtcatttaatggtttacaagttggcaaggttatggtatagtaatcttgtcaactgccaaggagaagagaatgaaagttttgtttgttgtgtatgtgatgattcaatataattacccaatgtttacttataatctggtgaacaacattattgatattattcaaaggagtatgtaatgacaagtgagcaggcttttaaattaaaagaattaattgaaacatatagcaaagctgttcatacagcaacagttattgatgaatcagctttctccggacatgctaacaagattaaatacaaaactcttatggaagaagctaaagtaaatcttgattcttatattgaaactttaattggtgaataacatgggctttcctaaattagaagtaggtgatttagttttaacaaaattatggaatggtgttcaatcagtagaaatctgccaatatcgtggagcaacaggtaatttgatgtacacgatttataatccagaaattttgttagagtgtcatttggaacgctttataaaagacaccgatagtatgccttatagtgtatcaattgtacgtaaatctgatacaaaggaatattctaaaattttagaacaaattcgtgccaataaaaaggattaatatgaaacgattagtattagaagttagtccgctttttggtgaattggctatagaaaaagtaaataacatgtatcgtttgacgcaagaagacgatatgctatattttacgcctagtgaaatcattcatttaacccaaattgaatatccttatactgataaaatagtaagcatcaatgatgagcacaaaattcatttttattcttcatgcccaggatttaatattaaaagtgagtcaatgtgtttatcagttatccattgggatagttttatagataagattaaatatttttattattctaatgaaagaaaacatagtttaaaatggctcaaaaattgcaatgctattattactaacgcttgcaatcagaatgatgaaactcttttaaatgtatcaaaatgttatgaagagggagatgtcttaactattcgccaaattgacgattttcgatcacatattgtcacatttaccaaagacgaagctattgcgttaaagacttatcttgattctgtcattccaactatgatttcaaagtgaggaaatatgtttatttcaagtggaagcggtttaattcgtgttgaatttaaaaatgacatctttcttagtcaaggagatgatattattaaaatgagttatgacgaaatcaagaaaatttgtcatgctcttgaaagtcatggaaaggaaaatgctactatcgatataggtgatttatgggtgacactttatgaagtatccgaaggatttaacattgaagatgaaaacaacattttagctattgataaaagaagtgatttgtttgatgtattaaaagtttatgaacagtcaaatggtggaagaaaagctgtattagtttatcaaaaaccacattcatgtggaactgcttcaatcatttcaaatattgaagatgaaactgatacttatatgtgtgttttaaaagctggtggtgaccgtcatccggattttatttctattcgtcaaaataatggagaaatttcattatcaaaatcagaagctgaagctatgattaagtatttaacaactgttacaccttcaatgaaaggataattatgattattaatgaaaactcttggcattataaattattcaaaatgtttaacgacgaatggaaacgacctaagacactttgtgcatatttttggtctattgttatccctacatttttcgtttcttttttcggatgtactatactcgcaggtctaactattatctgtgcagaaatcatacagaaatggcttatttttggtagtttatggactcttattccatcagcatttatacttgccattttgcttgttttacttattatcggttcatttgttattcctgcacaactacatgaaaaatataaagattataaatggaaaaaggattatgctttacatgtagaaaatattgatagggcgtataaaggtttacctcctattcaacccaagaaatctattatcgtcgaatttttaaaagcgcgtaaagctaaagtatgtcctgttattgaatataaggctgaatgatgaaaacagtaatgaaaagctattttggtagtcatctttatggaacttctactccagaatctgatgtagattttaaagaaatctttgttcctcctgctcgcgatattcttatcggaaatgttaaagagcatatgagtaaaaacactaacaacacatcatctaaaaacactaaagatgatattgaccatgaactatacagtcttaaatatttctttaaattagcagcagatggtgaaactgtagcgttagatatgcttcacactccacctgagttagtggttaaatctgatttgcctgatgtgtggaagtttattcaagacaaccgttctcgtttttatacgactaacatgaaatcctatttaggatatgtccgtaagcaagcttctaaatacggcgttaagggttctcgtttggctgcattacgtgatgtattgaaagtagttaatcaaatccctgagcagtgggttgattaccaagaagatggttctattaagcagcgtcgtactaaagttgaagatattaagcatcgtcttccagaaaacgaattctgtgaatgggtgttccataatcatgagaaaacaggcccacagacgttctacacagtgttgggtcgtaaatatcagacaacgctttctcttattgagcttaagcagtcactgaacaaattagatgctgaatatggtgaacgcgctcgtaaggccgaagccaatgaaggtattgactggaaagctctgagtcatgcttgccgtggtggactccaactattggaaatttacaaaactggtgacttggtttatccactccaagatgctccatttattctcgacgtgaagttgggtaaacatccatttaaaacggttcaagagtttttggaagatgtggtcgatcaagtagaagcagcatctactgaagcttctaagaacggtatgcagcaaaaagtagacatgagtttctgggatgacttccttgagaaggtctatcttgaaaaccatcgaagttattataaatgatagggagccttcgggctcccttttttattttaaaaattttttcacaaaactgtttacaagcataaagctttatggtactatacaactatcaaaacaaacacttaaacggaaaacaaaatgaaaattacaccaattgaagtaaaaaagttgattgatacagaagaaatttcagagtgttttgaaagtttcttagaagacgcaactgaagataacgcggtttatctcgcccagaaaattatcgaaacttatttggagaagaatcaatgacagtttacgtagatgttttaatgaatcatggatggaaacttcgcggtcatccaactaaaaattgtcatatgttcactgatggagatattgaagagcttcatgaaatggcagaagcaataggaatgaaacgttcttggtttcaagataaacgcattaaacattatgacttacacgctcgccgacgccaaaaagctgtagaacttggagctgtagaagtatctcgccgtgaagcagtaaaaatttggcgaacgttaaaataaattgtttacagaagggtagtagtgtgatactattaccctatcaaaacaaatgtgagattggagaataaaatgaaaactgtaactatcaataagggtatctacttcggtaaagaaatctctggaacttttgagctcttaggtgaatggttcccagataatgctccggtagatgcacaaggagatggtaaagtttttgttgaaattgacggtaagcgtcgcggtgtttgggtttacaaatcagacatttcatatgatggtgtaaaagttgaagaagttaaagaatcatatgaagatatgaaaacccgcattaataaaagatttaatgttatgggaatgatgacgaatggtattattaacggaaacattcgttcattaattatctctggtgcggcgggtattggtaaaacgtattctttagataaagctttgaataaagcaaatgataatggatacattgaatataaaagcattaacggtaaaatctccggtatcggtctttatgaacaactttggaataatcgtgaagagaattctgtccttttgattgatgatgtggatgttttctctgatatggacattcttaatcttctgaaagctgctctggacactggagagacccgtaaagtctgctggagcaccgcatcttcttacttagaagaaaaaggcattgagcgtgagtttgaatttaaaggaacgattgtttttatcacaaacgttgacattgaccgcgaattagaccgtggtactaaacttgctccacatttacaagcattagtgtcccgctcggtttatttggatttgggtgttcacactaatgaagaaattatggtcagggttgaagatgttattctttcaactgacatgatgcaaaagcgcggtctttctgatgaagaaacttataaagcattatcatggatgaaagttaatgttaatcgtttacgcaatgtttcactgcgtactgctctttatcttgctgactttattatgaccgacaaaaacggttgggaagaaattgctgaggttactcttctgaaataattcataagaggacttctatgacaaaaaggcagttcagaaatagattatatggactgccattaaaaagatgactagaattaaactggtgaatggaggtaatgatgttatactcaaaggctcgtgaaatttacgaaactaaaattaaagaagcagtatttaagttcgcaacgacaatgcgatggacaaatgactgggagtattcaaaaaatcataagaagcccatggtgacaagaaaggctcatatgttagtgttaatagaccgtgagcagattaaagcccgagaagccctccagaatcataaaaaggctgcctttgaatggtttatggataacactgctcctgagactaagaaagcggtaagcgcatggttcagtggaaaaaattgtgaaagaagtttcttttagtggtttacaagactgttcctctgtggtactatacaactatcaactacggaggaacacaaaatgaacgctaaagatattttcaacctggtaaattacaacgatggtaaatttaaatctgaagcacaaagtaagttctttaatgacatctcaatcggaggtgaaatcacggttgacggaggacaaatttacaaatctcgttggaattggatcgttattatcgatgagattggtattgtagaaatttacaagaatacgaataaaaatcgtacattacactggtctcgtgatactaacgaacagtacaaaaaggataaagcatctaaattatctcgtgtaactcaagaagatattgagttcatcaagaaagatattttgatgtatgataacttaattgctgaagagcaagctgttattgataaatttgatgagattaaagcttctcgtgaaattcctgattttatgaaagaatcagtaaatgaacgatacactctcatttcagagcgtattgaaacttacaaaaagcaaagagctgaacgccagaatactcttcggaagtttgaagaacggttaaagacggtactcgcataaccgctttataccaaggatggtataatggttctaagcccttttaattgagattattatgaaacagttgataattaaaagattgaatttattgatatgttgtttatgtatagcaattgcatatggttattacgcaattaatgattatatgcattataaagattatgatgttactgtagttaataccattacaggaacacaaggaaaagggtctagtttatcgtttattgccgtatatgaactcaaagatggttatagatttagtgaatatatttccccagagatgtattcatcaatagaaaaaggtgataatattactgtaagtttacgtcctttcgacgtaaaacagacattgtttgataatattgtttggttctttggaatggtattagttcaatctgtgtgtggtgcttatatagtctgttccatcttattctgtatatttagtaaaattgaaattgagtgaggaaaatatgtcagtagtaattaataatgtcaatgcagtaattaaatctttagttaataaaaaattaaatgaatggactgtacttcgtcgtggagagccagataaattttttcatagatttaacccaactttggatttgaatgttattgacagagatgttcatgctgaaattttagataaatttaaagttgatattgggtttgggttagataaacatttgcaacgaacaaacggatctggaatgggtttatctaatcgcatcatgaaagcccttaataaaattggagcgttgtctcgtattaatgcgagtgaaatccttcgcaattataataaaggatatgacctttatggtcgactaatgccgaaattatcatttgaccaaatgattgcggatttgtgggaaaatcaacgacgattattagcattaggcgctcgattagctaaaggtctagataaacaaatgatttttaagaccaataatacagaagaccttaaatgctttaaatttagtactcgtggagatgattattacatcagagctcgctctacagattatgttaatatggggcatcatctctgtttagcttttgaagttttaaaagaagccggaacattagaatatgtgtctggtgctaaatgtccgattggttcaaattgcattttaatttatcgcccagatgaatccagttcaactaaattacctacaaaacctgtaccagttcgcagtaatgaaaaacattctgaacaaattgcttattttaataagcagattgaagagctaaatatttctattcagcaatatgatgatgaaattttcagactatctggattgagtagtaaagctaaatctgagcgtgaaaaattaattaaaatcgttgatttacttaaatcttaaggaacaccatgaaaactcgttctcaaattgaagatatggttcgtaatgccagctatactcgtgatgttatgacatttttgtgtgaaaataatttagaccctgataaagttaatcgtgttattcatcactttaagtatacgaatagcagtgaatgggtgcgtaattttagtaaagcagggtatattacacaaatgactgctcgtgaacagctcaccgatttctgtaaaactattgattataaaaatcctttgattgttcaaggcgttggtcaaagtaaggtcgatttatcatctggatttttcaatccaaatcattatcgtattgaatggagatttattgctctattccgtaaacaattaaagcaaattttgtctactgctagtcgattaaaaggctctgatattaacttaaagaacctgaaatttgatggttatactcttcagatggaagtaagaccgttaaaagaaaataatagaactgcacgaattagctttaagcctaatactaaaaattctctttcaatttgtgaatgtcttaaatcacagctgacagaagcatttaagtatatggatgttgttgctgctgttcaatctaagattttacctcgttttgagcgaaattgggaacatacaacaacatatgaacttgatatgatcgtttcatttaaatatgaatttttgagaaaggatgaaattgttcaagagaaaaagcaggaagtgcaagataccttaaatttaaatttatccaattacttatcaaacgatcctaaattttggatgtatagctcaagcaatatagatgcatgtaaacttaataaagtgagttttcttcctactgaaaattcaaattttaaacctgtagaaaaatggcacgctgacgcgattgagaagtctcttaaggcagtagatgatgaactcgttaaagcgaccaatgaagtgctagaagctgaaaaggcgttagaacaagctcagtcaagggttcaaaatctgacaaagcaacgttctaaactgaacaatgcactaaatgcactgaactagtttactttgccacaaggatgtggtataatgtttttactttctactgaggagattattatgactcgtaacgaatatatcaaatcattcaatagcgttattgatgataaagctataccgatgtttggccaaaatagcgttctttctattatcaatcaatggctcaatagtgttgatgcaagtattgtttcttctactaaatttattcatgaaattcgtaaaatttctagccgtgtagataaagatgttatcaagaaaacctttaaagagtctcgtcttctttcatatttggttaatcgggatattcttggtaattttgggaaagaaattaaacgaactaaagatgtagtaggatacaattggttcggtgatgttaattcttatcatcttaatattaaagaagaccctgagaatatttttactcgtcgttggatcagtaatttcagactttttaagaaacaaattctaaaatcagcttctaaattatgttatggcgattatcgtcaaattcatcctttggcttctgatatgattatcataaaagaatatgaacttgataaaaataaagtatctatttttgtgaattatggattttttacaccagaaactaaccaaaagaatattaataaatttttctcaattgctagcactataactcgtcaattagagaccgcattactttgtatggaaacagtagaaaatattcatacatatccttttaagaatatatgcggttgggaaggatataaactcgtaattagccttcgtgaagtgaaatgtgcttattcacctactgataaagaaatttaccaacaaaaatgtgatgaaattgtgaatactcctaaagaagaaactacccttgaggaactaatggaatgtcttgatgattcacctgaaccgatagaaattcgtccagaagttattgcactagaaaaagcttataaagaagttctagaaatttctaataaagcgcagaaagaatatgagcaggctaaaaggatttgggaagaatctgttaatcgtcttgatcgtctggaacaagctttacagttaattaagtaatttaaagccaaggatggctcggagtataaatcattaaccaagtgagaagaacatgaaaactcgtaaacattatattgattattttgacagtcttattactaaacatcgtaattatcagataggacacagagcagtaatcaataatattcttcgtgattttttagactatattggatgggaaaaccatatttgtaaagatacacaaaatgcgtattcacattctcttggttctttgctcgagtggttcaaacgttcccgattactatcttctgtgatagctgttaataatgttaaaaaatttatgtatccaagctacattgagactaatgtatcaaatgctagtgttgttacatttaatattattaacgacgtgaaaagaacttatttagaagaatggttttctaaagatagtaaagaaaaatttgctagtgaattttcacacgaattcaataataacgtgaatatgctttttaagcattctcgtagactgttttgtcatggtgataaccgtactattaatgtgaatgtaaaagactgggttacggctaaattcactccatcgtcccagaatgggcaatttgaattgtcaattatcatttgtgctccgcacgagatatataaaaaccttccgtatatgaaaccacgcgaagctaataaacacaatgaaactattagttctttggcttataatttacgcgtgttattatctgatatggatgtagtcaaatcctttgatgataatacgaattatggtctttcgctgtttgaaactaaatttgttattaaattaaaggaccctagtgaatttaaacctacaccaaaatccaatcatggaaatgatactatgaaagaagaacgcgaatatctcagtgcccgtttgattgaagttgaaaaacagattgaagagcatactaaagttcttaaggctttaaccgccaaagcaaatggtttacgtaatgctattgaggtattgaaatgaaaaagcgtttattagaagacattgcagcttcaagtaattccagtttaattaaaattattatggctggtgaggaagatgatatggaaatgcgtggaaagattcacggctgcgacgatttagattttaaacctccagcatgggatgctattatggctatggttgaacgacgtgaaagagcttctaaaaacgttcctaattgccctgaatgcggtactgaacaagttcaattgattaactggcgtaaaccagagcttgaatataaatgccgtcaatgtaaacataaattcagtaagcatgctccggaaatggttaaattgcctgactctactgagttctttaaagaacttgtgagtgttcaaccaatgcctaataatattttggattaaaaatgaccaagcgtaaagaatatatggaggctgctgaaaaggcagtccgtgaattagcaatagcttattataatgaacatggtaaatttcctgatagatacagcgtgcttaaatctgctttaactcgttcatataaaaatatgctatcagaagtaagtgatattatatacaaacataaagaacaaacgggccaaagtcttgattacgacgagacttttaaacaagtactaggaattaaggaataatatgtttaaagtatatggttatgatagcaacattcataaatgtgtgtattgcgataatgcaaaacgtcttttgaccgtgaagaaacagccgtttgaatttatcaacattatgccggaaaaaggtgtttttgatgatgagaaaattgctgagcttctgactaaactaggtcgtgatactcaaatcggcttgacaatgccccaggtatttgctcctgatggaagtcatattggtggatttgaccaactgcgagaatattttaaatgatgctcgaaggaactgactatattcatgattaccgcggaagcgcggtatatgtaggtgatgaagttgcagtttattatgggtatggaactttgatgacagccaaggttattcaaattaaaaataatcgtgctaaactcgaagtttattattctaatggtgaaaagtctatttctaagtggaaatacggcgattgtatggttaaattggggtaaatatgatttacgatattaatgtatcaagaactccgtcaatggttactattccagccgaagaactagatcgtcttcagaaaattgaagagcttctttgggaaattgaatctgatttgccatcaggattagaatcctggattgattatgaagaacttaataagcttcggggttaaaccttggtgggcggctagatgggaaactgtagagccagagccggaagaaccggtttacattgatgaagaaacagtatataatgaaccaacgataaatgacttaattgatatggagatgggacatgattacagtagataagtggtttagaattaatcgtgttgatacagggctatgtaattactggccggaacttagtgcaggtactgtctttaaagttcgtgaacttgcaaaagaatgcgaagatgatatagaacctgatactggaattattgaaattgaactttccgacggaaagattattaacatctatgataagccaattacatactggtgtttgtggaatactgaatccgttgaaaatggcgaaattgaagaagttgtagagagaactagccaagatgttcagaagcctaaagccgcttttcaaggtgaacgtatttcatacgcattagctaaattagctgcgcaagaaaataacgatggctatgaaggtaacctgatgcaagctgccgcagagtacattgaatggcttgaaactcaaatttctttttctgaccaaaagattcggcaatataagcgattgcatcaaatgttttacaatacttgaaaaaactcaaaattctttttctgacaggacattttaatgaaaaccgaattggtttatactgaaaagttaaatggcggtaaggtttggaaactttttattaaaggacattctacggaccctcatatgaccacttgcgtaggaacctattctcgtcctactaaaaagatgattcgacagtataaacgattgcatcgaatgttttacaatacttaaaaataataaatacccttatctatttaaggtaagggtatttattatgttattgactggcaaattatacaaagaagaaaaacaaaaattttatgatgcacaaaatggtaaatgcttaatttgccaacgagaactaaatcctgacgttcaagctaatcatcttgatcatgaccatgaattaaatggaccaaaagcaggaaaggtacgtggattgctttgtaatctctgcaatgctgcagaaggtcaaatgaagcacaaatttaatcgttctggcttaaagggacaaggtgttgattatcttgaatggttagaaaatttacttacttatttaaaatccgattacacccaaaataatattcatcctaactttgttggagataaatcaaaggaattttctcgtttaggaaaagaggaaatgatggccgagatgcttcaaagaggatttgaatataatgaatctgacaccaaaacacaattaatagcttcatttaagaagcagcttagaaagagtttaaaatgacaattgaaaaagaaattgaaggattgattcataaaactaataaagaccttttaaacgagaatgctaataaagattctcgtgtttttccaactcaacgggaccttatggctggtattgtgtctaaacacattgccaaaaatatggtcccgtcttttattatgaaagcgcatgaaagcggaattattcatttccatgatattgattattcccctgctcttccatttactaattgttgtttagtagatttaaaaggaatgcttgaaaacggatttaagcttggtaatgcacagattgaaactcctaaatcaattggcgttgctactgcaattatggcgcaaattactgcacaggttgcttctcaccaatacggcggaacgacttttgctaatgtagataaagtactttctccttatgttaaacgcacctatgcaaaacatattgaggatgcagaaaaatggcaaatcgctgatgcgttaaattatgctcaatctaaaacagaaaaagatgtatacgatgcattccaagcttatgaatatgaagtaaatactctctttagttcaaacggacagactccttttgtaacaattacatttggtacgggaactgactggactgaacgaatgattcagaaagcaattctgaaaaatcgtattaaaggtctcggtcgtgatgggataactcctattttccctaagcttgttatgttcgttgaagaaggcgttaatctttataaagacgatccgaactatgatattaagcagcttgctttagagtgtgcaagcaaaaggatgtatcctgatattatttcagctaagaacaataaagctatcaccggctcatctattcctgtttctccaatgggttgccgcagtttcttgagcgcgtggaaagattcaaccggtaatgaaattcttgatggacgtaataatcttggtgttgtaacactgaatcttcctcgtattgcgttggattcttatattggaacacagttcaatgaacagaaatttactgaattgttcaatgagcgaatggatttatgttttgaagctttgatgtgtagaattagttccttaaaaggagttaaagcgactgttgctcctattctttaccaagaaggtgcattcggggttcgtcttaaacctgatgacgacataattgagttatttaaaaacggtagaagttcagtgtctttaggatacattggtattcatgaattgaatattcttgtcggtcgtgatattggacaagaaattttaactaaaatgaatgctcgtcttaaacagtgggctgaaagaactgggtttgcttttagtttgtattcgactcctgctgaaaacctttgttatcgcttctgtaaacttgatacagaaaaatatggaagtgtaaaagatgttaccgataaaggatggtacactaacagtttccatgtttcagtagaagaaaatattactccgtttgaaaagatttctcgcgaagccccatatcatttcattgcgacaggtggtcacatttcttatgttgaacttcctgatatgaaaaataacctaaaaggtcttgaggctgtctgggattatgctgcacaacatttagattattttggtgttaatatgccagtagataagtgttttacatgcggaagtacccatgaaatgactcctactgaaaacggatttgtttgttctatttgtggagaaactgatcctaaaaagatgaacacaataagaagaacatgtggttatttgggaaatccgaacgaacgcggatttaatctcggcaaaaataaagaaatcatgcatagggttaagcaccaatgaattatgatagattttatccttgcgattttgttaatggtcctggctgcaggaccgttcttttcgttacaggttgtttgcataaatgtgaagggtgttataataaatcaacatggaatgctagaaatggtattccattcactggtgaaacactagaacaattaattgaatgtttgaataatgattatatagaaggattaactataaccggaggtgaccctctttatcctgataacagagacgtgattcattgcatcgttcaaacagtaaaaaatctttatcccaataaaagcatttggttgtggacaggatataagtttgaagatattaaacaactagaaatgcttaaatatgttgatgttattattgatgggaagtatgagaaaaatcttccgactaaaaagctgtggcgaggatcagataatcagcgactttggtcaaataccgatggggtgtggaaacatgattaaattgaattatattatggatactataaatgatatgatttttcattttggtccagaattttattcccaatatagtttagtgcttatcaatgcttggttaattaattaagggtaaaatatgtataaatttcgtaaaggtttagctgattttcttacaactgtaacattctttctgtttatggcagttggagctattttccttattccttttattgctatatttttcgtgattagtttaatttctccagaaaagggcttatcttctagtgagtttaatgagcgtctggataaaattactaacaagctgaatgctgttcttgataaaaaggcttaattatgattagttttgagcggtatgtagtagagagttggaatggttttgatatgttcggtaatgactattatttctatgaatgtagtctgaacccaagcttctgggctggacgtgaacaagacctcgaagaaatcaacgctcgtgccgatttgttaggtgaactgcctactacttatttcacctttgatgaatccggcttcgttatccaggtttattttcctgaagaaaactctggtgaggattctgttaatcctccttattgggcttaccaaggaattatttctcgtggaacaaaactcgaacttaaagaataagattgaagtctatggaattccagatgaagtaggtcgttgtcctggatgtcaatcagttacaaaacttctaaaggagctcaatgctccttttactttctataaagttcttacaaataatggtaagattgagtatgatcgtccactgattgtatctcttgctaaacgcgctggattcacatctcttaacattcgttatccagtcattttcattaatgattctagacaaaagaacattaaacacttcaaagaaactctcatttcacttggatatgatagagatatcatagaagactaagacgggccctctgggcctttctttctcacattctgtatattaccattctaagctatcgttcccttcttatcattccctaaaataatttcacaaagttgtttacaacaagttcaaactgtggtattattaacatatgaattgcctttgaggatttgatatggttgtggttgataaagagattaaaaagggacaatattattttattaatggtaatgttgttcgtgttacttatgtaaacggttttgaagtttattatcttatactcaagttacataaacagatgatttgtgatcgtgctgtatttagttcagttgctaaggaaattaaactccatgggtaaaacgtatcgtcgtaaagatttaaaagtacgtgattatgactatttcggaaagcgtaaagctcctgatggtgtaagtcataaagatatggttgaaaacatttttcgctctgataaatggcgtagaatgaaaggcattgattcagaagttaaagatgagctaaatcgtcaattacgtagtgaagtaagaaagttgaaaaaatcagtttacattgacgatgattttgattacaatacttctcaacgagttgctaagcgcaaatcaaacgagtgttatcgttatagctgaggaaaatatgaatatcaaacgcatgctttttaagcaagggctatatactttaaatgctactccaaaaggcgatacaactaagtggtcagtaaatgactggattaaatttattgatgaaaacggtaattgggaaatttaaatgaatcctgaatctaaattatcgcagcgaattgctgaagaacgcgccaaatttttccagaacatgaaacacaatggtattgaggatgaagtttttctaaattggttctggaataataagtatgcagcatgcgaaggagccttgtcattgtcagtcgcaatgatgtacgaaggctggaagggtgccaaaaagtttagctaagggcttcggccctttttggataataaaattttaatgcaattgaggataatgtatgactattcaaattaaaaacgccatcaattcttacgcatatgataaagtagtttctctgctagaaaaaggcgatattgtaactcctcaaattttggataaatgggaaaaagagcttcatcagacgatgaaacagaatgatcagaagattggacgcaatactgtccgtgaattgttggttcaatatatcttgtcagaatttgatgttaaagcttttggtgtagaatctaaagcttatcaaaagcatgaaatttccgataaaactattcgtcgtatgaaaaatcaacgcaagaaaaaatttgcagacctgaaaattactaaggtataattatgaacgaagctcttattaacgatttgcgtcttgccggatatgaagtaaatacaaatggcattggtttaactcaaattgaaggaaacggattcatccttgagtatgaatttagccaatggtggttatatgccaattacggcgaattgattgaatatgttgaccaatttgattcactagatgcagctcttgaagcggctaagttgatgaatgtatgaaattaattaatatttctattgctattgaaaattttggtattttctatgttgaccaatacatgaaaatttcatttttcccaaataaaactggtgttggatattgggaaagccatgtttctgaattaaatgaaagtgaatatgttagtacacataaaaagtttttagactttttatatcgcgctgatattaatgatcattacatagatattcatgaatttaaaaagatgatggagaaagtgttccaagcatactgcttacttagataactgatatcctctatgctttaagatagatcttcaaatattatgatataatagatctatgaattgagctaagaggtgaaaatgtcagaaactaagcctaagtataattacgtaaacaataaagagcttttacaagctattattgattggaaaacagaattagcaaataataaagacccaaataaagtagttcgtcagaatgatactatcggattagccattatgcttattgcagaaggcttatctaaacgtttcaacttttcaggatacacccagtcttggaaacaagaaatgattgcagatggtatagaagcttctattaaggggcttcacaattttgatgaaacgaaatataaaaacccacatgcgtatataactcaagcttgttttaatgcatttgtccaacgtattaaaaaagaacgtaaggaagttgcaaagaaatatagttacttcgttcacaatgtctatgacagtcgtgacgacgatatggttgcgttagtagatgaaacttttattcaagacatctacgataaaatgacgcattacgaagaatcaacctatagaacaccgggggctgaaaagaaaagtgttgtagacgattctcctagtttggattttttatatgaggctaacgattaacctctccggattcttggaagaaatacctgaagttgaagctattccctatttacttaaaatgtatctcagggaagttttagctcttgacattgatattgatccagaaaatccgtatgataccgcttttaaatctaatggtgtagaattaaactatcggtatcatttaacagatgatgatttttattttatattagagaaataatatgactgataaacccgaaattaatgatgaagtggaaaagcttatttcttctattgaagaaaagaaccgtcttgaagcagaaagaaaagcaaataagttattgtctaaaaacaaacgcgaactgaatcgtctttataagcacgctcagatcgcagctgaaaacaataattttgctcaatacgaatatgctatcaagaaaagtcgggatattctgaaacagccatataacgatgaactcatcagtattctttggaagactactagatcgcagattgaggatatgattgatgcttacacacgtaaaattcaagcgtcttaaaattaatgcaggatttactgaatctttgaatggtcatctttgtgtgaaaatttctgaaaaagaataccatgatagttcaattaaagaagttaatcctcctattgtaagagcagaccccaatatgaaagtgtgggttgattcttatcaagtcaaaaaatggtggcagttatgaaagatgaacacccagacttctgaaatagattataataaaattcgttcctctaaagaggaaatgatgagacgctttaaagagtctcatgataaagctaaagcagaaggaactataaaatataagcgcataaaatttaaaagttctaacgagcctctgtatggcgtattatgtggataggagcttcggctcctatattgctttataaatttttggtaaaataaaccaaaacaaagaggatattaaatgaaagtatgtatttttatggctcgaggtcttgaaggttgcggtgtaactaaattttctcttgagcagcgtgattggtttattaaaaatggtcatgaagtaactttggtttatgctaaagataaatcatttactcgtaattgtgcgcatgattataaatcattttcaattccggttttattagcaaaagaatacgataaaacacttaagctggtaaatgattgtgatattctaattatcaattcagttcctgctacttcggttgaagaagacactattaataactataaaaaaattattgataacattaaaccttctgttcgtgttgtagtttatcaacatgaccattcttctctttctttgcgccgaaatttgggattagaagaaactattcgtcgagctgatgttatttttagccattctgataatggtgattttaataaagttctgatgaaagaatggtatcctgaaacagtttctctgtttgatgatattgaagaagcaccgacagtatataactttcagcctcctatggatattgcgaaggttcggtcaacctactggaaagatgtttctgaaattaacatgaatatcaaccgttggattggtcgtacgactacatggaaaggtttttatcagatgtttgattttcatgaaaaacatcttaaacctgcaggactaagtactattatggaaggtctggaacgttctccagcgttcattcctattaaagaaaaaggaattccatacgagtattatcgtcttcatcaagtagaccaaattaaaattgctcctaatttgccaacgcaaattcttgaccgttatgtaaatagcgaaatgcttgaacgcatgagtaaatccggatttggttatcagctgagtaagttggacaaaaaatatctacaacgttctttagaatatactcatctcgagcttggtgcatgtggaacaattccggtattttggaaatctactggcgaaaatttaaaattccgtgttgataatactcctttgacctcgcatgatagcggtatcatttggtttgatgaaaatgacatggaatcaacatttgaacgtattaaagaactgtcatctgaccgaactctttatgaccgtgaacgcgaaaaagcttatgaatttttgtatcagcatcaagattcaagcttctgctttaaagaacagtttgacattattacaaaataaagggcttcggccctttagctttatacggagtttgatataatgatatttcttggatatgtgatactttttcttgcattttatctattcactagagcatgttggattgggttctttagcacgccagatgggtttatttcaataattttattttgcatttcaatgacggttcttgatatatgaaaattttaaatttaggtgattggcatttaggcgttaaagccgatgatgagtgggttcaatccattcagttggatggaattaaacaagcaatagaatattctaagaaaaatggaattactacctggattcaatacggtgatatttttgatgtgcgaaaagcaatcacacacaaaactatggagttcgcccgtgaaatagttcaaatgcttgatgatgctggtattaccctacatactattgtaggaaaccatgatatgcactttaaaaatactttaactccaaatgcctctactgagcttttggctaaatatcctaatgttaaagtatatgataagcctactacagtagattttgacggatgtttaattgatttaattccttggatgtgtgaagaaaatactggtgaaattcttgagcatatcaaaacttcatctgcttctttttgtgttggtcactgggaactgaatggattttatttttataaaggaatgaaatctcacggtcttgaacctgatttccttaagacttataaagaggtgtggtctggtcacttccatactatctctgaggctgctaacgtcagatatattgggacaccatggacactaactgcaggtgacgagaatgaccctcgtgggttctggatgtttgatacagaaacagaacgaatggaatttattccaaacaatactacctggcatcgtagaattcattatccatttaaaggaaaaattgactataaagattttacaaatctatcagtacgtgttatagtaactgaagtagacaaaaatctgacgaagttcgaatctgaactagaaaaagttgtgcattcattacgagttgtgtcaaagattgataactctgtcgagtcagatgacagtgaagaagttgaagttcaatctcttcagacgttgatggaagaatacattaatgcaattccagacatcactgattctgaccgtgaagcacttattcaatatgcaaatcagttatatgtagaggcaacacaatgacttttgatgaatttaaaaatgttatgatgagtcagcattttgaatgcgaagtaaaagatgatattggtcataaagaaattattgaatattggtttgaaccgctagaggttgaagataattgtattaaaaaagttacggtctgtacagattgggctgtatcttttaacttcaacattttagataatgacacacctaaatcattgcgagatatggccgtatcttgtattaaggatgcatactgtgaagttttcgacatttgacattaatgatgaattcatagcaaacattgattataccgaagaagattctagatatgttggaataatttatattacatcaaaaacagcacaaggtgttgtttgcatggctgaatttgatgaatactttttagattatgatgatatgatagaatggtctaaaagatacattaaaaggaatcttttgtgaagaattttaaactaaaccgagttaggtaccaaaatataatgtcagtaggtggaaatcctattgacattcaattagataaggttcaaaaaactcttattactggacgaaatggtggtggtaagtctactatgttagaagccatcacatttgggctttttggcaagccatttcgtgatgtaaagaaaggtcaattaataaacagcacaaataagaaagaacttttagttgaactgtggatggaatatgatgagaaaaagtactatatcaaaagaggacaaaaaccgaacgttttcgaaatcaccgttaacggtacacgtcttaatgaatctgccagcagtaaagatttccaagcagaatttgaacagcttatcggaatgtcatatgccagtttcaagcagattgttgtccttggtacagcagggtatacccctttcatgggtttgtcgacccctgcgcgaagaaagcttgtggaagacttgcttgaggtaggaacattagctgaaatggataagcttaataaagcactaatacgcgaattaaattcacaaaaccaagtgcttgatgttaaaaaagatagtattatccaacaaattaaaatatataatgataacgttgaacgccagaaaaaattaacgggtgacaaccttactcgtctgcaaaatatgtatgatgatttggcaaaagaagctagaacgctaaaatcggaaatagaagaagctaatgaaagattagttaatattgttttagacgaagacccgactgatgcatttaataaaatcggtcaagaagcagttttaattaaatcaaaaattgactcgtataataaagtcattaatatgtatcacgaaggtggattatgcccaacctgtttgtcacaattaagttccggtgataaagttgtttctaaaattaaagataaagtttctgaatgcacacattcatttgaacagctttcaacgcatcgtgataatttaaaagttcttgttgatgaataccgagataatattaaaacccaacagtcgttggcaaatgatatccgcaataaaaagcaatctctaatcacgacggtagataaagctaaaaaagttaaagcggctatagaaaaagcatcttctgagtttattgaccatgctgatgaaatagcactgcttcaagaagaacttgataaaattgttaagacaaaaactaatttagtaatggaaaaataccaccgaggaattttgactgatatgctcaaagattctggtattaaaggtgctattattaaaaagtacattccattatttaataagcagattaaccattatcttaaaataatggaagcggattatgtgtttacattagatgaagaatttaatgagacaattaaatcccgtggtcgtgaagattttagttatgcttcattcagtcaaggtgaaaaagcacgaattgatattgctcttttatttacttggcgtgatattgctgaaaaagtttcaggtgttaaaataaacacactaattcttgatgaagtttttgattcagcgaccgacgttgaaggtgtaaaagctatttcaactattttagatagtttaaaaaatactaacgtttttgttatttcgcatagagaccatgacccgcaagcatacggtcagcatcttcaaatgaagaaagttggtcgatttactgtaatggtttaatttataagagattatgctttaatttattagagtataatctctatggaggaaaaacatggaatattcaaccggacagcatctattaactattcctgaaataaaacgatatattctgagaaataatttttctaatgaagagcatatagttactgaatctatgcttaggaatgcatttaaagcagaatatacaaaaataatgtccaatagaaatgaagcttggactgttactgattattatgactaaaggtgtattatgactaaaattactgtgaattatactgttgatgtaaaagatattcagccaaaacacgtgcgttctgaatcaaatccacaaaaccaaaataaaattcgtcgagcatgggttttgtctctttctgataacgcaatggaagttattcagaacaaaattaaatctgcacctgctcgtcatgcgtattatgaagctatcgatcgtgaagtaagtaataaatggattgaactaatgcgcaaacatactacagaatccctaaacgctggtgctaaatttattatgacttcatgtggtgaacgccttgaagatgaatattgtggcaatgcagatgaacgtctgattgttgccgctcaaattgttgccgaaacaatcgcagctgattttaatcgttaattgctttattaaattagttataaaattaaatctcatttgaattgaaggaaattacatgaaactgtctaaagatactactgctctgcttaaaaatttcgctactattaactctggtattatgcttaaatccggtcaatttattatgactcgcgcagttaatggtacaacttatgcggaagcaaatatttctgacgttattgattttgatgtagcaatttacgatttgaacggttttctcggtattctgtctctagttaatgatgatgcagaaatttcccagtcagaagatggaaatattaaaattgctgatgcccgctcaacaattttttggccagcagccgatccgagtacagtagttgctcctaataaaccaattccattcccggtagcatctgttgttactgaaattaaagctgaagaccttcaacaactgttgcgtgtatctcgtggtctgcaaattgatacaattgctatcacggtaaaagaaggtaaaatcgtaattaacggttttaataaagtagaagattctgctttgactcgtgttaaatattctttgactcttggtgattatgatggtgaaaacacatttaatttcattatcaatatggcaaatatgaaaatgcaaccaggaaattataaacttctgctttgggcaaaaggtaaacaaggcgctgctaaatttgaaggtgaacatgcgaattatgtagtagctcttgaagctgattctacccatgatttttaatagagggcttcggccctttataatttacactaaaacttgaatgaggaaattatgattaccgtaaatgaaaaagaacacattcttgaacagaaatatcgtccatctactatcgatgaatgtattcttcccgcctttgataaagaaacctttaaatctattacaagtaaaggtaagattccacatattattcttcattctccttctccaggaacaggtaaaacaactgtagcaaaagcattgtgtcatgatgtaaatgctgatatgatgtttgtgaatggatcagactgtaaaattgatttcgttcgtggtcctttgactaattttgctagtgcagcttcatttgatggtcgtcaaaaagtaatcgttattgatgaatttgaccgttcaggtttagcagaatctcagcgacatcttcgttcctttatggaagcttatagttcaaactgtagtattattattactgctaacaatattgatggtattattaaaccacttcagtcacgctgccgagttattacgttcggtcaaccgaccgatgaagataaaattgaaatgatgaagcagatgattcgtcgattgactgaaatctgtaagcatgaaggaattgctatagctgatatgaaagttgtagcagctttggttaaaaagaattttcctgattttcgtaaaactattggcgagctcgatagttattcatctaaaggtgttttggatgctggtattttatcactggttactaacgatcgtggtgctattgatgatgttcttgagtctctcaaaaataaagatgttaaacaactcagagctttagcaccaaaatatgcagccgattattcgtggttcgtgggtaaacttgccgaagaaatctattcacgtgtaactccacagagtattattcgtatgtacgaaattgtcggcgaaaataatcagtatcatggtattgcagctaatactgaattgcatctagcttatcttttcattcagttagcatgtgaaatgcagtggaagtgatatgagcttatttgaagatgatattcaattaaacgagcatcaagttgcttggtattcaaaagattggacagccgtccaatccgctgctgattcttttaaagaaaaagctgaaaatgagttttttgaaataattggagctattaataataaaactaaatgctctattgctcaaaaagattattcaaaattcatggttgaaaatgcattatcacaatttccagagtgcatgccagctgtatatgcaatgaatttaatcggttctggattaagtgatgaagctcattttaattatctaatggctgctgttcctcgtggtaaaagatatggtaaatgggcaaaactggttgaagattccaccgaagtattgattattaagttacttgctaagcggtatcaagttaatacaaatgatgcaattaactataaatcaattcttactaaaaatggaaaacttcctttagtattaaaagaactaaaaggtttagtcacggatgattttttgaaagaagtgactaagaacgtaaaagaacagaaacaactcaaaaaactagcattggaatggtaaaatgattgaaattactcttaaaaaacctgaagattttctgaaagtaaaagaaactttgactcgtatgggaattgctaataataaagataaagttctgtatcagtcctgtcatattcttcagaaaaaaggactatactatatcgttcattttaaagaaatgcttcgtatggatggccgtcaagttgaaatgacagaagaagatgaagttcgtcgtgattcgattgcatggctgttagaagattgggggctgattgaaatcgttcctggtcaaagaacttttatgaaagatttaactaataacttccgagttatttcttttaaacaaaaacatgaatggaaactcgttcctaaatatacgattggtaattaatatgactgctataactccacaagaatacatggcgtctcttaaagaaaaatataatctttctgcaacagaaacactttttgatttaccagaaaacctccaattaaaatttcaggtagaatttcaaaaattagttcacccagaacaaaaacattttactgcagtcgttaagtcaattaatgcagatggaatgataattttcacccggcaaatagtactaatttaagcaaggggcttcggccccttatttggagtataatatatcaagagcctaataactcgggctataaactaaggaatatctatgaaagaattttatatctctattgaaacagtcggaaataacattgttgaacgttatattgatgaaaacggaaaggaacgtactcgtgaagtagaatatcttccaactatgtttaggcattgtaaggaagagtcaaagtacaaagacatctatggtaaaaactgcgctcctcaaaaatttccatcaatgaaagatgctcgagattggatgaaacgaatggaagacatcggtctcgaagctctcggtatgaacgattttaaactcgcttatatcagtgatacatatggttcagaaattgtttatgaccgaaaatttgttcgtgtagctaactgtgacattgaggttactggtgataaatttcctgacccaatgaaagctgaatatgaaattgatgctatcactcattacgattcaattgatgatcgtttttatgttttcgaccttttgaattcaatgtacggttcagtatcaaaatgggatgcaaagttagctgctaagcttgactgtgaaggtggtgatgaagttcctcaagaaattcttgaccgagtaatttatatgccattcgataatgagcgcgatatgctcatggaatatatcaatctttgggaacagaaacgacctgctatttttactggttggaatattgagggatttgacgttccgtatatcatgaatcgcgttaaaatggttctcggtgaacgcagtatgaaacgtttctctccaatcggtcgagtaaaatctaaacttatccaaaatatgtacggtagcaaagaaatttattctattgatggcgtatctattcttgattatttagatttgtataagaaattcgcatttactaatttgccgtcattctctttggaatcagttgctcaacatgaaaccaaaaaaggtaaattaccatacgacggtcctattaataaacttcgtgagactaatcatcaacgatacattagttataacatcattgacgtagaatcagttcaagcaattgataaaattcgtgggtttatcgatctagttttaagtatgtcttattacgccaaaatgcctttttctggtgtaatgagtcctattaaaacttgggatgctattatttttaactcattgaaaggtgaacacaaggttattcctcaacaaggttcgcacgttaaacaaagttttccgggtgcatttgtatttgaacctaaaccaattgctcgtcgatatattatgagttttgacttgacgtctctgtatccgagcattattcgtcaggttaacattagtcctgagactattcgtgggcaatttaaagttcatccaattcatgaatatatcgcaggaacagctcctaagccaagtgaagaatattcttgttctccgaatggatggatgtatgataagcatcaagaaggtatcattccaaaggaaatcgctaaagtatttttccagcgtaaagactggaaaaagaaaatgttcgctgaagaaatgaatgccgaagctattaaaaagattattatgaaaggcgcagggtcttgttcaactaaaccagaagttgaacgatatgttaagttcagtgatgatttcttaaatgaactatcgaattatactgaatctgttctcaatagtctgattgaagaatgtgaaaaagctgctacacttgctaatacaaatcagctgaaccgtaaaattctcattaacagtctttatggcgctcttggtaatattcatttccgttactatgatttgcgaaatgctactgctatcacaattttcggccaagttggtattcagtggattgctcgtaaaattaatgaatatctgaataaagtatgcggaactaatggtgaagatttcatcgcagcaggtgatactgattcggtatatgtttgtgtagataaagttattgaaaaagttggtcttgaccgattcaaagagcagaacgatttagttgaattcatgaatcagttcggtaagaaaaagatggaacctatgattgatgttgcatatcgtgagttatgtgattatatgaataaccgcgagcatctgatgcatatggaccgtgaagctatttcttgccctccacttggttcaaagggtgttggtggattttggaaagcgaaaaagcgttatgctctgaacgtttatgatatggaagataaacgatttgctgaaccgcatctaaaaatcatgggtatggaaactcagcagagttcaacaccaaaagcagtgcaagaagctctcgaagaaagtattcgtcgtattcttcaagaaggtgaagagtctgtccaagaatactacaagaacttcgagaaagaatatcgtcaacttgactataaagttattgctgaagtaaaaaccgcgaacgatatagcgaaatatgatgataaaggttggccagggtttaaatgcccgttccatattcgcggtgtgctaacttatcgtcgagctgttagtggtctgggtgtagctccaattttggatggaaataaggtaatggttcttccattacgtgaaggaaatccatttggtgacaagtgtattgcttggccgtcgggcacagaacttccaaaagaaattcgttctgacgtactgtcttggattgactactcaactttgttccaaaaatcgtttgttaaaccgcttgcgggtatgtgtgaatcggctggtatggactatgaagaaaaagcttcgttagacttcctgtttggctgatagaataaatctagggacctccgggtccctttttcatacaagtaatataaatctatacttatgaaaaacagatgattctggacctttagaattccctaaaaaatttttcacaaaactgtttacaagactgttcctctgtggtactatacaactatcaactaatacggatttggagaatgaaatgaaaatcgctattttggttattgcattaggtcttactggttgtgtagctcaaggaccggtagtaaatcagtctgatgtaggaaaaattgtaaactgttcaagcaaattttataatcctaatgtcaagtgttataaagaagctccaaagcaaacagtagaacaaatgcaggcgaattttgacgaagctattcgtccagatgaatctgctcaagcatatcgtaattctgatgtaattacacgcgaagaaaaaattgaaaactactgcgcagagctttgggcaaattgggctaataattaccaatggcgtactggtaaaaatgctccgatggagtatgtagtgaattcttataattcatgcgtaaaaaatttgactaagtgaggaaaagatggaaactttagtagcaggttcaatttttatggttttagtttcaggcgtgttggctattattatatacatgcttccatggttcatcgccttgatgcgtgggtcaaaatcgacagtaggaatctttttcacgtctttactgtttaactggtcaattattggttggtttattacatttatttggtcaattgcgggtgaaactaaaaagtctgcacaaccaaaccaggtaattatcatcagagagaaggaatgaaaagcaaaattataacagtgttgcttttaatcttgatgattataataagtatatactatagtgtaacggttcctcttatgattccaactattattttaggttggggtttattactgttacaagttaaatatgaatgtatcaattgaggtttaaatgattagtgactctatgacagttgaagaaatccgtcttcatttggggcttgcattaaaagaaaaagatttcgtagttgataaaactggtgttaaaactattgaaattattggcgcatcatttgtagcagatgaaccgtttatttttggcgctcttaatgatgaatacattcagcgtgaacttgaatggtataaatctaagagcttgtttgttaaagatattccaggtgaaacaccaaagatttggcagcaggtagcatcttctaaaggcgaaattaactcgaattatggttgggctatttggtcagaagataactatgcccagtatgatatgtgtttagctgaacttggtcaaaatcctgattctcggcgtggtatcatgatttatactcgtccatccatgcaatttgactacaataaagatggtatgtcagatttcatgtgtactaatacagtacagtacctgattcgtgataagaaagtcaatgcggttgttagcatgagaagcaatgattgctgggcaggctatcgtaatgattatgcttggcaaaaatacgtactagataaattagtatctgatttgaatgcaggcgacccatcgcggcaatataaagcaggttctattatatggaacgttggaagtcttcatgtgtacgaaaatcagttttatttagttgaccattggtggaacaccggtgagactcatattgctaaaaaggattatactggaaaatggaagtaaatgtgccgcatgtttataagtataaacatcctaaaactaaaaagtggtatataggaagtcatgatggtcacaacccgaattatgatggttcgggtgtagtttggcaacatgttaaaaagaaatatggaataaaatcctttaataaagaaatattatatgaaggaccaatgtttagacaggttgaagaaattattttaacttgtttagatgctgctaattgtccggattcatataatttaaagaatgaagcatggggaggaagttttccaggcaaattaaatggaatgtacggtaaaaaactatctccagaagaaagatataagtgcggaaatgcctttcgtggaatcaagcgtcctgatcattctaaaagaatgaaaggcgaaggtaatccaatgtatggtaaaaatgagcaggcatatggaattataaatcgagccaaggaaaattctggtaaaacttatgaagaaatttttggcgtagaaaaagctaaaataattaaagaaacgatgtctaaaaatcgtaaaggaaaacctcataatttgatagaaaaaatatgtccgcattgcggactaaaaggacgtgggccaaatatgacaagataccattttgataaatgtaaggcacttaaatgattcaattcgtaattccgagctatcaacgtgtaggggcagtttctgcccttgatatgtttccgactgattatgaacctcatatcgtagtacgtgaacatgaagaaaaagcttattatgatgcctatgggtctaaagctaaaattgtaactattcctgatgatgttaatggaattgccggtactcgtaaagcaattactgatatgtatgcaggtcaacgaatctggatgattgacgatgatactactattcgtatgagttcaatgcgaaaaagagatgatcgtcgttgtgtggataaagtcaatcaattgactcgtgaacagttctatgaattgattcaatacgtcgaagatgccatggattgtgggtattatcacggtcatgctcgcctaccaatttttaaaattacttcatcttggggtaattatcgtgaaaattcatatggattcacgaatacatggtatgaccttggaaaacttacgacagaacaaattgggtatggaaaaattgatttgtgcgaagatatgtatgcatttctcaatttaattaatcaaggttatccgcatttggccttgttcaaatatctggttgtatctggaaaagcacaagctcctggagggtgcagttcaattcgtagtaattctaaacataatagagcgcttgagcaaatcaatagagagtttccagagcaagctcgttggaaaacttctaatattgaaaaacgaaaatcgttgggtgaagaagacgagccattaaaggttcttcgcatgtgcgtttcgcgtaaagaaaaatcagaagcatttcataagtttaatgctattcatccaatagcagttgattaatgcctaaatttattgtgttataattactctatctttaaccagtgaggaaaatataatgatgcctatggaaaaaaatgaatgtctattgcagatttaaaatcccgtttgattaaagcttccacttctaaaatgactgctgaactgactacatctaaattctttaatgaaaaggatgtaattcgtacaaaaattccaatgcttaatattgctatttctggtgcgattgatggcggtatgcagtctggtttaactattttcgcagggccttctaaacactttaaatcaaatatgtctttgactatggttgcggcatatttgaacaaatatcctgacgcggtttgtctattctatgatagtgaatttggtattactccagcttatttgcgatccatgggagttgacccggaacgagtaattcatacgccaatccagtcagttgaacagctgaaaattgatatggtgaatcagcttgaagctattgagcgtggtgaaaaagttattgtattcatcgactcaatcggtaatatggcttctaagaaagaaacggaagatgccttgaatgaaaaatctgtggcagatatgactcgtgctaaatcactgaagtcattattccgtattgttactccttactttagcattaaaaatattccatgtgttgcggttaaccatacaattgaaacaattgaaatgtttagtaaaaccgtgatgacaggtggtacaggcgtaatgtattcggctgatactgtattcattatcggtaagcgtcagattaaagatggttctgatcttcaggggtatcaatttgttctaaatgtagaaaaatctcgtaccgttaaagaaaaaagtaaattctttattgatgttaaatttgacggtggtattgatccttattctggattgttagatatggctctagaattaggatttgtagtaaaacctaaaaatggttggtatgctcgtgaatttcttgatgaagaaaccggcgagatgattcgcgaagaaaaatcttggcgtgcaaaagataccaactgcactacattctggggtcctttatttaagcatcaaccattccgagatgctattaaacgtgcttatcagttaggtgctattgatagtaatgaaattgttgaagctgaagttgatgaattgattaactcaaaggttgaaaaatttaaatctccagaaagtaaaagtaaatcagcagctgatttagaaactgacctcgagcagttaagtgatatggaagaatttaatgagtaaagatgatttagatttagaaattatcgatgaatccccctcttcggagggggaagaagaaagaaaagaacgtctttttaatgagtctcttaagataattaaatccgctatggaaaatgttatccaggagattgtcattaaactagaagatggttctacacacattgtgtatgtgacaaaattagattgggttgatggaaaagtcgtaatggactttgctgttcttgaccaagaaagaaaagctgagttagctcctcatgtagaaaaatgtattacaatgcaactacaagatgcatttaataaaaggtcaaagaaaaaatttaaattcttttaaggagtaagtgtggtagaaattattctttcccatctcatatttgatcaagcttatttttcaaaagtttggccatatatggattcagaatattttgaaagtggtccagctaaaaatacattcaaattaattaaatctcatgttaatgagtaccatagcgttccatctattaatgcgttaaatgttgcattagaaaatagttcatttactgaaacagaatattctggtgtaaaaacacttatttcaaaactagccgattctccggaagaccacagctggttagtaaaagaaacagaaaaatatgttcagcaaagggcgatgtttaatgctacgtctaaaataattgaaattcaaactaatgctgagcttcctccggaaaaacgaaataagaaaatgccagatgtaggtgctattcctgacatcatgcgccaagcattatcaatttcatttgatagttacgttggtcatgattggatggatgactacgaagcacgttggctatcttatatgaataaagctcgtaaggttccatttaaactcaaaattctaaataaaattactaaaggcggagctgagactggaacactgaacgttttaatggctggtgttaacgttggtaagtcattaggattgtgttcattggcagcagattatttacagctcggtcataatgttctttacatttccatggaaatggcagaagaagtctgtgctaaacgtattgacgctaatatgcttgatgtttctcttgatgacattgatgatgggcatatttcttacgctgagtataaaggaaaaatggaaaaatggcgtgagaaatctactctcggtcgtttaatcgttaagcaatatcctactggtggagcagacgctaatacatttcgatctcttttaaacgaattgaagctcaagaagaattttgttccaacaatcattattgttgactatctgggtatttgtaaatcttgccgcatcagagtttattcggaaaatagttacacaactgttaaagctatcgcagaagaattgcgtgctctggctgttgaaactgaaactgttctttggactgcagcacaggttggtaagcaagcttgggattcttctgatgttaacatgagcgatattgcggaatctgccggtcttccagcaacagccgattttatgcttgcggtcattgaaaccgaggagttagcagctgctgaacaacaactcattaagcaaatcaaatcacgatatggtgataagaataaatggaataagtttttgatgggtgttcaaaaaggaaatcagaaatgggtagaaattgaacaagattctactccaactgaagtgaacgaagtagcaggttcacaacagatacaagctgaacagaaccgctatcaaagaaacgaatccactcgagctcagttagatgctttggcgaatgaattaaaattttagtttacaagctgacaagactatggtatagtagtcttgttggttaaatgaggagattgttatggaattggtaaaggtagtttttatggggtggtttaagaatgaaagcatgtttactaaagaaatcacaatgatgaaagatgacgttcaatgggctactactcaatatgctgaagttaataaagcgctagttaaagctttcattgatgacaagaaagtatgtgaagtggattgccgaggataatatgcacattgttttatttaaacctactccgtataatgtcaggaaaaatactcaattcaaagcacttatcgcagatacgtgggaattggtgttagatattccagcagaagaaagtcctccatttggtcgagtggaatttattaagtttgctgtgcgccctacgaagcgacagattcgccaatgcaaaagatactttcgtaaaatcgtcaagttagagaaacagttattgatgctagtaaaatagtagtttacaagctgatagagttgtgttatagtaattctatcagctaatcgcggagaaaagaaaatgatgctagttaatagagaatatcagtttaaatcagaagaagatttggaaaaattcgcgagtggttgtgaactgaatagacgcacagctaaagtcataggattaaaaccctttacagttctagattgtgaagtttctaaattccgcagagggtgttctattagcggtcatgctctggttgatggaaacacatttttctttgtttttagcgtcagagaacttttattgattaacgaacttgaggaaataaaatagtttacttttgttttaaacatgttattatagacctatcaaaacaaacgagtaaatggagaacaaaatgtctaaagtatcaggttatcaattattaacacaagaacaacgttcagagatggattctttacaagaacggtgtcagcatagaaataacgcacttgattcatttttattagttgaatatgaaaacttgtgctctagacttgaaaaagaatatgttcatcaacatgaaggaggagaagaatgaaactgaaatcaccaattattgcaatttgtctgtttgcttctactagtgtttacttttgttgaaaattgagatactataaacataaactactgaggagattatcatgaaaaaatttatctttgctgcaatttttgctttatcttcttgcgctgctcagcctgctatggcgggttatgacaaagatttgtgtgagtggtctatgactgcagatcagactgaagttgaaactcaaattgaagcggatattatgaatatcgttgagcgtgatcgtcctgaaatgaaagctgaagtgcaaaaacagctcaagtctggtggtgtaatgcagtataattacgttctgtattgtgataaaaacttcaataataaaaatatcatcgctgaagtggtaggtgagtaattagaggttaatatgtatagttctgaattttcatatttaaaaatggaaaaaaatttcatacgattttatagatgaaaaggtttattacagtttccatgaaccacgttttaatagtgaggttgggtttattgcagtaaaagacaatttcattttaaaaatatattcggcattaaaggattttcactacgaaaatattaacctaaaatttgataaagaaaacgttcgtaattgcgcagtaacaattacaggaaataaaggtacatgcgttatgctatctgatgaaattaatgatttgctaaatgatgccgaaaaggttgctattccatcgattgatgaccaaatttttaatgcttttatgaatagaggttaatatgaaaacgtttaaagaatttatcaaagaagatatggtcgctggagattcaggtggtaatcctgaaaatatctctactggaacaacgtcaggcgctgtagtaaataaaggtcctgaacagattcctaaaaagaaaaaagaggaatctaaagaaaaagaagagtaaaaatgtcatcgataccttggattgataatgagtttgcatatcgtgcattagctcatttacctaaattcacacaagtaaataatagttcaacttttaaattgcggtttagatgccctgtttgtggagattcaaaaaccgaccaaaataaagcccgtggatggtattatggtgataataatgaaggaaatattcattgttataactgtaactatcatgcaccaatcggaatatatttaaaggagtttgaacctgatttatatcgtgagtatatctttgaaataagaaaagaaaaaggtaaaagtcgtccagtagaaaaacctaaagaacttcctaaacaacctgagaagaaaataattaaatctcttccgtcatgcattagattagataaattggcggaagaccatccaattataaaatacgtaaaagctcgctgtattccaaaggataaatggaaatatctttggtttacaactgaatggcctaaattagttaatagcatagcaccaggaacatataaaaaggaaatacctgagcctcgtcttgttattccaatttataatgctaatggaaaagctgagtcttttcaagggcgtgcattaaagaaagatgctccccaaaaatatatcaccatcaaagcttatcctgaggcaacaaaaatctatggtgttgaacgggttaaagatggtgatgtatatgttctagaaggacctatagattcgctttttattgaaaatggtatagctattacgggtggtcaattagacctagaaattgttccatttaaagatagacgtgtatgggttttagataatgaacctcgtcaccctgacactattaaacgaatgactaaattagttgatgcaggagaaagggttatgttttgggataaatctccctggaaatcaaaagatgtcaatgatatgattagaaaggaaggtgcaacccctgaacaaattatggaatatatgaaaaataatattgcccaagggttgatggctaaaatgcggctatctaaatatgctaagatttaaattaacccaaccaaagcaaatgctaaatctacgaatgtatcaagagtaattactggaatactaacgccatgagcaatagcaactggcgataaaacaaaattccaaagtaaaattcctatcatagcagaaatagtaaaagctatacgttttttattacctttgatggcattaacaagtgccattaatttttgtaccatatgtcctccttattgctttatatatttattgtataattaatctactaatccatgaattgaaaggaaaaataatggcatactttaatgaatgcgctcatttgatcgaaggtgttgataaagcaaatcgtgcatatgctgagaatattatgcacaatattgacccgctgcaggttatgcttgatatgcagcggcatttacaaattcgtttggctaacgataaaccagaaacaaatcgtcatcccgattcacttgaaactgcgggagaagttcttgcttggctgcgaaaccaagacgattatatcgcagacgaaactcgcgagctatatacttctcttggtggtatgagtaatggtgaaaaagaagcttctgctgtatggaaaccttggaagaaacgttattctgaaatgcaatccaagaaaattcaagatttatctcctgaagatcagcttgaaattaaatttgaactgattgatcaatttcactttttcatgaataaatttattgctcttggaatgtcagctgaagaaatctttaaactttattatctgaaaaatgctgaaaatttcgctcgtcaagatcgaggttattaatggctcgtttaaataaacgccagcttaagaaagcccacaagaaacgtattgaccagctatttaaaaattatgacaaagagctcgtgtgtgagctcttatctaatcagcttcgtgcggttgattgggttgtagaagaaggtcctgatgaaatttttgtcagcgaagaagccttaaaattaattatagagcattcaaaatgaaaatatccaaagaagaatttattagacgacaaaaagctttaattaatttacacgagtggtatgcttaccagcttaaagtagatagctctaatataaatgctgtaatggctttatataaacaaattcaagatgaacacgaattcctggcacaagttttcattgaagactgatataaatacacctgtaattaaacaataaaggagtttattatgggtggtttcgttaacatcaagacctttactcatccagcgggtgaaggcaaagaagttaaaggtatggaagtttctgttccgtttgaaatttattctaacgagcatcgtatcgcagattctcattatcagatctttccgtcagaaaaggcagcatattctactgtagtttctgatgcagctgattggaaaactaagaatgctgcaatgtttacgcctacacaaataggtggttaataattcaaggactcctccgggagtccttttttcattttactggtttactttccaaaatgagtatggtataataaaattatcttatagaggagagcactatgttaaatcgttggattaaaccaaatgaagatttagatattatcatttcacggcatgtaatgaagaaatatgaactgcagccatggtctacagaagttgttgtgcattcatttatgatgtacgcagatggttctgtcgaatttaatgcagaaattcgatatgattatggcgagaagcaagtcgaattcaagagaggctttttgtaatgtttatctttaattggtttaaaagcttctttacagattttttctctacaactcctggagaaggtgtagttcctatttcaaatgactaccttcctttaactgtagttgaatatgtttatatgggagatggaacagtagaagcagttactatgacttatgaagaagcccaagaatattataaaaatccttggcgctggtcaacacctattacatcatctaatacacagaatacacagtctagttctgattcatatgacactaatgttcctgttcatgtatggacgggcgattcgtgtggaagttcttgtgattctagttgttcatctacatcttgtgattgaggaaaattatggaagcgattttgtttgaaatgtatattagcagtaatagtatgtcgtttgctaaagacgttccaattaccgtagcagtaatgattgataagggttattgtgacccaatgtatctcgtagaaaatttcgtttcaatgccagttccagaagatgctgaaataaaacttaaaaagattggtattattgaaactgtaccaaatattccgtttagagcaattgaagcatttactaaatccgaatacattaatgttagcgcagaacaatataatgataaacctatatctttctattcgtatgattcagtatatagttggaaaatagataaaggaaataaatttataattgtgagtgaagatgctttatcatactttatttcttctatatggaatagtttacatccaaatttgctaaaaattcatgaattcgatgatgctcctactgttgttttaggtaaaacaaatgaaagttctgaagaaaatgtttgaatggttcagtagaccaaactcaatgtacattgatgatggttgggttgaacaagcaaataaagaaatgcagaacgaatcagaagaatggatgaaatcaatgattagcgttgagaaagaaaagaaattagaacgctcagcgcttaaattgatgagagacatttatggggataaatcgtgaacagagatatgacgctagaagaggctaaagctaaagcaaatgaagctttagatttgcttcttaaaattggcagtaaaatgatggaagaaaatgagaaatatatccaggaaaacaaaattcctgatggtccattagtaggcaaaaggaaatcgcatgattgaagtagcaaaacattattcaatagaatttatgtctaaagaaggtaaatcagtaaatacacttgataaaaagtgctcattaattattcctttagcagaaaatccggatattttaattaaagatataaaagaaagaaaatatccagaaaatgttattctaattataaagcatactgaagatattttgcagaatactgattcaccgttttcttcttctgaagctttaactattaaaggctataaaagagctcatgaatatggtctttttgacctgtttgaagacgataaagttaaattagcacttaatttagcaggtcaatcttctaaaagtaaaacattcattattgaagatattaaagatataaatgcatttgttaagatggtctgggctcattttgacgttggactacgctggagaatgtccgaagaagaaagaaaaattattgaagctaatcgttattttggtttttatcgctaggaattaatatggatttatttgagatgttagaagataatcattctacgaatatccagaatgattctagtgattataagaaagagtaccgtatagtattacagaattatggaattgaagccccagatgctcttctagaagaactagcttcataccatcttgaccctccgccctgggctccctgggcaaaataattcaaaaagttgtttactttccttcctaacaatgatatgatagcttctgaagtatatggaggctatcatgattattaatcttgcagatgttgaacagttatctataaaagctgaaagcgttgattttcaatatgatatgtataaaaaagtctgtgaaaaatttactgactttgaacaatcagttctttggcaatgtatggaagccaaaaagaataaagctcttcatcggcagttgaataaaatcattaaaaagcatttaactaaatcaccttatcagctatatcgtggtatatcaaaatcgacaaaagaactcattaaagatttacaagttggagaagtgttttcaacgaacagagtagattcatttactactagtttgcacacagcgtgcggtttttcttatgttgagtatttcactgaaataatatttcgcttaaaaactgataaagcttttaattattctgaccatatcagcgatattatactttcttctcctaatactgagtttaagtatacatatgaagatactgatggattagattcagaacgtactgataacttaatgatgattgtgcgtgaacaagaatggatgattccaattggaaagtataaaataacttctatttcaaaagaaaaattacacgattcatttggaacatttaaagtgtatgatattgaggtagttgaatgaaatattcagcaatgcaattaaaagattttaaaatcaaatcaatggatgcatcggtgcgtgcttctattcgtgaagaattactttctgaaggatttaatttatctgaaattgaacttttaattcattgtattactaataagccagacgatcattcttggttaaatgaaataatcaaatctcgtttggttccaaacgataaacctctttggagaggtgttccagttgagactaagcaggtgttaaatcaaggaattgatattattacatttgataaagtagtatcagcttcatatgataaaaatgtagagctacattttgcttctggattagaatacaacacgcaagttatttttgaattcaaagctcctatggtatttaatttccaggagtatgctataaaagctctacgttgtaaagaatatagtccgagttttaagtttccagatagccatcgttatcgtaatatggaattagtttcagatgaacaagaagtaatgataccagctggaagtgtatttagaattgcggatagatacgagtataaaaagcattcaacatacactatctatactcttgactttgaaggatttaatctataatggaaggacttagattcattataccatgaaagttttaaagcatttttcataaagttgtttacaagctgaagtaaaaatgttatagtataagtagttaaccgtccgtgagaaaaatatgaaactgtctaaaaatcaaattcgtaaaattacacgtcgtttagagcatactcaggcatctgctaaaagacgttctaaagattttaacttagacttcaattacattaagaacattttagatcagaaagtttgcgcttactcgggagaaccttttgataatcgtattgaaggagagaaattatcattagaacgttttgataataacgttggatacattaaagggaatgttattgcagtaaagaaaaagtataatacatttcgttctgattatactttagaagagttgattgaaaagcgtgatttatttgctttgcgaattggtcgttcatctgcgaaaaaagttcataaactaaatttagatgaaaagaaatgggctaaaatcaaaaagacttataatcaaattaaagctatacagaaaaaacgtgaaaaccgaattgagcacatttctcagctttctaaatcaaaacaaacttctgacgttaagctaacgattatagcacttaaagctcgtattgatggttctcgtatagcagaaggcgctgaagttgttaaattgaacgttcttcttaaaggctcggattggaaaactgtgaaaaagctgtcagaagcagaaatgcaatatgatatgtgtgataaaattattcaaggtgtagagcggtatcaaaacttgtcttttattgataaacttaaactgaaaagaggatacccgctaaattgttcaatttttaaacttatccgaggataatatgttttatgtatatgcgatagtgtatagagataaagatggatttgcggtgcctgttcctcttgatgaacatcgccctgctgtattttttgaaagggagattgctgataaagtatttacaactcttaaagagcagtatcaactagctttaggtatgggaattccgagattagttgagactccacgcaagttttggtttaataaaatagaagttaaacatgttaagcctgatgtagacacgcaaagattatatcggcgaattttagatactgggcgtattgttagtataccaattgcagggaatttacgatgacatttgatgatttgacagaaggccagaaaaatgcctttaacatcgttatgagggctatcaaagaaaagaaacatcatgtaactattaatggacctgccggtactggtaaaactactcttactaagttcatcattgaagctttaatatctacgggcgaaactggcattattttagcagctcctacacatgcagctaaaaagattctttcaaaactgtcagggaaagaagcgagtactattcatagtattcttaaaattaaccccgtaacatacgaagaaaacgttctttttgaacaaaaagaagtaccggatttagccaaatgtagagtattaatctgcgacgaagtgtcaatgtatgatagaaagctatttaaaattctgctttcaactatcccgccatggtgtactataattggaataggcgataataagcaaattagacctgttgacccaggggaaaacactgcttatatcagtccattctttacacataaagatttttatcagtgtgaactcactgaagttaaacgcagtaatgctcctattattgatgtagctactgatgttcgcaacggtaagtggatttatgataaagttgttgacggacatggagtacgtggatttactggtgataccgctttacgcgattttatggtaaattatttttcaatcgttaaatcactagatgatttgtttgaaaatcgcgtaatggcatttacgaataaatctgttgataagttaaatagcattattcgtaaaaagatttttgaaactgataaagattttattgtcggtgaaattattgtaatgcaggaaccgttaattaaaacatataaaattgatggaaagcctgtgtcagaaattatttttaataacggacaattagttcgtattatagaagcagaatatacatcaacatttgttaaagctcgtggcgttcctggagaatatctaattcgtcattgggatttaacagtagaaacttacggcgatgatgaatattatcgtgaaaagattaaaataatttcatctgatgaagagctgtataagtttaacttatttttaggtaaaacagcagaaacttataaaaactggaataagggtggaaaagctccatggagtgatttttgggatgctaaatcacagtttagtaaagtgaaagcacttcctgcatcaacattccataaagcgcagggtatgtctgtagaccgtgctttcatctatacaccttgtattcattatgcagatgctgaattggctcaacaacttctttatgttggtgttacccgtggtcgttatgacgtattttatgtgtgaggatatatgattaacatcaattcaaaatatttaaatcgtctaatagatggtataaggaagcatactaataagcaagataatctcgatgttatggtaacaggagctgagctccttcataagctttatcttataagtgatactatattagcaattaaacgaattgaaaaacaatcatatcacagtaatacagatacggtaattacactagatgaaagtgtctgtaaattactaattaaatttgaggaagctattcgtggaaataactaaagaccagttttatctgcttcaagataaagtgagcgaaatttatgaaatagcttatagtaaaaatcgtgaaactgtaaaaattgaatctagtaagttgatgcttcaattagaagaaattgaacgagatttaattgcgttagaattcttttgtggtgaagtgaaaactgtcacaatcagtgattatgttttaggtgaaattagctatctttataaggcgattattaatgattgaattaagttggtgtcagtttaaatctcttatgacaaatgttaaagctgtcattgagaaaaattctggtcctgaaaatattactattcgcgaaaaagctttaaagataatatacagtcttgaagagatgcaaaaagatattgaatctatggcaaaatttattgatgaacctattaataaagtttatattcaagactatactgtaggccaaattcgcgatttagcgaggaaaatttaatgtttgattttattatagattttgaaacaatgggaagtggtgaaaaagcagctgttattgatttagctgtaattgcttttgaccctaacccagaagtagttgaaacatttgatgaattagtttcacgcggcattaaaatcaaatttgatttaaaaagccaaaaaggacatcgtctttttactaaaagcactatcgaatggtggaaaaatcagtctcctgaagctcgaaaaaatattgcaccgtccgatgaagatgtaagcactatcgacggtattgcgaaatttaatgattacatcaatgcacataatatcgatccttggaaatctcaaggctggtgccgtggaatgtcgtttgattttccaattttagtcgatctcattcgtgatattcaacgtcttaatggtgtttctgagaatgaacttgacacatttaagttagaaccatgtaaattctggaatcagcgtgatattcgtaccagaattgaagcacttctgcttgttcgtgatatgaccacgtgtcctcttccaaaaggaactttagatggattcgttgcgcatgattctattcatgactgcgcgaaagacatcctgatgatgaagtacgctttgcgatatgctatgggtcttgaagatgctccatcagaggaagattgcgatcctctatctcttccaacaaaacgataaaaagttgtttacttcctcggttagttgtggtattataacaccatagctactgaggataataaaatgaaaatttatcgtgttgaatcatcgtttagtattcttgattatgaagatgctataacaatacgtcgaaatctttgtgttcaaataacgccgtacaggagtataatagattcatggagcgaagagtggctattacacgtaggttatgacagacctaattttatgcatcatagcgataataataaaagaattcctttaccacacgaagataaactattagttaaaaacgctaatatagtaattaatactaagttcaagaaagattatgttggagtagaatatcatattccaggatggtttatagctctttatcattttgctttcgctagcgaatatgatatgatgagatggttcacacgagaagagcgtgaagaattagcttcgaaaggattttatcttgctgtatacgaagtaccagatgaccaagttatcgttggcgggcatcaagtaatgttccgtaaatcccatgctgaacttgtagattttattgaaatgagataattatgaaatttaattataatcctgaatacacaccgaatccggcagctaaactgattgattttgacgttgtaagtacttatgtatgccctgttaaaccactggaaattaaggaacctactatgactaccgctattgaaatcggcaaaacctacaaactggttgaacctaaaattaaaactaatgccttgatttctggtcataaaactctgactgatgtttttggcgaaggcgaatttattgttgaagaatttgccaaaagtgagtggtttgacaaatcttacgtcatccacggtcgccggttagataataacaaaataaagaaaaacctggtttatgaagatgagttcatcctgttccaagaagttgaagaacaagaccctacagacctgttgtgtgctgctgtgtctatccgtcgtccttttgataatcctatctgtggttgggtaacagaccagtggattgaagatggtgttgagcttctgaacgttgtccatgcaggagattttagtgtagtacctcgtagtgcggtggtagctattttgaattaatagtttacaaactcttgggaccagagtataatggtcctgtggagtataaaatctttttaacaagtgagagataactatgattattaatattggtgaaattgctcgtgtatctgataaatcccgttctaaagcagcaggaaaattggtcgaagttgtaagcattcagcttaaacacggtgttaaagatgaagattctgaagtaaaagtacgtatcattgctaaagatggaatgtctaagccccagtttggttatgttcgatggaaatttcttgagcctgcgtttttgaaagctgttcctgctaaaggaattgaaacgattgatacttcgcatgtaggtgtagactttaagtggaaactcggtcaagctatcaagttcattgctccttgtgaatttaaatttatcaaagatgatggaaaggctgtttatactcgcgctatgtgtggatacattaccgatcaatgggtagaagatggcgttaagttgtacaacgtggtatttttaggaacatataaagtcattcctgaaagttggattaaacactacagcaatgctctctatgcataaagtttaaaattttttcataaaactatatacatcagtagttgattatggtactatatcaatatcaactactgatacagaaaacaacttggagaataaaatggataattcgttaaaggtgcgctgatactcttctgaaacgcatcgctccaatgttcaattaatgaggaaattatgatgaaacgtaaaattgttcagaattgcactaatgatgaatttgaagatgtattattcgatccagatttggtagtagttcaaaaggaacacactatcaagtttactcacttgacttcggtttatgtgtatgaaaaggttggggataaacaaccaatttacggtgtatttcgtgaaatcactgaagatggtacaacttactggaaggaaatttattaatggctattaaatttgaagttaataaatggtatcaatttaaaaataaacaagctcaagaaaattttattaaagaccatactgataacggaatctatgcacgccgtttaggtatgcatccttttaaaattttagatgtggatgctcttgggcgtcctattaaaattatgtcatttgctggaaatttagtactatcttctggtaaagatattttggatgaagattttatttggctttcatcgaatgaagctgaattctttaatgaagttgaaaatccataccaggcagctgaagagcaggaagaatctgcaccgataactgatcaatctaaattccctgtaatgaaagttactattgaaaatgatgaacaggcatggtccttgtatcagatgttgaaagctcactttaaggaataattatgccgctttatgattataaatgtcaatcaaaagactgcgcaaaagaatacgaaaaaatcaagaaaatttctgaaagagatactgatgtatgtcctgattgtcatcggattgctattcggttagtctctgcccctaagcatgtgaatggcggattttacgacttacttaaagggtaattatgtttaaaatcggtaagaaatatcgcattcgcgaaggtgaagaaaagaaatatctattttctgctatttataggaatggttctattaatgctgtaatatctacaagcgaatttatcgttgaagatatgaaaggtaataatgttacaatgattagtacagcatctggaaatgacggaaaaattcttcacagttttcagagtaatgttctaatttatgatgaagaatttgacttcttcgaagaagttcccgaaggttttgcttttgaatgcactatcactatgaaatctggtgaccctctttcttttacagttaaagatgaaggaagtcgcttgagaattattagtcttcttcaagccattaaatttaagtgaaaattatgaaatatattaatcgttctatcgcggcattagtattagcagtgtctttagtaggatgtactgatgctgataatgcaaccaaagttttgtcttcaagcggttttactaatattgaaatcactggatataactggttcggttgttctgaaaatgatttccaacatactggatttcgtgctattggacctactgggcagaaagtagaaggaacagtatgttctgggctgttctttaaggattcaactattcgttttaaataaaaggccttcgggcctttagctttatgattaccggagtataatattcccgaaaccaaacgaggataagtgatgattaagaatgaaattaaaattctgagcgatattgaacatatcaaaaagcgtagcggcatgtatattggctcttctgctaatgaaatgcatgagcgctttctgtttggtaaatgggaaagtgttcagtatgtacctggtcttgttaagcttattgatgaaattatcgataactcagtagatgaaggtattcgtactaagtttaaattcgcaaataaaattaatgttactattaaaaacaatcaagtaacagttgaagataacggtcgcggtattccacaagcgatggttaaaacacctactggtgaagaaattcctggtccagttgctgcgtggactattccaaaagcaggtggtaactttggtgatgataaagaacgcgtcaccggtggtatgaatggtgttggttctagtttaactaacattttttctgtgatgtttgtcggtgaaactggcgatggtcaaaataatattgtagttcgttgttcaaatggcatggaaaataaatcatgggaaactattcctggaaaatggaaaggaactcgtgttactttcattccagattttatgtcatttgaaactaatgaattatctcaagtttatcttgacattacattagatcgtctccagacacttgctgttgtttatcctgatattcaatttacctttaatggtaaaaaggttcagggcaattttaagaaatatgcacgccaatatgatgagcatgctatcgttcaagaacaagaaaactgttctattgcagttggtcgttcaccggatggttttcgtcaattaacatacgttaataacattcatactaagaatggtggccatcacattgactgtgttatggatgatatttgtgaagaccttattccacaaatcaaacgtaagttcaaaattgatgtgactaaagcacgcgttaaagaatgtttgacaatcgttatgtttgttcgtgatatgaaaaacatgcgatttgattctcaaactaaagagcgtttgacttctccatttggtgaaatccgtagtcatattcagcttgatgctaaaaagatttcacgtgctattttgaataatgaagcaattctgatgccaattattgaagctgctttggctcgtaaattggcggcagaaaaagcagcagaaactaaagcagctaaaaaggcatctaaagctaaggttcataaacatatcaaagcgaatctttgtggtaaagatgctgatactacattgttcttgactgagggtgattctgctatcggatatcttattgatgttcgtaataaagaacttcatggtggttatccattacgtggtaaagttctcaacagttggggtatgtcatatgctgacatgcttaaaaacaaagaactgtttgatatttgcgcaatcactggattagttctcggtgaaaaagctgaaaacttgaattatcataatattgctattatgactgatgctgaccatgatggtctaggaagcatttatccttctctgcttggattttttagtaattggccagaactgtttgagcaaggaagaattcgcttcgtcaaaactcctgtaatcatcgctcaggtcggtaaaaaacaagaatggttttatacagtcgctgaatatgagagtgccaaagatgctctacctaaacatagcatccgttatattaaaggacttggctctttggaaaaatctgaatatcgtgagatgattcaaaacccagtatatgatgttgttaaacttcctgagaactggaaagagctttttgaaatgctcatgggagataatgctgaccttcgtaaagaatggatgagccagtagtttactttaccacaaggatgtggtataattaattgggcaaatgaggatattgaaatgaaatcatataaagtaaatttagaactttttgataaagcagttcatcgagaatatagaatcattcaacgctttttcgatatgggagaagctgaagagtttaaaaaccgctttaaggatattagagataaaattcaatccgacaccgcaactaaagatgaactactagaagttgctgaagttattaaacgcaatatgaattaatgaggaaattatgattatcaccactgaaaaagaaacaattcttggtaatggttctaaatcaaaagcatttagcatcacagcatctcctaaagtatttaaaattctatcatctgatttgtacacaaacaagattcgcgcagtagtccgtgaattgattaccaacatgattgatgcccatgctctcaatggaaatcctgaaaaatttatcattcaagttcctggacgtttagacccacgatttgtttgtcgagattttggtccgggtatgagtgattttgatattcagggtgatgataattctcctgggttgtataattcatacttcagttcatctaaagctgaatctaatgactttattggcggatttggtttaggttctaaatctccgtttagttatactgatacgtttagtattacttcgtatcataaaggtgaaattcgtggttatgtagcttacatggatggtgatggcccacagattaaacctacattcgtaaaagaaatgggtccagatgataaaactggtattgaaatcgtagttccagttgaagaaaaagactttagaaactttgcttatgaagtttcttatatcatgcgaccattcaaagatttggctatcattaatggtcttgaccgcgaaattgattattttccggattttgatgattattacggcataaatccagaaagatactggcctgatcgtggtggattatatgctatctatggcggtattgtttatcctatcgatggtgttattaaagaccgtaactggctaagcattcgtaatgaagtgaattacattaagtttccaatgggttcgcttgatattgctccatcacgcgaagctctttcactagatgatcgtactcgtaaaaatattattgaacgagttaaagaactcagtgagaaagcatttaatgaagatgtaaaacgatttaaagaatctacatctcctcgtcacacatatcgtgaattgatgaagatgggatattctgctcgagattatatgattagtaattcagtcaaattcacgactaaaaatctgtcatataaaaagatgcagagcatgtttgaacctgacaataagttatgtaatgcaggagttgtgtatgaagtaaatcttgatcctcgactgaagcgcattaagcaaagtcatgaaacttcagccgttgcatcaagttatcgtctgtttggtattaatacaacaaaaattaatatcgttattgataatattaaaaatcgtgttaatattgttcgtggattagcacgagcgttagatgatagtgaatttaataacactttgaatattcatcataatgagcgtcttctgtttattaatccagaagtagaatcgcagattgatttgcttcctgatattatggcgatgtttgaaagtgatgaagttaacattcattatttgtcagaaattgaagctttagttaaaagctatattccaaaggtagttaaaagtaaagctcctcgtcctaaagctgctacagcatttaagtttgaaattaaagacgggcgctgggaaaaagaggaattatttacgctcacatcagaagcagatgaaattactgggtatgtagcgtatatgcatcgttctgatattttctctatggatggtactacatctctttgtcatccatctatgaatattttgattcgtatggctaatcttattggcattaatgagttttatgttattcgtccgcttttgcagaaaaaggtaaaagaactcggtcagtgccaatgtatttttgaaactctgcgtgatttatatgtagatgcttttgatgatgtagattatgataagtatgtaggttattcaagttcagctaaacgatatattgataaaattattaagtatcctgaactagattttatgatgaagtacttcagtgtagatgaagtttctgaagaatatacacgactcgctaatatggttagttcattacagggtgtatatttcaacggtggaaaagataccatcggtcatgacatctggacagtaactaatctttttgatgaattatcacgtaatgcttcaaaaaacagtgataaaatggttgctgagtttaccaagaaattccgtattgtttccgacttcatcggatatcgcaactctttaagtgatgatgaagtttcccaaatcgctaaaactatgaaggcccttgcggcctaataaggaaaattatgtacaatattaaatgcctgaccaaaaacgaacaagctgaaattgttaaactgtattcaagtggtaattacacccagcaggaattggctgattggcaaggtgtatcggttgacacaatccgtcgtgttttgaaaaatgctgaagaagcagaacgctctaaagttactattagcggtgacattacagttaaagttaatagcgatgcagttattgctccagttgctaaatctgacattatttggaatgcatctaaaaaattcatttcaattactgttgacggtgtaacttataacgcaactcctaatactcattcaaacttccaggaaattcttaatctgcttgtagcggataagttggaagaagcggcacaaaaaattaatgttcgtcgcgctgttgaaaaatatatttccggcgatgttcgaattgaaggtggaagcttattctatcaaaatattgaattgcggtctggtttggttgatcgtattcttgattcgatggaaaaaggcgaaaactttgaattttattttccgttcttggaaaatctgctggaaaacccaagccagaaagcggtatctcgactctttgatttcttggtagcaaacgatattgaaattacagaagatggttacttctatgcttggaaagtagttcgtagcaattactttgattgtcactcaaacacttttgataacagtcctggtaaagtagttaaaatgccgcgtactcgtgtgaatgacgatgatacgcaaacttgttcccgcggtttgcatgtatgttctaaatcttatattcgtcactttggcagttcaaccagccgagtcgtaaaagttaaagtacatccgcgtgatgtagtatcaattccgattgattacaacgatgctaaaatgcgtacctgccaatacgaagtagttgaagacgttactgaacaatttaaataagggcttcggcccttaactaaggaaaattatgttaggttatcaagcacgagtaaaagaagaatacgatcaattaatgctcaaaattaatgcacttagcaattttttagaaagcacaaagtttctaacggttagtgcagttgagcaagaattgctactttcgcagtttatctcaatgaaatcttacgcagattgtttagaaaaaagaattgcacaattcaaataaaataagggcttcggcccttttgttttaagggaaattatgattccgacataaaggaaagtttaaatgcagaaaacgaatccgggtttgcagagactatttcagattccgtcatttaccctatcgaacagtgacttgactagtgaaatgaaggtcaaaattgctgatactgcaagatactctttaaaacaaaacccgaaccaggataaagcagaagttatcgaaagatgtcgtatcgctgtgtacgcagagttttttgtggcagattggctaagagggtatgttaacaaaggccaagaggatgttaatgacccgtatacatacgcatgggatgtactggcgcatccaaaatactgcgggcttcgtgtagaagttaagacacatcaaactgactcacgttggatttcggtaacaacaggatgcagcggagagtatccatatggttctggaataaatctagggcccattctaaatcatcaagtcgctgactgtataattatattcaacactaaagaaattcatccaggtgtcatccagtacactccgaagttcatcggtgacagagaagaccttcgtaaggttgtaagaaaaagcaactacaatggatggtatctttccatttaaaaattttcacaaaacggtttacataccacaaggactgtggtactatacaactatcagctacggaggagtaaaaatgaaatttaaattttattacgctaaacataaaattaccggtgaatttattgcatttacgacttcaactacagatgaaggagatatttttactgcagtatttttatcaaaatgggaatcagatcaaccttacttatcatcacgtgaagatctccaacgattagttaatggagaatataatgattcatggtcatatttagtccatgattgtgttaaaaaggcaataaaacaaaaacacttggaaatcgttgagattgaactatgagttcattatggtggtgtttcgtttggttaattagtattccattaatttgtttaacatttacttttgtgatgaggttattatgaaaattttgaattctgtgcttattgcttgtgcgtggtgggttgcgcaagtttcagcagtagtagttggtattcacatttattacgaatatttttaaaaaagttgtttacaagactgttcttccgtggtattattaccctatcaactacggaggaacagaaaatgaaaaagattgttaaagctatatggaatgtagttataatactaatagttttgagtatattcccaatcgttttaatgattgatgtattaaacgcttactttggatttatgtgaggaaaatatgaagcgtaaacgcagtgcttttacatttattgaatggtttttcgataatatttttccggctttattcattttcatgctgatttttgctttaggttcagttgtagttggaatctatttgatgacagtagtcggaattgatattcatcaaaatggtttaaaatccgtagttgaaacaatttggaacggtgtaaaatgatgaatttgctgagcggttggttttatattcttatgttttacattggcgcaaattttccatattggatgggatggtcaacaactgcgtttggattttatactccttgaggtgaattatgaaaatctttaaagatgtaaaagttggtgaaattttctgtttagataacggtgatcagttaattcgtatttcacctcttaagagcactagcgagaaaccgacagttaacgctactttagcaaacaatagtaatgaacgtttctgtattgaaaatgatactgaaacttataccgtagaagagttttgggaattgagcgtcgactgcgacgattaatttaatggccgtgtgtattcatgcggccttggagtagaaaataatttagaggaaattaatatgaaatacatgactgttactgatctgaataatgcaggcgctaccgttattggtacaatcaagaacggtgaatggtttttgggagttccacataaagatattttatctaaacctggattttactttttagtaagtaaattagatggtcgtccatttagtaatccatgtgtgtctgcacgattttatgtaggtaatcagcgttctaagcaaggatttagtgcggttctaagtcatattcgtcaacgtcggtctcagcttgcgcgtactattgcaaataacaatgttccatacacagtattttatctgcctgcttctaagatgaaacctctgactacgggatttggaaaaggtcagttagctttggcgtttattcgtaatcatcattctgagtatcaaacacttgaagaaatgaaccgtatgttggctgataactttaaattcgttttgcaggcatattaatgagtaatttccacaacgaacatgtgatgcagttctatcgtaataattttaaaactaaaggcgtcttcggacgccagtgaggaaaatatgaatattgcaaaattattaggagttatttcatttatttgttggatagtagcatgtgttttaactatctgtattgatgtcagcagtgtgttttcgcaagctttagctcagggtatgtgtgcatatttaacatttgtgttgttatctactaatgattaagaaaatcttgggctattcattagcccttgctattttattgatagcattatattacggaataatgttcggattaattcaagtcgtgcttttcatttctgatgttattatggcactacattcactagtatggtaaatttatgcaactgaataatcgtgatttaaaaagtatcattgataatgaagcattggcttatgctatgtacacggttgaaaatcgtgccattccaaatatgattgacggatttaagccagttcaacgatttgttattgctcgagctcttgatttggcacgaggaaataaagataagtttcacaaactcgcttctatcgcaggcggtgtagcggaccttggatatcatcatggtgaaaactctgcgcaagacgcaggtgctttgatggctaacacttggaataataactttcctctgttagacggtcaaggaaactttggttctcgtactgtccaaaaggcagcagcaagtcgttatatttttgctcgtgtaagtaaaaatttctataacgtatataaagatactgaatatgctccagtacatcaagataaagaacacattccgcctgctttctatttgcctattattcctactgttcttcttaatggcgtttccggtattgcaactggttatgcaacttacattcttcctcatagtgtttcttctgtcaagaaagctgtactgcaagctcttcaaggaaagaaagtaactaaaccgaaggtagaattcccagaatttcgtggtgaagtcgttgaaattgatgggcaatatgaaattcgtggaacatataagtttacttcacgaactcaaatgcatatcactgagattccatataagtatgatcgtgaaacttatgtgagtaaaatcttagacccgcttgaagataaaggcttcattacatgggatgatgcttgtggtgagcatggctttggcttcaaagttaaattccgaaaagaatactctttgagcgataatgaagaagaacgccatgcaaaaattatgaaagacttcgggttgattgagcgtcgttcccagaatattaccgtcattaatgagaaaggaaagctgcaagtttacgataatgtagttgatttaatcaaagacttcgttgaagttcgtaaaacttatgtccaaaaacgaattgataacaaaatcaaagaaactgaatcagcatttcgtttagcttttgccaaggcacatttcattaagaaagtaatttcaggtgaaattgttgtacaaggtaaaactcgcaaagaactgaccgaagaactttctaaaattgatatgtattcttcttatgttgataaactagttggaatgaacatttttcatatgacttccgacgaagcaaagaaacttgctgaagaagctaaagccaaaaaagaagaaaacgaatattggaaaactactgatgtagttacagaatacaccaaagatttagaggaaatcaaatgagtccattcattggtatcacaagcgctgcattagtatctggtggcattttactggcgggtttaggtgttgttcctgccgtagcaggaggtcttcttgcgttcggaattcaacgtgttatcatgacagttatcacagtcatgcagtaattttagggagagcctcggctctccctttttatttcaaaaattttttcacaaaacggtttacaaccaaagcatactgtggtactatacaactatcaaataaatgaactgaaacaaacaacccggagatacaaaaaatgaaatttaaaatcgaaaacgaaatcgttaaagctaaaaatgctctgactgctaacaaactggttgtagatggtattgaatatgatatctgtggagttcgtgaagaaaaacctggtgttctgactttcttcacaatgatttttaaatttaaaggtgacacagaattcaaacagtttgattttgcccatgaagacgaaatcgaagttcgtaatctgaacattaagtaagtactttattagagctcttgaaaaagagtgcaaaaaagtgtttacttctgctttaaacatgatactatagacctatcaaataaatgaactgaaacggagattaaaatgtctaaagtaacttacatcatcaaagcttctaacgatgttctgaatgaaaaaactgctgcgattttaattaccattgctaagaaagatttcattacagccgcagaagttcgtgaggtgcatccagatttaggtaacgcagtagttaatagtaatattggggtattgattaaaaaaggcctggtggagaaatctggtgatggattaatcattactggtgaagctcaagatattatttcaaacgcagcaactttatacgcgcaggaaaatgctccggaactactgaaaaaacgtgctactcgtaaagctcgtgagattacttctgatatggaagaagataaagacctcatgttaaaacttttagatgaaaatggatttgttcttaaaaaggttgaaacttatcgtagtaattatcttgccattttagaaaaacgcactcacggaattcgtaattttgaaattaacaataatggaaatatgcgaatttttggatacaaaatgatggaacatcatattcagaaatttactgatatcggaatgtcatgtaaaatcgctaaaaacggtaatgtgtatcttgacattaaacgctcggcagaaaacattgaagctgtaatcactgtagcatctgaactgtgaggaataaataatgaacaagttagaaattgtcaatgaacttcgtcgttgtgtagaacctactcaagagggttgggacatctggtaccatggagcttatcttggaactatcgtaaagattaagactggtaaatacatgattattcgtgaaagtaaagatgctccagtaggtattcgcaataattttatggcagcgataagttcatttacagatgcagcttacgaaatttaccttgccgattataaagaattccaggaatctcaaccggttattcgttcaattggtgttaacaaagctcagcagaaaactttgtggcagcgtattaaaggatggtttaaatgaacccatttattaatcgtttaaaaatgctgaatgttcctttatctcgtgaaactccagaaagtcttgttgaaaaatttaaagcgcatggttataaatgcacagaagaagatattctgaaagaagttcctgaaatctgttggcagactgcgtactgggatgaaaaccaaaagtatcaacgacgaattgtctgcgcagctaatcgttttaaattaaaagatggacgaactcttattattccaggtgctcgtcattattctaaagatatggcagaagttttagatgtagttaaacctcaattagttactcaacaagtttgtgatgatgaccaaggatttattgaccaatatagtaattattggacacgtgaagaagcaatgattattgcaacttacgccggacaagtacgtattgaacgtggtggtagtgaaaaagaactttactctgaggacctttactaatgaatattaaaaagtttcaaattgatggaattacgaatcaaattaaggcattggaatatgccaataaaatgatgtcaactaattggggaatttatgcgaatgagccagcatttaaattttgtgatatggaatttaccaaaaagcttgtaggaaaagatcatgtatgcccatttagttctccggtaaatggaatgctaaaacctgctttacgcgatctttatattgcgatgaacgaagaaatgataaaagagctaaaacgtcaactgaaggtgattcaatttggccagggaaattaattcaaaatcagattattttaactctctcaatgataaagataaaaatctaatacggcattttattgttgagatgggatataccgatacacacgatttaagagaacatatatttgaatgtggtgtagctaaaaagttttcattcacgtgcaaatgtttaagagaggtaattcaacactatgaacaatttagtcgcaaaacataattttaataaagcttctgtccataaagataagaagaaagcgtttaaagaatctaatcgcaaacagaaacataaggggaaggtctatgattattgattctcaatctgtagttcaatatacaatcaaaattgatattctagaaaagctatataagtttctaccaaatttataccactcaattgttaatgaattagttgaagaactgcatcttgggaataatgatttcttgattggaacttataaagacctctcaaaagcaggatatttttacataattccagctccaggaaaaagtattgatgatgtattaaaaactataatgatttatgtccatgattatgaaattgaagattatttcgaatgagtcataatcttgaaaaagtaatcgagcataatgtagctcaggaacgtaagtcgttcaaggaattcgtagaaaaaatttttgaagaaaataccacagaccagtttacaaatcaagcgtctgatgatattataacaaagtcaactaattgagtggtatagttaatgaataaaaatattgatacagttcgtgaaattattactgttgcgtctattttgattaaattttccagagaagatattgttgagaatcgcgctaattttattgcatttctgaatgagattggagtaacgcatgaaggtagaaagttaaatcagaattcattccgtaaaattgtttctgaattaactcaagaagataagaaaaccctcatcgacgaattcaacgagggttttgagggtgtatatcgatatctagagatgtatacgaacaaataattatttagcccttcctaatattctggccgcctgagcacatattgattcaaggcggtcattacttatatgatcatttctataccagtacatggttattgttccagcatagatattatccaaattaaaatatggacaactgtacatgtagtttatttcgggagtaggctttttagttggtaaaaaagcaaattttgagtcggaataataatgacgtccatttaaatgaactgtatattcatccatagttttatcaacaggatatcctccaagtgatttttcacttattgttgaaggtaattttccttcatatgctataatatcaacaaaatagtttaagtttttagggcggaaagaatacaccgcactaaagtctgcctcagatgatatatgaactatctggagttgttccagggcgacagattcaaagcgtgcatttctttccttttcaataatttcactgtatgtttcatactttgattgcttatagtactcaaagaaactatctcccctataccaaacaatcgccatcataaataaaagaattacgacagctacccgggaagcaagaactttcccggtagcgttatctttgaacaagcgatctagaacaccaaacagaatatcagagggcgaaaatgatattctaggtgctgccatagaccctccttttaagggtatttattcacattatactcttggaccatatattgctccaacattttgccatgttggagcggaccctatgacagcataaccagcagcgccgccattatattcagatccttgaccgcgaatattgcatctacctcccgcggaacctacttcaccaccgtttccaccattatagataccattcacggatcctgagccaggtgcagaaatagtaccgccagtcgcgcctgattgcatatcaatagatcctcctggcgcaccaaaaggacgaccgccaccaccaccaaaggtcaatctcatttgtgaaaaaggagaataatatccgccgccgccaccgccgccaccgcctgcaatagctccgccattattaattcttagtctcccaccaatatcgttttgaatacaatgacctccagctgagccaggactattgctaccgccattacctccacgaccatacatcgttacgccatgtatatttaactgaacatattcatttggtgtatctccgtacatgaagaataaaggaacatctttagaataagaaacgatatcaccaacaatattgaatacaataggtgcaccgccagcttcaaagcatctatcacggaaccactgaccattaaaattgtggtttgctcctacagtatgaataatttctcgtgagcgacctgcaaattgactcatccagcaaggaacacccaatcttaattgaccagctgcttgactcatccagcgctgtcctgtttcatttgcggctgaacttccaatccaaccaggaacaccaactactgccataatttatactccaaagggggcatttcccccttgttgttagaatttaaaatatttactaattttgcgagcaattttagtaaagagaggcgttttcaattctttaatttcttcactcatttcctgaatagccttaattaaaagagcattcacagcagagttagaaattgtcagaacatcagatccatcaacttcaactttagatacagcttccggtaattccttttcaaggtcctgagcaataataccaacttcacgtttaataacactacggtctttaatagacttaactttatcgtaaatataaactttcagtcggcaaactttttcgactgctccatattctaattcttctttattaatcttgagacgggagtcagaacgaatatacacatcgctaaagctaccatttcctggtgtataaaagaatccatcatgatggaattcaaacacagcttgtgggtgtccagcatcaggagaagcctccgtggatccgacacgaatgattgcttgcccccactgtgatggaatacgacgcataccaaagtcaacagcggtgctatatccttgattggttataacgcttcttgctttaagaataggataataactatcttgaccaacataaccatgatcaacgaataatggagcttctactcgccattggttgccccaatcacccggttgtctagcaatccatccagaaccgttaatgtgtacacggtcacggttaacgttaaccattgcggtattttgcgggtttaacgcaatctcaccattgtttgtgatatgtactgccgcctgagaagcatagctataaaatgctagcgaattatcagcaccacccttgccaatataccagttaccagtcccgtctatgtcaccgcgaatatgcaaagaattactagcagttgttgataatacaatagaatcattaggtgcattgattgttaaccgacctgtcatcgtatcaccgcctttacctaggcgagtattcaaggcagcatctaaattggttgcatcgttgtatttcttccagattgaaccagcaatgttaccatcagtgttcaagaatgctgcgccagcataaactcggctttgtgacatgaatcggccagacggcaagaaacgccatgtagctaattcagtggctgtagttccagtagcggataaatcaccctgagcaacgatacgatattctgaactagcaatatccataccagaagccatagtaatatttgttacagtgtttttctgtttaacaattggcgcaaactggtttttatttgaatcgtcaatagcctgatataatggcgcaatggtagtattctgatttgcgtaagtattagaaccagaaccgctagcaggggcttgaatatatgctcctggagcaagtgaaattttctgattagcaccaagattaacagcagcagtgatattcagcaatcccctaaagttttgttgagcagtccaagtatgtgatccgtcttcaagaacaacacgacgacaagtattagtcctacttcctggattaccagcgatacgaacaacgaaataacgatagttcgcctgagatacagtaccgcgccacacttgaacagttcgacccgttccggtatgttcgctaggaccgacagaaaacataaccaggtttccatcaatcgtgccccaatccatatttgctggcatattctttattttgttcaaaggaacactaaacatactaccagggacaaaatcaaaggtttgccaatctaactccgctaattgagctttaataccacccatacccaaagtaattggcagagaataagatgtatatacttcgttccatgcaccccacgcaccaccagtatatgcacgctcaaaaatacgatcgcgagtagttgcacccgttcctgcggtagtgaaacgttggaaaatagcaccgccagaagcacgctgtttaacttccagcaaaccaacaataacagtcggcaaaccttcacctgtaggacagttaataacggcatcagtgcctaaaatattatataacccgggagttttaaaatcattcagatctccatcatagaaagtcgctggtgtgccatgaccaacctgcttccattcctcccacttaggtgcactagcatcccatgcagcagcgagacaacgagtataaaccatacccatgcgggtagtataacgctgagttctcgtgtataaaccaccttcaaatatttctaaaaatccttgtgcggctgatccttcttctggataatggcgatcaaatgatgcgattgcgcttgaactgtttcgccataagccacaatgttctaattctcccaagctatcaaggtcaatcgtttgtgaaagtggacgagttgacgcttgaacattacgccacacaccccatggaccatcgacgccattccatttagcagataaggaacgaatatagacgttaccagatcttacagtataacgctgagtgccagcaaattggccggccacaaacacttctagtacacctacggcattttcttctgggaatttatttgctggttgcgcatttgttgaagtagatttcgaccaaacaccaagatattcttcaatgggcccatacgtatctaaattagcatcagtaggtaattcgccattattttttataaatgttgtgctattgacatttatgtcagatggagttaaggtaatgtcctttgacccatcaaaagatataccattaattttcctaggtgtttgcaatttagtagctgtgctagaatttccaattaaagttccagttatattttctgtaacctctaaagacccatttatagttcctccatattttaaacctaattctataacactacctgagtcatcttttgtgaaaattgttttatcttttaagtttatagccaattcaccttcggctaatactgaagcagcaggacgttgacctgcagttttgcttcttttaaattgtatttgttttaaagtagccataagtcctcttaataatagccgaaatcttgaacagaatccttaattacgatttggtcaaatcgtggaacgtgtgaaggttgagatgcaggattctgtgaaaaaaggtttggcgcagttaaatttcctgtcatagtgtctccagagcgtaataccctagagtttgcatttgctgtaacagtatttattgctccatcaacataatctttgcgagtaacatcagatgctgcggaaggagtagatgtaacagttaccgatggagccgttacagccctggtaaatgttgtcaaaccttctggcgtaatagtaatttgtccagtagtgatttcactacctgcaggtctaaaactaataccaccggaagagccgccaactacaagagtattaccagtgccgccaccagaacgaattcggataggggtttcattattacttaattgaagataactatttaccccgtaattaatagtaattggaccggcgtaagtaccaccattagctttagaaacgaaatcgttatcagctgcctgcggtttattatattctgaatatattttaaatgatttgtagagtacatcgtcaccggctgaattcaatggaaaatttccttgatgccaaatgacagatccacccacagttgaacctacttttaaatcagccattatatgcccctttattttaatattatttataaagaaaaagggaacccgaaggctccctcagtttaaacttctctaaattcctgtccaaacactttgccagttttagaagaggcttgtgtaggaagtaccattatatctggaggtgaagccgattcacagacataattaacgcgaataccgttgacgccaaattcggcaggttttgaaatgccgccatttcttgatacttcagaaaaacttaaatttctcatgccgccttgacctgcttgagcagttctttgtgcatatatcgtaaatcctacggcgttttctggaacaactacatagtcttcttttaattcccaagacccagcttgcccagtaaactcagcttgggtcgaggaaatatatccatttgatgcatcataaaaacgaatggatatgtttgtagttccaagatcaagtaaatcagcatcagcatataactgtgctttaagataaagaacatcaccaggaattaaattatagtcagaaagtttacttatagcagctgaagttggcaatcgcgcaatttcgttattagttccaccaactgctgacatgaattgctctacactttcataagttctttttggaaatcctgtcgctccgacgtcttctaaactatcaaatacaacatctaaaatagtttgataatcatctgtgctttttctattacttagtttaacatgctctaatgcaatagctcttttagaagaagtataaaaagcagcatatgatacgtcaaatcttgacaatactgaatctgatggaaaaactgaagttcctgctccccttaaccaagataccacttcaggaggaaaattaacctttccgctagttaatatagcaacaagtctattgtttgacaaagaattcatgaaactgacaaaagcggcagatgttgtattgtttgaagcagaaaaagcatatgacttgctatcaactaatgctcccgtagaagggtcaaaaactcttaaatgaagacctgcactaaatgtttgatttccaacgggattatcctgaaatttaacatatggccccgcagtagaaagcgggcaagaacccgctatgcttattttgtatcttactgaattactttccgataaaaatggcgtttggacgtatccttgtccaaactctgccataaatttttccataatacctcttattcaacccattcaaatttaacagttttattcactgggtcaggaataatgcgaacattaccaattcgtaagaaatcacgaatagtaagattacctattattccattatcagatgggattgctcctatatccgaaggttgaggagggttacctccatcaaatacctgaacaaaacttgaccaagaatttttagttttctgccatgtacgcgtccagcgagtggtacgtgcttctggggtcgttggataagtaatccaatcttggtaaagcgaatcaagtgtgttaccaaactgagtcaatgtaccaggagatttaacttcttcgccacgttctaagtatggaagcccagtcacttcattagttttttcaaccattttaaaataacccgggaactggttataagtggctgaatcgttaatatcaattgaccagaatcctacagtatcagatgttggagcgcgggtgtataaatcagatgttttagtgccctgagaacgaattctcgagttaacagtcaaaccgcctgaatttatagtagcacctttggcaatgattaagctttcaccaatcgttacttggccagatgcattattaatagctaaaggacgtaatccattaaatccaccagtctgatcacccgatgcagtaagcataaaattcgttactgatccatcattgcgaacaatgaaaccataatttccgttaatagcacggaaagcatttgcgcttcgagaaataatttcaccagttgcagtgactgaattaccaaatgttgctacaccatttgcattcaatgttcctgaagcattaacatttatcggtgttactgtaccgttgatattaaatgttatatttccagctttattacgctgagaataaaaatgactagacgtttcatcactaacttcaaatacggtagaacgtgttgtgtctgattccccgctaaattgatttccccacactctgactgtcatcgtttgagccgggtttgttccagtttgaggtcctttctcaaaaatcagacgagttgccgttccagtattagaaatagttaatgtactatttgctgaaactgatccaccgaatgtagcagtactagatgatacaagaggggcacccagattcgtttgttgggttaaggttagtgaaccattaactgtttgtgcaatgtccctacgaatgaactggagcgaatctagaccatctaataaattactatctacagcttttgcttttaatggcaaataatttgctaatacgcgatttaattcatatggtgatactgcataaccatttttctcatatgattctaatggctgtgttgaacctaccgtatcattaccaacaaacgttaatgaaccagaagaagttttaacaaaccctcttatcagagtagttgctgcccaagttggttcactctgcacaatccattttaaattttttggagatacagcagtatttgctgacgttccagtcacagtttcagactgagttgcaactttaataacaccttcttgcgattcggtagatttagtacctaaaagctttttaggagttattaaaacattatctaatgttcctgcagcagcttcaacttgtgtagctacacgaagtgtaccacgctgtgtctcatttgcttcaagaatattaagggtataatggtcccagagagttcctgattcaactaatccagatagagcaacaacagaagtacgatcagtactattaaatctggttttaatttttaatggtgtagagatacgagtatcgtcgacgcctgcgtcgaattcaacttgcgtagcaatttcagctataccacttaaactttcagttgctctacggtcatttaaagttttaggagtgactgcgcgagtataatcagttcctgtattaacttcgctttgcgtagcaatttcaattaaaccaattcttccatcagttgatgtctttttatgtaacgtttctggtgttacaaccgcatttgcccatccttcttggctttgtccagcaattacttcactttcaactgctaaaattactgcgccttgttgcgttggagtagctttatactgatccaaagctttaggtgaaacaactaaattattagtgtttttattataaacattcgtaccatttaattcacgactagaagctggagtagctcctgcggtagatacaaaagttacaataccagataatgattcagaaccttgacgagcttgaagctttttaggagtgatgattgtagtatcatcagtacctgtattagtttcctgctgcgtagcaatttcagcgacacctctacgagtttctgtagcagttctttcattcagctttttaggagtgatgataaggtcatctgcaaaagagaatgtggtgttctgatttacttgagcagtagttgctattcttgcaatacctctgcgagtttcagtagcagtacgattagctaacgtttctggagtaattgccaattctttttgcggagaattttctaaatcagcatttgcttgagcttgtgtagctaaagcaattacgcctaatcttgctctagtagaagcatttaaagagtctactctttctacagttggaacgttttgctgtacaacccagtattttccatcagaatcttctatataagcaagttgtaaaactggaacataattagtttcaccgttaaaaactaattcttgaactgttacccattcagcttcaggcggatattctgaacgttttgggaattgcagcaattgaactgaagaagcaattttatcttcaccagcagctttgattttaactgtttgtccttttctcatgtaattcatggaaattttaacagtatcaccaacagaaatatcagtcggaagctgaagttcaattgtttgggttgttccattattcgcgccaaataccatgacttcttcatttggacgaatatttgaattagttgttataatgcgtaaacgtgctttactatccccgtcaaacaatctccacaatttctcattatcgtcaaacatcaagaaaccgtcaatcgatgtacggccttcaatggaatgagttccaacttcttgtactgaagtcgtttcatcgtatgtagtaacaattgtatgataaagtggattcagtttatctaaatcaacgaaattaataatatcgccatgattagcaaatctcggaagtttaacattaattggtgcagcagaagtaaatctacgtacgataaaatcattagattgtgcttgatacgcagtcgatggagtaacaatcgcagcttctctgctataatcagcaacatacatttgccacaaacgattattaaaaatgaatatcatctgtgactttggatgagtcattaaaactgaacgtacttgttcacctctaaaattgacaatactctgatttgaagaatttattttaacctgatttatgccaggttttccaccgatatcttgaattattacggtttctccatcaagcggagaaggtggtaaagtaaactcaatgtcattgccaactgatgtatctactgaaattgcttctccggattttaattgatatggtccagatgatacagttgtatatacagcatcagtacgtaatgctttccaacgaattctattaaaatttccagcaggttttggaatattatccgttgctgcccaaaaacgattattataaatgattacaaaatcttttaaatatccacgagttggatcatattgctgaactgtgttttcttgaattaagtaatcaacgttaacaccgtcagttcctacggtacgatcagctaaagctacgttgattattttatcgccacctgcgtccagaccatcttctgctctgaactttcttttaatctcggccattctcccgggctcctattgtgttttcaataataagtatttatacctgtttactttaagatttagatagtatataatagaaatctcactaattgaacgaggttcatatggatttagaaatgatgctggatgaagattacaaagaaggaatttgctttattgactttagtcaaattgctctttcaactgctctggtaaacttcccagataaagaaaaaattaatttatcgatggttcgtcatttgatattgaactcaattaagtttaatgtcaaaaaagcaaaaacgcttggatacactaaaattgtgctgtgtattgataacgcgaaatctggatactggcgtcgtgattttgcttactattacaagaaaaaccgtggaaaagcacgagaagaatctacttgggactgggaaggttattttgaatccagtcataaagttatagatgaattgaaagcttatatgccatacattgttatggatattgataagtatgaagcagatgaccacattgctgttcttgttaaaaagttctctttagaaggacataagattttaatcatttcatcggacggtgactttacacagcttcacaaatatccaaatgttaagcaatggtcaccgatgcataagaaatgggttaaaattaaaagcggttctgctgaaattgactgtatgactaaaatccttaaaggcgacaaaaaggataacgttgcttcagttaaagtacgatctgacttttggtttaccagagttgaaggtgaacgaaccccttcaatgaaaacttcaatcgttgaagctattgctaatgaccgtgagcaagctaaggtgcttctcacagaatctgaatataatcgttataaagaaaatttagttctaattgattttgattatattcctgataatattgcttcaaacattgtgaattactataattcatataaattaccaccgcgtggcaaaatttattcatattttgtaaaagcgggtctttctaaattaactaatagcattaatgaattttgaggtgaataatggctaaaaaagaaatggttgaatttgatgaagctatccatggcgaagacttggctaaatttattaaagaagcatctgatcataaactgaaaatttccggttataatgaactgattaaagatattcgaattcgtgctaaagatgaacttggcgttgatggtaagatgtttaatcgtctattagctttgtatcataaagataaccgtgatgtgtttgaagctgaaactgaagaggtagttgaactttatgacacagttttctctaaatgatattcgcccggtcgatgagaccggtctttcagaaaaagaactttcaattaagaaagaaaaggatgaaattgcaaagcttcttgaccgccaagaaaatggatttattattgaaaaaatggtagaagaatttggaatgagttatcttgaagctacgacagcattcttggaagaaaactctattcctgaaactcaatttgctaaatttattccttcgggtataattgaaaaaattcagtcagaagccattgacgaaaatcttttacgtccttctgttgttcgttgtgaaaaaactaatacattagattttctgctatgattaaactccgcatgcctgctggtggtgaaagatacattgatggtaaatcagtttataaattatacttaatgataaaacagcatatgaatggaaagtatgatgtaattaagtataattggtgcatgcgggtgtctgatgccgcttatcaaaagcgaagggataagtattttttccagaagttatcagaaaaatataaattaaaggaacttgctttaatttttataagtaatttggttgctaaccaagatgcttggattggtgacatctctgacgctgatgcacttgtgttttatcgtgaatatatcggacgcttaaagcaaattaaatttaagtttgaagaagatattcgcaatatttactattttagtaaaaaagttgaagtttctgcttttaaagaaatctttgagtataatccaaaagttcaatcaagttatatttttaaactacttcaatcgaatataatttcgtttgaaacgtttatcttgcttgattcgtttttaaatataattgataaacatgatgaacagactgataatttagtctggaataattattctataaagttaaaggcttatagaaaaattttaaatattgattcacagaaagctaaaaatgttttcattgaaactgtgaaatcttgcaagtattaattgcttattataaataagattataattatctcactgaccagctatgaggtcatacatcgtcatagcaccaactgttaattaaattaaaaaggaaataaaaatgtttaaacgtaaatctactgctgaactcgctgcgcaaatggctaaactggctggaaataaaggtggtttttcttctgaagataaaggcgagtggaaactgaaactcgacaatgcgggtaacggccaagcagtaattcgttttcttccgtctaaaaatgatgaacaagcaccattcgcacttcttgtaaatcacggtttcaagaaaaatggtaaatggtatatcgaaacatgctcatctacctacggtgattacgattcttgtccagtatgtcagtacatcagtaaaaatgatttgtacaacactgacaataaagagtacagtcttgttaaacgtaaaacttcttactgggctaacattcttgttgtaaaagacccagctgctccagaaaacgaaggtaaagtatttaaatatcgtttcggtaagaaaatctgggataaaatcaatgcaatgattgcagttgatgttgaaatgggtgaaactccggttgatgtaacttgtccgtgggaaggtgctaactttgtactgaaagttaaacaagtttctggttttagtaactacgacgaatctaaattcctgaatcaatctgcgattccaaacattgacgatgaatctttccagaaagaactgttcgaacaaatggttgacctttctgaaatgacttctaaagataaattcaaatcatttgaagaactgagcactaagttcagtcaagttatgggaactgctgcaatgggtggtgccgctgcaactgccgctaagaaagctgataaagttgctgatgatttggatgcattcaatgttgatgacttcaaaacaaaaactgaagatgattttatgagctcaagctctggcagttcatctagtgctgatgacacggatctagatgaccttttgaatgacctttaacagattatattactaattaattggggaccctagaggtcccctttttatttcaaaaattttttcacaaaactgtttacatccttgtccttccatggtactatacaactatcggcaatactgctgataattaaagaggaaaataatatggctaaagttgatattgacatcgttgattttgaatatattgaagaaattattcgtaatcgttatcctgaacttagtatcacaagtattcacgatgatcccaattattgcaatttttctattgtcattgaaggtcctcttgaagacctcacccgctttatggctaatgaatattgtgatggtatggattctgaagacgcagaattttacatgggattgattgaacaataattatcaaggggctattacaagccccgttaaaatgaggaaaacgtaatgtatattggcaaaaagtatgagcttgttccaagacttattgatacatttattaattatcgcccacgttctaattcatcgatagttaaaattattcaagaaaatggtggatggtttgaagttaaagaagctttctttgttgatggatttagagtaataaaacacattgaatgcgcaaatggaaagcatttttactttaacgtttgtgaagacgaatttcattgttttcgtgagtataaagaaccgacttctgaagaagatggagccgaagacatagtttctggcgtaacaaaaattcactgcattgttgacgaaaataatgtagatgaaatcattgaacttttgcgaaaaactttcaaaaagtagtttacaacagggtagtagtgtgatactattaccctatcaaaactaatggagaaaagaaaatgttcgcaccttatattatggcagcagttatgttggtctgtttatatcttttgattaaagcttgctaaggagaataaaatgagattacaacgccagagcatcaaagattcagaagttagaggtaaatggtattttaatatcatcggtaaagattctgaacttgttgaaaaagctgaacatcttttacgtgacatgggatgggaagatgaatgtgatggatgtcctctttatgaagacggagaaagcgcaggattctggatttatcattctgatgttgatcagtttaaagctgattggaaaattgtgaaaaagtctgtttgaggaaaataatatgtctggcattcatgtaactggaattgctcaagtaaacatccgctgccaatttaaaactgtacctggggtgactcatattactttatcacacgacccatattctcgtggaagacagttaactggcgtaattaagtttttcggcggaattggcggaagcgaatttactataggagatgacgaaattgttggctgtaaattaaaagttcagaagggcgtgttagaactttttagtgatgaagtttttgatgaaatctcacgagcagttaacaaaggaatgttaacgttaattaaaatgattaaagctagcggatatgttactgatcctttttaataggaggcaatatgatttttgtatttgaatttatgaatgatgaattcgattatgcaatttttaacgcattgcataatcctgatttaagtgaatttaatgaaatgttttctgacgctttgagtatgtcagaagaatactgtggagaatgtcaacgtgtttgtgtgacagtctttgaaaacaaagaaaagacctatgaagaattattctttgatgctaataaagccactgaatggtttgttgaaagaggttttgcgtaatgattaaattggtattcgcttattctccaactaaaacggtcgaaggctttaatgaattagcattcggtttaggtgatggtttaccatggggacgaattaaaaaggacctccagaattttaaagctcgtacagaaggtacaattttgattatgggtgctaaaacgttccagtcattatctacattacttcccggtcgtagccatattgtggtgtgtgaccttgcgcgtgattatcctgtaactaaagacggcgatttagcacatttctatattacttgggaacagtacataacttacatttctggcggcgaaattcaagtttcaagtcctaatgcaccattcgagactatgcttggtcagaattccaaagtaagtgtaattggcgggcctgctctgttatatgctgcgttaccttatgcggatgaagtagttgtttctcgcatcgttaaaaggcatcgtgttaattcaacggttcaattagacgcaagttttcttgatgatataagcaagcgtgaaatggttgaaacgcattggtataaaatagatgaagtaacaacccttacggaatcagtatataaatgagcaataaattaaaagttaaggatgttcctaatgctatggccctttttatttgtaggcagatgcatcaagggcctatgacaccaaaacaatatcttaaaggtgagcgttctttaggatttactcgcaaagcaaaacaaatggttaaattaggatataagcctaactttgccaaatatccttctacatattcttggatgaactaatgaaacaataccaatttttaattaaagatatcctggaaaatggctacgaaaccgatgaccgaacaggcacaggaacaattgctttgttcggtactaaattacgctgggatttaactaaaggttttcctgcagtaacaactaagaagctcgcctggaatgcatgtatttctgagttattgtggttcttatcaggaagtactaacgtaaatgatttgcgattaattcaacataattcattaattcaaggcaaaacagtttgggatgaaaattacgaaaatcaagcaaaagatttaggataccatagcggtgaacttggtccaatttatggaaaacagtggcgtgattttggtggtgtagaccaaattatagaagttattgatcgtattaaaaaattgccaaatgataggcgtcaaattgtttcagcatggaatccagctgaactcaagcagatggcattaccgccttgtcatatgttctatcagtttaatgtgcgtaatggctatttggatttgcagtggtatcaacgatcagtagatgttttcttgggttaattgaggcctgagtataaggtgacttatacttgtaatctatctaaacggggaacctctctagtagacaatcccgtgctaaattgtaggactgccctttaataaatacttctatatttaaagaggtatttatgaaaagcggaatttatcagattaaaaatactttaaacaataaagtatatgtaggaagtgctaaagattttgaaaagagatggaagaggcattttaaagatttagaaaaaggatgccattcttctataaagcttcagaggtcttttaacaaacatggtaatgtgtttgaatgttctattttggaagaaattccatatgagaaagatttgattattgaacgagaaaatttttggattaaagagcttaattctaaaattaatggatacaatattgctgatgcaacgtttggtgatacatgttctacgcatccattaaaagaagaaattattaagaaacgttctgaaactgttaaagctaagatgcttaaacttggacctgatggtcggaaagctctttacagtaaacccggaagtaaaaacgggcgttggaatccagaaacccataagttttgtaagtgcggtgttcgcatacaaacttctgcttatacttgtagtaaatgcagaaatcgttcaggtgaaaataattcattctttaatcataagcattcagacataactaaatctaaaatatcagaaaagatgaaaggtaaaaagcctagtaatattaaaaagatttcatgtgatggggttatttttgattgtgcagcagatgcagctagacattttaaaatttcgtctggattagttacttatcgtgtaaaatctgataaatggaattggttctacataaatgcctaacgactatccctttggggagtagggtcaagtgactcgaaacgatagacaacttgctttaacaagttggagatatagtctgctctgcatggtgacatgtagctggatataattccggggtaagattaacgaccttatctgaacataatgctaccgtttaatattgcatcatatgctacgttagttcatattgtagctaagatgtgtaatcttatcccaggagatttgatattttctggtggtaatactcatatctatatgaatcacgtagaacaatgtaaagaaattttgcgtcgtgaacctaaagagctttgtgaactggtaataggcggattgccttataaattccgctatctttctactaaagaacaattggaatacattcttaaactcaggcctaaagatttcgttctcaaagattatcagtcccacggcgtcttgaaaggaaaaatggcggtgtaatttcaatttaattgcgaggatatatgattttacgatttaaagatacttctggtgcagttctttttacacttcctaatccaagtgagctagaagttccaggaccaaatcagcctattatcatttatggcaaaaaatattatactcataaaatgactcgtgagtattttgataataaaatttctacagttaaaacttcttctgattgttactatgatattactgttttaacggaaaaacaatatgacgaattatcaccgcgcgggccgtctatgccaggtagtgaataaatataaatccgactttgatgtcaatattcaccgcggtacattttggggaaattacgtcggtaaagatgctggcagccgggaggctgccattgaattattcaaaaaagattttatacgtcgaattaaatccggagaaataactaaagcacatttagagcctttacgtggaatgaggctaggatgcacatgtaaaccaaagccgtgtcatggtgatataatagctcatatagttaaccgattgtttaaagacgattttcaagttgaggacttatgcaattaattaatgttatcaaaagtagtggtgtttctcagagctttgacccacaaaaaattattaaagttttatcttgggcagctgaaggaacatcagtagatccttatgaattatatgaaaatattaaatcatatctccgtgatggaatgacaactgatgatattcagactattgtcattaaggccgctgcgaattctatttcggttgaagaacctgattatcaatatgtagctgcacgttgtttaatgtttgctcttcgtaagcatgtttacgggcagtatgaaccgcgttcatttattgaccatatttcttactgtgtaaatgaaggtaaatatgaccctgaattgttgtcaaaatattcagcagaagaaattacatttttagaatcaaaaattaagcacgagcgggatatggaatttacttattccggggcgatgcaattaaaagaaaaatatctcgttaaagataaaaccactggtcaaatttatgaaactccgcagtttgcatttatgactattggaatggcattgcatcaagatgaacctgttgatagattaaaacatgttattcgtttttatgaagcagtatctactcgacagatttcattaccaactcctattatggctggttgtcgtactccgactcgacagtttagttcatgtgttgttattgaggcaggtgattcgctgaagtctatcaataaggcttccgcttcgattgttgaatatatctctaaacgcgctggaattggtattaacgttggtatgattcgtgccgaaggttctaagattggcatgggtgaagtacgccatactggtgttattcctttttggaaacattttcagactgcagttaaatcatgttcacagggtggaattcgtggcggcgctgctactgcttattatcctatttggcatttggaagttgaaaatcttctcgttttgaaaaataacaaaggcgtagaagaaaaccgcattcgtcatatggattatggtgttcaactgaatgatttgatgatggaacgattcggaaagaacgattacattactttgttcagtccgcatgaaatgggtggagagctttattattcttattttaaagaccaagaccgtttccgtgaattatacgaagcagcagaaaaagaccctaatattcgtaaaaagcgtattaaagcccgtgaactatttgaattgctcatgactgaacgttcaggaacagcaagaatttatgtacagttcattgataatacgaataactatactccgtttattcgtgaaaaggcacctattcgtcagagtaacttgtgctgtgaaattgctattccaacaaatgatgtgaatagtcctgatgctgaaattggattgtgtactctctctgcattcgtactagataattttgactggcaagaccaagataaaattaatgaattggcagaagttcaagttcgtgctcttgataatcttttggattaccaaggatatccagttcctgaagcagaaaaagctaaaaagcgtcgtaacctcggtgtaggtgttaccaactatgcagcttggctggcaagtaactttgcttcttatgaagatgctaacgatttaacacatgaactatttgagagattacagtatggactcattaaagcatccattaagctcgccaaagaaaaaggaccttgcgaatattattcagacactcgttggtctcgaggcgaattacctatcgactggtacaataaaaagattgaccaaatcgcagctccaaaatacgtttgtgactggtcgtcgctgcgggaagaccttaagctctttggcatccgtaatagcacactatcagcacttatgccatgtgagtcatcttcccaagtttctaacagtacaaacggtatcgagcctccacgtggaccagtctctgttaaagaatcaaaagagggttcctttaatcaagtcgtgcccaatattgaacataacatagacctatatgattatacatggaaattagctaagaaaggtaataaaccttatcttacgcaagtagctattatgctgaaatgggtatgtcaatcagcttcagcgaatacatactatgacccgcagatttttccaaaaggaaaggttccaatgtcaataatgattgatgaccttttgtatttttggtattttggcggaaaaaatttctattatcataatacccgtgatggttctggtactgatgattatgaaatagaaactccaaaagctgaagattgttcatcctgtaaattatgatataatttgactcacggacgagtcaccaactattaactaagcggaaaatttatgagcacagtttttaatacaaatccagttgatgttttaaaagaacctatgttttttggttcaggtcttggtattgcgcgttatgatattcaacgccataaagtttttgaagatttgaccgaaaagcaattatcatttttctggcgtcctgaagaagtaaacttaatgatggatgctgcacagtttaataagcttcctcaatatcagcagaatatttttactaataatctgaagtatcaatcacttctagatagcattcagggtcgtgcaccgtctgctgtacttatgtcattgatttcagacccaagccttgatacatgggttgctacatggacttttagtgaaactattcacagtcgttcatatactcatatcatgcgaaatctttatactgatccatcgaaggtatttgatgaaattgtattagatgaagctattatgaaacgtgctgaatctattggacgttattatgatgatgttctgattaaaactcgttattgggaaaacgctaaagctgatatcgaataccaaaaagaaattaatgcagacgaagacgttattgaagatgctattgagcatgagacatattggaagcgtgagctaatgaaatctctttacctctgtttgcatgtaatcaacgcattggaagctattcgtttttatgtatcttttgcatgtacctttaacttccataagaacatggaaatcatggaaggtaatgccaagattatgaagttcattgcacgtgatgagcagcttcaccttaaaggcacccaatatattattcgtcaacttcaacttggcactgatggcgatgaatgggttaaaattgctcaagagtgtgaacaagaagcagttgatattttcatggaagttaaccgccaagaaaaagattgggcagttcatttatttaaagatggtgatgttcctggattaaatacaaatagcatgtggagctttattgattacttaactgtatctcgtatgaagcagtgtggtcttccatgcccaattaccgatgctccggttaaacatccatatccttggattcgtgaatatcttaattctgataatgttcaatctgcgccacaagaagtagaattgtcatcttaccttgttgcacagattgataatgatgttgatgataaagttatgatgagttttaaaaaatacttttaaggagtgggccgcaaggcccattttattatgaaagaaattgcaacagaatattcatttattaaatatactgagctagaattagactacaacggaagtataaaacaattatctattccaaacaagtataacgtaatttatgctattgctataaatgatgaacttgtttatattggaaaaactaaaaatttacgcaaaagaataaactattatagaactgctattaaccgtaaagacaaaacgtctgattctactaaatctgcattaattcatgctgcgctaaaggaaggaagcaaagttgaattttacgcccgccaatgttttaatctttctatgacaaatgagttaggtacaatgacaatcgcgacgattgacctagaggaaccactattcattaagctgtttaacccgccttggaatattcaacataagaaaaaatgatgcttccacatggagtgtggtactatattcaaaacacaaaagaggatacacaatgcaagaactttttaacaatttaatggaactatgcaaggattcacagcgtaagtttttttactcggatgatgtaagtgcgtctggaagaacttacagaattttctcatataattatgcatcttattctgattggttacttccagacgcattggaatgtcgtggaatcatgtttgaaatggatggagaaaaaccagtaagaattgcttctcgtcctatggaaaagttttttaacttgaatgaaaatccattcacgatgaatatcgatttaaatgatgttgattacattctaacaaaagaagatgggtctttggtatcaacttatttagacggtgatgaaattctgttcaaatcaaagggttcaatcaaatccgaacaggctttaatggctaatggtattttgatgaatattaatcaccatcggttgcgtgatagacttaaagaattagctgaagatggatttactgctaacttcgaattcgttgctccgacgaatagaatcgttcttgcttaccaagaaatgaaaattattttactgaatgttcgtgaaaacgaaacgggtgaatacatttcatatgatgatatttataaagatgctgctcttcgtccatatctagttgaacgatacgaaatcgatagccctaaatgggtagaagaagctaaaaatgcggaaaacatcgaaggctatgttgctgtgatgaaagatggttctcattttaaaattaagtctgactggtatgtgtctcttcatagcacaaaaagttcattagataatccagaaaaattgtttaagactattattgatggtgcatcagatgatcttaaagcaatgtatgctgacgatgaatattcatacagaaaaattgaagcatttgaaacgacttatctgaagtacttagaccgagctctgtttttagttcttgactgtcataataagcattgtggtaaggatagaaagacttatgcgatggaagcgcaaggtgttgctaaaggtgctggaatggatcacttgttcggtatcatcatgagcttataccaggggtatgatagtcaagagaaggttatgtgtgaaatcgaacagaattttttgaaaaattataaaaaatttatcccagaaggatactaagctgtttacaagtccctcgtgttgtgttacagtagtcttactgacataacatgaggactttatgatggatttgcagctcattactactgaaatggtcgttgaagcatacggtgatactacagatgggatttctgtatttaaaggaaaccgtcgagttggatatatcaccgatcttaagaaagatttagctaagcaagtcaagcggaaaacgaccattaaagaatatcgaaatcgtcgtcttgagcaagcccgtgatatgcttcctgatgcggttgaagagatgaaagtctttttagaaaatcagcttgcgaaatatgattgtgatgtatttattaatcagactcaacctaatgttcatatcaatagttgtaaatgctatatcatcgttaatcctttgactggaaagcatcgtcttggaattagtaatccaaatcgtagtgcatcggatatggcagaagatgttgaggcatgctttaaaatttctaaatctccagctgaacatcatattttaattaacggtctttctcaagacgatattatagaggttattaaaactttatgcatgtaagtaattttacagctggattgctattacttgtaatagcatttggcggaacatctattattttaaaaaataaggtagaaagattagaaacatcagttactgaaattacaaaaacagccaatgaaaacgccttagcattaaataatttgcgaattcagtataattatattgatgcgatgaataataaaaatcgtgaggcaattgctgctattgagcgtgaaaatgaaaaactgcgcaaagacgcaaagaaggcggatgtggtggctcataagccaggattggttgaaaaacaaatcaacaactccttcaacaagttcgcagaagacatccaggacctttctaaatgattaaactatcagcagtaatattatctattggtcttctagttggttgttcgacaaagcctctagaagtaaagaaagaaacagttcatcctaattggcctgtgcaaataaagtcatatgacgaagctaaactatcttggcaagttaaagttattgatggtaaagcttgggtaggtatgccatttgaagattctcaggaatttcgtatttggcttaatgatgtaaaacgatatgtacatgaccagaaaactatgatatgttattatcgtcaagagctaaaagaggataaatgtaaatgatttcatggtatcaatttgaacatctaaaaggattaatttatgaatccgagatggctgcaatgatttatggacgacagattcaacgattagaatctttacctccaactaatgatgttttattagctcaatcacgtgctaatctcaaaaatgaatatcaaaataagtggggtaaagcatctaaagacttgcatgattatattcaatcattagttgagaaaaataaatgaaaactctgctagaacgttatattgaatgctcggaccgttacattgatgtatgccatgacaatgcatcaagcattagcgaagacattgaacatgctaaagctttagatgatgctggtaaagccctacgaaaagaagcaaaagctcgtgggtttgatatgtatcagcttaaaaatcacatgataaaatttatttcatctaatgttcagagcaaatcggtgaatcaatcaacagctgaattatataaagggcggcgtgagcataatattcgtattcttgaagttttcttaggaattaaatgatgaaaaagattattttgactattggctgtcctggttctggtaagagtacttgggctcgtgaatttattgctaaaaatccagggttttataatatcaatcgtgatgactatcgccaatctattatggcacatgaagaacgcgatgagtacaagtataccaaaaataaagaaggtatcgtaacttacatgcagcatgatgttgctaacatgattctctgccaagacgcaacgaagggtgtaattgtttcagatactaatctgaatcctgaacgacgtaaggtttgggaagagtttgccaaagagcttgggcatcaaattgaatataaagtgtttgatgttccttggactgaattggttaaacgtaactcaaaacgcggaactaaagcagtaccaattgatgttttacgctcaatgtataaaagcatgcgagagtatctcggtcttccggtatataaagggactcctggtaaaccaaaagcagttatttttgatgttgatggcacgttagcaaaaatgaatggtcgtggtccttatgaccttgaaaaatgcgatatcgatattattaatccaatggtcgttgaactatccaagatgtatgctcttatgggttatcaaatcgtagtcgtttcaggccgtgaaagtggaaccgaagaagatccaacgaaatattatcgtatgacccgtaaatgggttgaggacattgctggtgttccattagtcatgcagtgtcaacgcgaacaaggcgatacccgtaaagatgatgtagttaaagaagaaattttctggaaacacatcgcaccacattttgatgtgaaattagctattgatgaccgaactcaagtagttgaaatgtggcgccgcatcggtgttgaatgctggcaagtcgcttcgggagatttttaatggcttggcaccatgaaacttgggctttgttattgtaaatagcggtttagttggtactagtaatgggcaattttgtgtatttactagtgaaaatagagcatgggaggaatgccttaaattaagagaaaagaatcctgatgttgaactagtagtaaagaaaactaaactgcctttaccatggaaaacgtatgaataacctagaaaagatttatcgtctttgtgataaaattgaaaaagaaaagaaatatctattttgtctatggcctattgttgacggaagagtaggcctagatgttcttgattatgaaacagaagacaaagtagatggcgcaacttttgataacgctttggatgttattgattggctcgaagaaaattatgtgaggtaaatatgtttccgacttactctaaaatcgtagaagtagtgtttagccaaattatcgctaataacatgtttgaaaagcttgataatgcagctgaacttcgaatccacgctcaagtgactcatgtattgaacgctttgcttccagaccaggtggattctattgccattacgttgtatccaggttccgcgcatatcattgttgtatttggtcttgatgctgagctagttatcaaaggcgacattcgctttgaatcacagacatcagaattcaaagcaatttaatagtttactttacggtagagttgtgatattatagctctaccaaaacaaatgaggaaattgaaatgagcgaatggtttgaagaagataaggtttatcgctttaaagctggatataaagatatttttaatgaaacttgcggggctaataaacgaattgcccagtttattggggaaaattcatttaaagtaaaaatagatcctgcgaaaaatgttattagcattaaacgtgaaattgatgattgttggtataaagctgttgatgtaatgggtgaatcctataaagttagcccgttattttcaattgcttatatgttagaatattcttttttcgaagaagttcaaaaagatgattctgtaagtaaatttgaaattaaaactgataaagaaattaagtggaaagtagtaggtattactggttgtatgttctatatctatgctcaaactgatacgaaggaagaagctaaaaagaaagctctagaatatcttgaagagcatgaagaaggtccggtaatgattacccaagatgctgaattagtttctgtcaaattagttaaaaatgttgaaagtaaggagctaggatcaacatgctaagcgaaaaaccaattactgttaaagaattccaagaaaaagttaaactatttgctcaagaattggtaaataaggtttctgaacgatttcctgaaacgtcggttcgtgttattaccgaaactcctcgttcagtattagtaattgtgaatccaggtgatggcgatcaaatatcgcatcttaaactggattttgatggattagttgaagcacaaagggtgtatggcgtactatgatgaatttaactgatataattgataattgtcttgaaaatgatactggcgatcatagagcgcttgattctgaaacagcacagttcattagaataactttaatgaatgatactctggtgaatagtattcatccttctgtgtatgatgctattattgtgacgaagtatccggttgagcttcacaaaaagatgactggcgcagtttttattgataagaaaaaccgctttaaagatgggcagaatataactagttctgttattaaaagtataactaaacttcgtcacgaaatttatcgtgttgaaactgctaaatctgcttatctggtgattatgaaatgaaagcgagtacagtacttcaaattgcatatttagtatcacaggaatcaaaatgttgctcctggaaggtaggagcagtaattgaaaagaatggacgtattatttctactgggtataatggttcacccgcaggcggtgtgaactgttgtgattatgctgctgagcaaggttggttgctgaataagcctaaacacactatcattcaaggccataagcctgaatgcgtatcatttggttcaactgatcgctttgtcttggcgaaagaacatcgtagtgctcactcggaatggtcatctaaaaatgaaattcatgctgaactaaatgcaattttgtttgctgcacgaaatggttcttctattgaaggcgctactatgtatgtaacactttctccttgtccggattgcgcaaaagcgatagctcaatctggtattaaaaagctggtttattgtgaaacatacgataaaaataaacctggctgggatgatattctgcgaaatgcaggtattgaagtgtttaatgttcctaagaaaaacttgaataagttaaactgggaaaatatcaacgaattctgtggtgaataatgaaatttcgtttggtaaagctcacagcaattagttcttattctaacgagaacatctcatttgctgtagagtataagaaatattttttctctaaatggaaacagtattataaaactgattggactagtattgataggccatatagttggaaatctgatttagaaaaatgccaaaaattactttccactcttaaagaacgtggaacaactcatattaaaactgtaataggtaaatgaatgaaactgacgactgaacagaaagtagcaattcgtgaaattttgaaaactaaattgtccatgggtatttcaaacgtagtttttgaaaagtctgatggtactattcgtattatgaaatgtactcgtgatgcagactttatgccaaccatgcaaactggtaaattgactgaatctactcggaaagaatctactgatatgattccagtatttgatgttgaacttggtgcgtggcgaggtttttctattgacaaattgatttccgttaatggtatgaaagttgagcatttgctccaatttattggtaaataaatgctttaagaattatttgttattattaattcatctgttaacaaaaaggaaaaacgatgtctgaagtacaacagttaccaattcgtgctgtcggtgaatatgttattttagtttctgaacctgcacaagccggtgatgaagaagttacagaatcaggacttattattggtaaacgtatccaaggcgaagttcctgaactgtgtgtagttcactctgtcggtcctgatgttcctgaaggtttctgcgaagttggtgatttgacttctcttccagttggtcaaattcgaaatgttccgcatccttttgtagctctgggtcttaagcagccaaaagaaattaaacaaaaatttgttacctgtcactataaagctattccgtgtctttataagtgatataaataataatatgaattgggtgtcggaataataagttaaccgaacaattctatgtggtagtctacaactgagagatctgtcgaaagaagatgaaattcagaagaacgtgactaccgagttttaatctctaacgagaatttttaaatgattaaacaattacaacacgctcttgaactgcaacgaaacgcatggaataatggtcacgaaaactatggcgcatctattgatgttgaagccgaagctcttgaaatcctgcgttatttcaaacatctgaatcctgctcaaactgcattagctgctgagcttcaggaaaaagatgaacttaaatatgctaagcctctggcttctgctgcacgaaaagcagttcgtcattttgtggtaacactgaagtaatttattggagattcactgccttagtgtgagctaaatcgaggagccgtcgaactgtctgattaatgatttgcgaatcattatagttttaagaccccggcagttttacggtgtacctcttgaatgttattttatagcggcaagtgcatgctaccccgaggtgatggccaatcgggagtacgcctcaaggcctatatatccatcagtatatatcttatcctcgagtaatcggacccggaacctttaagctaacggtgtgcaacagataagagctataaggtatgttgacgaggtttatggttatcctgtcggtaaatattcaaaacctaagtacccctttgagggattgcgcaggcaatgccaataagtcctgcattttcatttaaaagagaatttataatggcaaaacaagttaaagcaaagaaagcagttgaaaagaaagttggtgattctaaacgcgctggctacaagcgtgggtcgaactctcgtatcaatcaaactgttgagaagatcatgcgccgagcacgtgcggttcttcgagatgatgcttctcgttttggtaagcagaaagcataagttgaggactccttcgggagtccttttttattttccaaagattgcacaaagttgtttacagtacggttcctttgtgatagtattatcttacacaaacaaaggagaataaaatgaactacatcaactttgaacgtaaatatgtttctaatggtattgcaggttctattgatactatttgtctctggaaacatcaaaacggatcagtatgcgaaatcgatcagtatatgactcctaattacgtttatatgcgatttgaaaatggcatcacggtttcaatcactaaggaaggttccaactttaaaatcgctctagatgatgatttccgtgaacgcgatttagggactcatccttgttggaatggcgttcatcgcaagcttctgattaaaacttggattcgtcatattctgagtaacaaagctaaacctgagcatcttgaagcaatctttgatgtagttcttaacgaatttgatatttaagcttcggccccttactgaggaaaatattatgtttatgactacttattttgatacccgcaaaaatttctgtgaagttgttttctcaaaggcgcctaaagaccttcctgcacatttgcaacctaccagtgaatcgattaaaaactacgttaatgtagtctgccctttagagttccgtactgtaaatgggcgcgatactttagctatcactaaactcaatcgcgaaattgacattgatccctcaattgcacgtgaaattaatagttctgatattaatggcggtaatgttaaatcgcacggttttcagatgaggttttaatgaaattctttttaggtcaaactgttgaattaaagggagttggtatacctggattaatttctaaggttctacctccgtttaaatggagtggtattcaaataaaagaggcttatattgtttcttgggtagatggaaatgaagaccttcgtatgggcgatgaattatctcctatctacggattaaaggaattagtatgaatataattaataagatttttggaattcagtacattaaggtcacatataaagtaacagataaaaatccgtatactgatgaacacgaagaaccgcaagttaagtctattatattagaaaaaggcagtgactggccagttgaatttcgtctaccaaactatggtcattgggctgatgttgaaattataagcattgaaaatgtctgagttagagattagaagcaattttaaatggccatcatgtgcattaagtaatttcgcccaatggcctttcgttatggatggtattcaatttggaggtcttgaaggattcctccaaggatgcaaggtgaaaaatgttgaacaacaacgtcgtatatttgggttatccgggcttgccgcccaacaagctggaaggtcttatgctagagctcaggaccgtgggaccctcttctggcttggagttccgttttcaagatactccccagcatggaaagaattatacacaaatgcatattttgaagcagcgatccaaaacaagggctttcgtgatgcattacacgcctcgaaaggaaaagttttgaagcacagcatggctagtggtctaacaaaagatgatacaatattaaccgaagctgaatttattgatgtgttaaacctattaagagactctctatgaagcctactattttaactgatattgatggagtatgtttaagctggcaatcaggccttccttattttgctcagaaatataatcttccgttagaacatattttaaaaatgatccaagatgagaaatttatttctccaggtaaactctttaattgtgacgaagaacttggcgtcaagttaattgaaaaatacaatcgttcagattttattcgttacttgtctccatataaagatgctctgtgtgtaattaacaaattaaaagaagattataattttgtagctgttacagcattgggtgattctattgacgctctgctgaatcgtcaatttaatttgaacgctctttttcctggtgccttctcagaagtactgatgtgtggtcatgattcttcaaaagaagagttgtttaaaaaggcaaaagagaaatataacgtgatttgttatattgacgatctcgctcaccattgcgatcatgcgagtgaaatattaaatgttcctgtttattggatggctcgaggggaacgtgacagtattccaaaaactgcacagcgagtttatacatggaatgatgtagaaaataagcttttttcaccaaaggaaaataaagaaagttttgatagtgaaaaagctataaaagatgtaattgagaagatgatcaaaaacgattcttttccttggaacactacctggagaactcctggatttaatccttataatcatctatatcatccatatcagacacatccgtttcagacatggaactatattaaacctggtggcatagagtatttgtataatagacctactagtggtgataatattttccaaggagcattctaatgtttgttgttcatactatttatgaaaatgaaggtaatactacacgtgattacggtcacgtaaatcaattttttagatgcaatccagaattccgagctcaaaaagacgaacgaatttttaaaaaatgtgtagagcaaggtttcatttacgtcaagcactggatgcaaggaaataaagttagaaccacgtaccacaggtctttgactgagcttaatgatgaattgatttataatagagctgtaaaccaaactctaaaggatgaacaatgattcttaaaattctgaacgaaatagcatctattggttcaactaagcagaagcaagcaattcttgaaaagaataaagataatgaattgcttaaacgagtatatcgtctgacttattctcgtgggttacagtattatatcaagaaatggcctaaaccgggtattgctacccagagttttggaatgttgactcttaccgatatgcttgacttcattgaattcacgttagctactcggaaattgactggaaatgcggcaattgaggaattaactggatatattactgacggtaaaaaagatgatgttgaagttttgcgtcgggtgatgatgcgagaccttgaatgcggtgcttcagtatctattgcaaacaaagtttggccaggtttaattcctgaacaacctcaaatgcttgcaagttcttatgatgaaaaaggcattaataagaatatcaaatttccagcctttgcccagttaaaagctgatggagctcggtgttttgctgaagtcagaggtgatgaattagatgatgttcgtcttttatcacgagctggtaatgaatatctaggattagatcttcttaaggaagagttaatcaaaatgactacagaagctcgccagattcatccagaaggtgtgttaattgatggcgaattggtataccatgagcaagttgaaaaggaaccagaaggcctagattttctttttgatgcttatcctgaaattagtaaagctaaagaattcgccgaagtagctgaatcacgtactgcatctaatggcatcgccaataaatctttaaagggaaccatttctgaaaaagaagctcaatgcatgaagtttcaggtctgggattatgtcccgttggtagaaatatacggtcttcctgcatttcgtttgaaatatgatgtacgtttttctaaactagaacaaatgacatcaggttatgataaagtaattttaattgaaaaccaggtagtaaataacctagatgaagctaaggtaatttataaaaagtatattgaccaaggtcttgaaggtattattctcaaaaataccgatggattgtgggaaaatgctcgttcaaaaaatctctataaatttaaagaagtaattgatgttgatttaaaaattgtaggaatttatcctcaccgtaaagaccctactaaagcgggtggatttattcttgaatcagagtgtggaaaaattaaggtaaatgctggttcaggcttaaaagataaagccagtgtaaaatcgcatgaacttgaccgtactcgcattatggaaaaccaaaattattatattggaaaaattctagagtgcgaatgcaacggttggttaaaatctgatggccgcactgattacgttaaattatttcttccgattgcgattcgtttacgtgaagataaaactaaagctaatacattcgaggatgtatttggtgattttcatgaggtaactggtttatgaaagcttacttagaaacaattgtcgtggctcaaaaagaaggtggagatgtttctacttctgtatcacaagtcattctcgaatttgtagatgcatacgcttataataaatttacagaaacatttgatgcctatgaaaaaggaccaaagtttgaaatatatcgtactctcttaccactagattactaaaggccttcgggcctttaattttataaatagaataaacactagagaggctatgatggaacttattacagaattatttgacgaagatactactcttccgattacaaacttaaatccaaagaagaaaataccgcaaattttttcagttcatgttgatgatgcaattgaacagccaggctttcgtttatgtacatatacatctggaggtgatactaatcgcgatttaaaaatgggcgataaaatgatgcatattgttccttttacattaactgctaaaggttcaattgctaaattaaaaggtcttggtccaagcccaattaattatatcaattcagtttttactgttgcaatgcaaacaatgcgccagtataaaattgatgcttgtatgcttcgtattcttaagtctaaaaccgctggtcaagctcgacaaattcaagttattgctgatagacttatccgtagccgttcaggtggcagatacgtccttcttaaggaactctgggattatgataaaaagtatgcatatattcttatacatcgcaaaaatgtatcactagaagacattccaggagttccggaaattagtaccgagctctttactaaagttgaatcgaaagtcggcgatgtttacatcaataaagatactggagctcaagtaactaaaaatgaggcaattgcagcatctattgcacaagaaaatgataaacgttctgaccaagctgtaatcgttaaagttaaaatttcccgtagagcaattgcgcaaagtcaatcattggaatcttctagatttgaaagtgaattattccagaagtatgaatctacagcagctaattttaataaaccagctactgcacctttaattcccgaagcagaagaaatgaaaattggaattaattcattagcttctaaaacaaaggcagcaaaaattattgctgaaggaacggcagatgaacttcactatgattataaattctttccaatgagtcaagtcggtgaagtttcagaaaaaattaaagaagtaatttttaatgcaattaaaaatgaaccaactacttcaataaaatgtttagagaaatacgcagcagctgctaatcaactctttgaagaatataaagataattggcttgataaacataataaaactcgtaaagggcagccagatgaagtctgggaagaaatgactaaaaattcctggaacgcagcaaaaactaaattcctcaaaagaatgatttatagtttttctggaattggtgcaggtccaatgattgatattactattgcccgtgatggttctaaatatactccatcacaaaagcgcggcattagagagtattgtggttcagggtatactgacatcaataatcttcttttgggtcgttatgatccagaacgttatgaagtaatgagtgaaaaagaaattgaagctgctataactaatttagattctgcttttgaaaatggtgatcgtataccagaaggcattacagtttatcgtgctcaaagtatgactgctcctatatacgaagcactagttaaaaataaagtattctatttcagaaattttgtatctacttctttaactcctatcatttttggacgttttggaattacacatgctggtattggtcttttagaaccagaagctcgcaatgaattaacagttgataaaaatgaagaaggaataactattaatccaaacgaaataagagcgtataaagaaaatcctgaatacgttaaagttcaaataggatgggcaattgatggagctcataaagttaatgttgtatatccaggaagtctcggaatagcaacagaagctgaagttattctaccgcgtggattgatggtcaaagttaataaaataactgatgcttctaataatgacggaacaacatctaataatacaaaactcattcaagctgaagttatgaccacggaagagctcaccgaatcggtaatctatgatggagaccatttaatggaaactggtgaattggttgcaatgacaggtgatattgaaatagaagacagagttgactttgcatcatttgtttcatcaaacgttaaacagaaagtagaatcatctcttggaattattgcgtcttgcatagatattacaaacatgccttacaagttcgttcaaggataaatcatggaacttattacagaattatttgacggcgcttcggcgccggttgttaacttaaatcctaagcataaaatacctcaaatttttgctattcaagccggtgaagaaagcgtgcttcctggatttagattttgtacatacacctctggcggtgatacaaataaaaacgttaagccgggcgataaaatgatgcatatcgtaatgataggtgtcaacgagaaattatcgttagtcaagcttagaaacttgggtggaaatccaattggcgtcattaatgctgtttttgatactgctcttcaaacaatgaaacagtataaaatcgacgcatgcctattccgcgtactaaaaagtaaaacaaatggcgcagctcgtcaaatgcaagttattgctgaccgtttagtacgtactaaaggagcaggtcgatatgttcttttaaaggaaatctggggctatgataagaaatatgcatatattatggtttaccgtaaaaatgccaatttagaagacattccaggtgtacctcctatttcaactgagttattcacaaaagttgaatcaaaggttggtgatgtttatgtagacgttaaaacaggtaatgctgttcctaaagctgtcgctgttgctgcttctattgctttagaaaatgataagcgcacggatcaagctgttattcagaaaactaaaattagtcgtcgattagcagcacaagctcaatattctactgttgatgcttcacttcagggtgatagcttcgctgctaagaaatatcaagagtttgaatctaaagttccggtatataaagcagaaggtccgatgaactctggcgttattcagattggttcaaactttagcaaaggagctatcggtggtatgagaagtgcttctcgttttaaatctaacgattatgaactagaaagtttccgaaatcatattgcattagcccatgcacgtttacgtgatccatctatcaagttgcagagcgatataacatatcaaggttctcaagaatatttaaagaataaagaattctttgattataaaactgataaaattttaagcgatcttgctgacattaatatttctaatagctttgatgttattaagaaaattatcaatgatttagttaaaggttctaaagctacaccagatgaaaagacagctattattcaatttgtcatgaatggcatttataaattgattaatgaatctgccgctcaggcatatgaatacgcaagcactgaagtaactccaaaaggattaactcaggctgagtctgatgtaattgaagattattgtgcagattcatatgttgaaatgaactcgttccttttaggtaaacctgattctacccgtgaagaatatatggaacgagctattaaacacatcgagacgttggattctgcatttgctaaaggttcagttcttcctccaggaactactctttatcgtgggcaagaagttacctttaaaactttgcgtcataacattgaaaataaaatgttctatttcaagaacttcgtatccacatcgcttaaaccaaatatcttcggtgagcatggtaaaaactatatggctctagatgattctggcgcagtattttctggtgaaggagaaggttccattgatgcagaagatttgatgcatatgggtagtcattctacatatgttaatgaagatgctgaaactagcgtgggtatggtaattaaaggagctgagcgaatcaaagttatcgttccaggtcatttatcaggatttccatcagaagctgaagttattctaccacgtggaattttactgaagattaataaagtaagtacttactttatgaaagaaactgcttataacaagtatctaatcgaaggtacaatcgttcctccttctgaacaattagaggaatcagtatatgatggcgatcatttgatggaaactggtgaagttcgtccaatgactggatttaatcaattccttgtagaagaatcaaaagaagaggaaaacgaagtttctcaaatcttagcttctttggttaacatcaacggaatgtctaaaaagttcaaaatgtagtttacaagtccctcatgttgtgttatagtagtcttactgacataacatgaggaacacaaaatgaaatcttctttgcgctttttgggtcaagaacttgtagttgaaggcgttattcctgctgataatgcttttaatgaagcagtttacaatgaatttatcaaaatttttggaacagataaaaagttcggaatttttccttctgaaaatttttcaaagccagaacagactgaaagtattttccaaggtgtagtaacaggtaaatttgagtcagaagctccggtaaaaattgaggtttatattgaagacagtttagttgcttcagttgctgcttttatttcattccgtaaataaaaatatggggaccgaaaggtccccattgttatattgctcctaatattttactttgcgaattgacaattcctgtcatagtattaatgtttgaaatgcttcctgcagttccccctaatctactgagtcgtgaaagcgaattagatagtccagtaacacctccactatttccgagaacgctttgaataccatttatagcagcagattcaagccattcaagcgcagcttgcctatcaactgctccagcctgcatcactctatacgcaaaagtaacgtcaaatgtagttatttggttatctccatcatatgataactcaggagcgctcactgatattggaatgcatccagtgaacatcaccgcagtatgaggcaatccattacgagaatgaagattaacctgaatatctgcctcgacatcctgtggcaaagcacgcagtccagttactgggtcttgaacggagttaacccagtcttgcattgcacgatagttacaagcttctgaatccattctaaatgaaataaccaaagggtctaattctctcccagttatacgaatattaggagaattatagttccagtcagtttcataggataatctattctctggcatttttacagagtatatcatcaatccagatgagttatatgccatgttaaagaagtcaattaaatatgtaccaactgtaaatgagcctaataaactttgaactgtacgttgactcatggcaccaataagatatttactaacccctgattttcttatcagtttttgtgtgccagcagtaattagcgtggtaattccctgattaatatcaccttgagtcaatcctaaccaatctgaatttaggcccaagttattataagaaaagttgctaattgaacttatcaacgaagagcttttagttgatggagttgttgcaaaaacgcagctaaacatattattacgttggaaatctgcgtttattgcttgattattaaattcctctaaagaatacattaaaaagtccccgcatataaagaagcacggtttaacgtgataatttctctcatagtaatctcgagagtaaatgtactagggaggtttggagcaatagctaatccgttaaagttaccattaggtgttttgtcaaatctgatactctggatttgacatggaccgaatatttccgtttttccatcaaacttagatgttgcaccaaagtttttcaccatccaaattgtcgggtttgaaactacaagaacgttagttaaactcgatgtcattttctcaaataacgtcttatttttaactgcatcttctggagttaacggctcaataaaagtagaacggtaccactcatctaaatatccttttatttcagcagcatattgagatttaccagtttcaccgtaagaaaaatagttaaaatactgatagatattaataatagccattaaatcttctgttgagcgcggagtcaaatcccaagtgaacactttagttctattttcagcaccgccgtacatgcttctggctgtcgtataaatctgttcattattatcagccattataccttgtgttatactttccagcgctccaaatactgcggttgaagccatattgcttagcacaccagtagcagtacctccaccttttgtaataagactatcttgaacatcattaaatctatgtgatgacgtatcgacgtcagatttagatctaggtaaaagaatatttgcaacaggaactttacttattgttcctgaattattatctgatattagtccatttgatagttttgatactgtattactgatagtgtttctggctgtacgtaaaatactcgaagatgaagaagagtagttagatctcatcgttctaagacttccagaatccctagatgacatattgtatgcagtaaataataatccattcttatatagatctgttacctggaagtcccctgtagtgtcattaccactagcacgcccagttggaaactgggcagtgtatgttttagttgctacttctgatttagtactctgtccggctgaaattttctcaccggactttttaattaaatcagcagttatttctttaacaattgccatattattccttaattaactccagtcgcatcaaatacaccaggagcagtcgtgctcgttacgggtgtcatattatgaacgacagtatttttcttaataacattattagtattattgattgaaggagatgcttgttgaataggagcttgctgtgctttgttcttttctattacctggacttgttttgcttctggcgatttagcagaagtttgaggtttggcattaggctgatttttcttgagctcttgataagtagcatcaattttagaaaatctagcagcaagttcttttttaactgccggtgaattatttaaatccgggtcatccattcgttttttaaggtcttcataggcagcttcaactgatttaaccgttgagtctttactcatatcagctgaattagcgtattcatcaaaacgattcatagcagcacgagcttcattagctttcattaaagcaattttagcttcctccggagaaagttgctttaatttttcttcttcctctgctctctcttcatcagtcgttagtgcttctttattatcaacaccacgaatccagttagatgcacgagttttccagttcgcaattttgtctagcccttttgctattggaccaagatcgtcattcattcttttatattgataatttgcaactttttcttggtcttctttgctaagagaagcatttgtagtattttggaaattttctagtgctcttccttctacttcatcagcagtatccttcataccaggaataactcgaagaattgccgcagataatttagccattccaagttgaataagctctcctaaattaaaaagaacctttccaagtccttcgacaatagctactgtcaatccgccccagtctccagcttcccacagcttcttaattttatcaatagaaccaaagatgctctgtaataaaggaccccacgttccggtttcgctagagaatttggtaaagtttgtactaaacaaatcccatgcctgcgaaaatttatctgaccaatatttgaagtgaaccatcaacagatctattccaacaacaacagccaatatcattgcagtcattttagcagcttcaatagcagcactaacggtatacttaaataacatgcttgatattttatcactaattgaaatagatttcttaaatccaaaatcaacagtctttgttaatttatctaaagcttgagataattttaagttaaatgcttcttttttctgtttttcttctggcgattcttgtttaggttcaactggctgaggggtagggaaaaaatcagcatcaggatcattattaactgcttcaggagctggtaataaaggacccacggattcagctgtatcgtcctcaacaactttaacaggaatagcgctttcaaccgtagctaaactagttcctgtttgttgaattccggctgtctggattttttgctcgagtaaactcgttaatttatctaatttacttccgagcgattcaccgatttctttattaatattattgccaatttcgacagtttcagcaattaactcagaaccagcagtagtatcactcactgcgctttctacattgtcaattgctccaattatttcattcgatttttcttcaacagtttgagcaattaattcagaagcagcttgagcatcatccaatttcgtagatatatcgttaagtccagataaagtgttagaagcggatttagccgcttcctgtgttggtttattatctgaaataacttttctacgcatcgtttgcatttcttgtggctttttcattcaaataatccaataatattgccaattccggttattggaccattagggccaggaattgctaaagttgtaaaaatatcatttgcccattttaaaacgaatgctggcatctcaagaaaattaatttctttaacttcatcattgaccttaagcaagcatttggataacatatcgctcaccgttaaaaattgttcaaattttccaggaggtctaaaataaaatgtatttccttggtattgaaattctaatctttggcacacataaacatcattaatgtcataagtataaccatctatttctttacgagatttaatctttccattaaattccaataaatgaatggaaacgaaatcaacttctgccggtgataaatttggacaaatagaatcaataagaagctttaaattttcatcaggacctttaacatcttttaaaatgttataatgtttaagacccatcttaggaatagaaacttctttattacttatcggaagaactactttcttcagtggtagtatcagttttaaattcatttttaaccttaactgggtcgattgtttccagtttcgttgcattagtgaacatatatagatgagttacggaattattatttgataattcgtgaataacttcatcaacgtaaaattctgttttaaattggtttttactatcattaaaaataattttaacgccaggagtcaagttaaaattaccgacagtagaacatttagcatagccgtcatattgcgccatagtctgaagacgaatagcttcttcatatccatttctataagtcatttcagaataagcacctgaccttgacactacaatagagttttcaccctttcctgtagtaatcattggtaatgaagaatctaaaaatgaatgagcatagatagtagcatttttcattggatcacgtttatgcgggtttgatttagtcaaccaaacaaaatcatatgctaatggatatttcaattcttggacgaattgacctattaaagttggctcacctacaatcattggatatggttcttgatttatcatcatatcatagtccatcatgttaactcccatgatgtcttgccatacaaatacgaacttatcgcttcctaccgctagagcaacttctcttacatatgacaaatagttttcaaatgtgctagtccatggaatatcaggaacataagcattaatagcatttatcgctggagttaataatgtacgatcttgataaattacgccaagcatttcctttatagattcaccggcatcagggaaaaatggtctaccaaatttaagattttctatagaatgaatagttcccaattcaatagcaatgatgttatcaccttttgaatctacagatacagaaaaatgcttacatccataaattcttgttttaacattattaatatcgtttgcattagctacagaaatctgaattatttcatttccatccatttttgtatggatatttttagaatcataaaattgtagcattccttcatttcgaccataaagagaatcccgcatagttaatgtggtaatagtagcagctaattcaacaaatctattattactccaagcgtcataactctcaaataatttaacgctgagatttggatatccaggacgttgtaacatactcattgatgtttatccttctcaatcagttttaatacgaatccgcgctcggcaggaatcattttcattattgaatttaagctataattactttttacaagcgtgtgattaatttgataaaaagtaaatatctcatctggattaactaatagcttaaacacatctactatatcagtgtattttttaatgtacttatcacaacacgacatgtgcaatgttaaattaataggattcattgcatcgagaattttttctaatgtttctatctcgatggcgtcaactagttctatttgactggactcgctaatttccttccaatcataccatatttcatctacttgaacagaatgaatattttcagtaatcatctttgctttattttcataaaactcagaaggaaactttaatttaattttaacattagctacatcaaaaacaggttcctttaattctttttgatatatttcaaatggaactgtcttttcttttttacattttggacatacaaatgtgactggtactttagttttacctattgaacctacaaatacctgcaaaaatataaatggttgccaagtcttcggatagtctccaaaataatcatcaattaaatcagtaattatttctttttgttcttgtggtgaccgatgttctatatcgtttcgaactaacaaaaaatctcgataatcttctaccgtaaatggtttaaaacgatgaacaccatctggtaatttacaacgaataatgtttgccatagatgctccttttattctatttataaatatgataaataaaggagctaaatatgtatgaatacaaatttgatgtgagagttggttctaaaataatcaactgtcgcgcatttactcttaaagaatatctagaacttattactgccaaaaataatggttctgtagaagtaattgttaaaaagctaatcaaagactgtacaaatgcaaaagatttaaaccgccaagaatcagaactattactgattcatttatgggcgcattctcttggtgaagttaatcacgaaaactcttggaagtgcacctgtggaactgaaataccaacccatataaatctattacatacacaaatagatgcaccagaagacctctggtatacactgggtgacattaaaattaaattccgataccctaaaatttttgatgataaaaatatagcccacatgatagtatcatgcatagaaacgattcatgctaacggggaaagcattccagttgaagacttaaatgaaaaggaactagaagatttatattctatcatcacagagtcagatattgtagctataaaagatatgcttttaaaacctaccgtttatttggctgttccaattaagtgtccagagtgtggaaaaacccatgctcatgtaataagaggcctcaaagagttctttgagttactataatggcaaatattaataagctttattctgacattgacccagaaatgaaaatggattggaacaaagatgtttccagatcgcttggattaaggtcaattaaaaacagtcttttgggaattattacaacaagaaaaggttcaagaccgtttgaccctgaatttggatgtgatttatcagaccagctttttgaaaatatgactcctcttactgctgatactgttgagcgtaatatcgaaagcgcagtaagaaactatgagccacgtattgataaattagcagttaatgtaataccggtttatgatgattatactttgatagtagaaatacgcttttcagtcatcgataaccctgatgatattgagcagataaaactacaactggcttccagtaatagagtataatgcttcacgtataaacgtggtataatgaatctaagtccatccaataacaattgaatagagaacaatatgagattagaagatcttcaagaagaattgaagaaagatgtgtttatagattcgactaaattacagtatgaagcagctaataatgtgatgttatatagtaaatggcttaataagcattcaagtattaaaaaggaaatgcttagaattgaagcacagaaaaaagttgctcttaaagctaaattagactactactcgggacgaggagatggtgatgaatttagtatggatcgttacgagaaatcagaaatgaagacagttctatcagctgataaggatgttttaaaggttgatacctcgttacagtattgggggattttattagatttctgtagcggagctcttgatgctattaaatcacgtggatttgctattaagcatattcaagacatgcgagcatttgaggctggaaaataatgagatataacattgatgatgcttttaattatgaagaagaatttgaaacggaaattcaattcttaatgaaaaagcataatcttaagcgtcaggatattcgtatcctggccgaccacccgtgcggtgaagatgttctttatattaaaggaaaatttgccggatatcttgatgaatatttttattctaaagatatgggcattgatatgcatatgagagttgtataaatagatatataattcagaggagacaatcatgtcagataagatttgtgttgtctgtaaaactccaatcgattctgcattggttgttgaaacagacaaaggtcctgtacatcctgggccttgctataattacattaaagaactaccagtttcagaaagttcggaagaacaattaaatgaaacgcaacttttgctatagtgtgacctttagtctatagttttggcccttcctttttggttgggccttttttaatttaaaagctttcttctacttcatcgtctgaatcttctaattcagctctttttcctgccaaagcatctctgactgagatgtcatcagtatcttttaattcagtttctttaactcttttcttataataagcttcaagttcttctaaaccttctaatgtttgacaagaggcaattttacccataaattcatcaatagaagcttcataaagaaattgtttaaattctagtaacatctttttctccaaagggccgaagcccttataaattaactgttttcattacgtaattaaatttttcatctgcgtagcgctgaatacgatcaatgccgtgttttaaaagatagttcaagtgaacatatttctttttagtattagcagattttggcttgacaccacagtcatctatgaggtcccagactgttgcgattgttttagaaccatgcttacgtaatacacgaccgattgtttgtaatacaatgatttttgatttaacaccgtgcgctaaaacaacgtgatgcagatttttaactgaaataccagtagaaaatacaccataactagctactataattattcctttaccattttcagctaaggttttcattatattgcgggtttcggtatcaacttcccctgatacgtaataaactttatcgtattcatttttaattaaatcgaaaatagctttaccatgtgatacatgtttaaacatgacaaaagcgttttcatctttttgtgcaagcttaatagccaatttagcgatccatttatttcttttactaagccccgtaataatttttatttcttcttgataagtttttccctttaatttagtagtgaactcatcgggatagcgaagaaaaatactattaatttttagctcagttacttgtccatcttccattaacttagaagtcgttactggcttaaatatttcaccaaacattccaacatactgcatgatattggctttgccatcacgtaatgaaccagatagaccaaatttgaacatgcagttatttaaacctgatatgatagatgaaatactttttcctgtagcaagatggcattcatcattcatcatcattccaaactgtgagaaccattctttcggttgttttactacagtttgccatgtaccaacaacgactggtgcatcatttttatatttatcatcttttgatgctccgccaccaattttctttatcattgcatgactgaataaacgatagtcaacgaagtcatcagccatctgagttgttagagcagttgttggaacaatgataagaattttaccttcataattttccaaataatatcgcgcaagcaaagcttgaattaacgatttaccagcggatgttggaagattaagaattctacgacgattaactaatccttcgaacactgcatctttttgataccaatgcggttcaattcttttatttcctgaatagatttctaatttagaaagccattcatcaaaatcttttcttgataattcttctttttcgttaatctgtgggtcaatccaggctttatagccaaagttatcgcagaactttttaatttgcccgactaaaccgaatggaagaaggcgattataatctaaaagacgaattcgtccatcccagtggccatatttgtacttcggattaaaacgatacccatcagcttcaaagctaaagaaatcacggagttcatgaaatgtactttcttcgcaatcaattctcacgtgactaaaatcataaaaatgtactttaatgtcagtcatgtctaaataccatgtaataaatatatctatatttatactgaggaaatattatgatagataaagattatattgcagagctgaaggctcttgatgataataaagaagctaaagctaaattagctgaatatgctgaacagtttggtataaaggtcaaaaagaataaatcttttgataatatcgttaatgatattgaagaagctctccagaagctcgctagtgaacctatgccggagactgatgggttatctattaaagacttaattgatgctgctgatgctgcagaggggttaaaatatgacgatgaagaagtcaatccagaagcagcacttttgattgattctccggttaaatctgacattaaaattgaagtagtagaaacagataaaattcctgaaaataccgatgttttgattgaagatactccatttgttgaagaaaaatttgaacaggctgtagctgagattattgaatctgaaaagccgtctgtatttactcttccggaaaactttagcccgaatcttcagttgattggaaaaaatccaggattctgtactgttccttggtggatttatcaatggattgctgaaactcctgattggaaatctcacccaactagttttgaacatgcgtcagcacaccaaactttatttagcttaatttattatattaaccgtgacggatcagttctaattcgtgaaacacgcaactcttctttcgtaacattaaaataaggataacttatgacttttacagttgatataactcctaaaacaccgacaggggttattgatgaaactaagcagtttactgctacacccagtggtgaaactggaggcggaactattacatatgcttggactgtagacgacgctccacaggaagaaacgtcagcaacttttagttatgtactaaaaggacctgccggtcaaaagactattaaagtagttgcaaccaatcaagttgcagaatctgaacctgaaacagctgaaattagtacaactatcacagttcaaaataagacacaaacaactactttggcagtaactcctggtagccctgatgctggagtgattggaactccaattgaatttaccgctgccttagcttcacagccatcaggtgcaaacgctacgtatcaatggtacgttgacggttctcctgtgggcgaagcaactagcactacattcaattacactcctgacgcaagcggagttaaaacaattaagtgcgtagctcaagtaaccgcgacagattatgatacaaaggaagttacttccaatgaagtgtcactgactgttaataaaaagacgcagacaactactttggcagtaactcctgatagtcctccagcgggagtaatcggaaccccagttcaatttactgctgccttagcttctcaacctgatggagcgtctgctacgtatcagtggtatgtagatgattcacaagttggtggagaaactaactctacatttagctatactccaactacaagtggagtaaaaagaattaaatgcgtagcccaagtaactgctgaaaattacaatgaaaaggaagttacttctaatgaagtatcattgacagttaataagaagacaatgaatccacaggttacattgactcctccttctattaatgttcagcaagatgcttcggctacatttacggctaatgttacgggtgctccagaagaagcacaaattacttactcatggaagaaagattcttctcctgtagaagggtcaactaacgtatatactgtcgatacctcatctgttggaagtcaaactattgaagttactgctgtcgttactgcaactgattacgatagcaaaactattacagcagaaggtcaagttcaggtaactgataaagttgctccagaaccagaaggtgaactaccttatgttcatcctcttccacatcgtacttcagcttatatctggtgcggttggtgggttatggatgaaatccaaaaaatgaccgaagaaggtaaagattggaaaactgacgacccagatagtaaatattacctacatcgttacactcttcagaagatgatgaaagactatccagaagttgatgttcaagaatcgcgtaatggatacatcattcataaaactgctttagaaactggtatcatctatacctatccataatcataaggggcttcggcccctttcttcattttgaaagcacacaaaacacaatcagaaaatgatgtatataatggcaccaactcgataacatgagattgattatgagaactgaggttgtggtgtttactcttcatgagtctggaaagtcattcattgaaattgctcgtgaattaaacttacaggcaaaagaagtggctgtattatgggctcgagctatgactgctaaaaataaatttgaaactcgagaaaaagtcgtctatagaaaaagacatatcaataaaaaggtgaaaaatggaacagtatgatctttatgaaaatgaatcttttgctaatcaattgcgcgaaaaagcacttaaaagtaaacagtttaagctagagtgttttattaaagatttttcggaacttgctaataaagcagctgaacaaggtaaaacacattttagttattattgtattgctcgtgataaattgattactgaagaaattggtgattggctgagaaaagaaggattcagctttaaagtcaatagtgatcagcgtgatggtgattggttagaaattacattttgaggattaattatgtttaaaaagtatagcagtcttgaaaatcattacaactctaaatttattgaaaaactttatagcttgggattgactggtggggagtgggtagctcgtgaaaagattcacggcacaaatttctcattgattattgagcgtgataaagtaacttgcgctaaacgtactggaccgattcttcctgctgaagatttctttgggtatgaaattattctaaagaattacgaagattctattaaagcagtacaagatattatggaaacctcagcggttgtatcttatcaagtctttggcgaattcgctggacctggcattcagaagaatgtcgattatggcgataaagatttttatgtatttgacattattgtcactacagaaagtggtgatgtgacttatgtcgatgattatatgatggaatcattttgtaatacatttaaatttaaaatggctccacttttaggtcgcggtaaatttgaagagcttattaaattgccaaatgatttagattctgtcgtccaagattataattttacagtagaccatgctggattagttgacgctaacaaatgtgtttggaaagctgaagccaaaggcgaagtatttaccgctgaaggatatgtattgaaaccttgttatccttcttggcttcataatggaaatcgtgtagccatcaaatgcaagaattccaaatttagtgaaaagaaaaagtctgataagcctattaaagctaaagttgaactatcagaagctgataacaaattggtgggaattttagcttgctacgttacactgaaccgagtaaataacgttatttctaaaattggtgaaattggtccgaaggattttggaaaggtgatgggactaactgttcaagatattttggaagaaacttctcgtgaaggtattactctaactcaagcagataatccttctttggttaaaaaggaattagttaaaatggtacaagatgtacttcgtccggcttggattgaattggtaagttaaataaaaagggaccgaaaggtccctttgttttattcatcaacgataatttttggtagcttaacacctaataaaacagacaaa

SEQ ID NO: 4 - DNA, 43313 bp, Unknown
  Description of Unknown: Bacteriophage F510/08
cctactcaacgaggccgtggctagcaaggtgctaaactcccgcctgggctggtccgcagtcggcgagtatgtcgaactgttcaaccgcacgcaatcccgcgtggccgggttgattcccgagtagctcaagccgagtacctgcatagtcgggtgctccactggaactactggaatttttattgagattggctggaggttggctgtctgtggctggggggggtagttactccgggtctaattttggtatcgtcgtgtgagaaccctcccgactctgatcagcccacccttcccccgtaggccctccgcctggtgggccatccctcgcattgcctgggtgttgcttcctagcctcctgggagcttccagctccgctgggtggcgtgggcttccctgccctgtcgccgaccattctacgcatcctgtcgggagtgtcaacccttgggctggccgtagtgcctggagcgctccagcgcttccctgtgcttggtcagcgctaccgcgtactcctgggatgcctggcgcttccgccacggtgctgcgtagtgccggtggtcctgcgctgcccacgtcgctatctgcctctgccatgctgcgtcctgctggtgccaggctcgctcgcctctgtcctgtctgctcagcatcctgtgcctcctgtggcctctgctggtcctgtcgggtggtggtgcgggagtggctggccttgcctcttgtggtattgcctcctggctgtacctggcgttgcctgggtggtcccggctctgcctggggcctacctggccactccctctaggccacgtactctacccgcctgcctctgccttgtctagtccctcctggctggtgcctgggtgctggtctgtctcaccctggctcactctgtctctacctgtgccctgcctggctctgtcctggctaccgctggtcctgctgtcttgcctcgccgctccctcgcatgctcggtcgcacctgcggcgctgatggactcctgtttgtccattgtgtgtgacataaccgcagccctagtgccacgcgggttccagggcggtgggtcgggtgcctgggtggcggctgtcgctccctggtaacgcaaatcctggctagctagactaagcctcgcacgtgggtctctatacgtgtgggaaggctccagggagcgccctgggagggttgacacgtgggcagtaggtctgtagagttcgccctgtcttcacgcaacaacgcctctacaggcagcctggagacggggttgacacactgccagggcatcggtagagtacgcagccagaacgacgggagattgcaaccttccaagcgcggcacaagccataggcgcaagggacacggcaaactcttagggcaggaaccgcagtgtgtaaggccggcaggcatcactgaggggattgacacggtgcaggacacgcggtacagttcgcaccacctgatggccactcagcaaaagggcctatgccagagaactggacgaactaatccccgacagaggattgacaagacaagcgcaagtctctaacatgcgcagcaagacgaaaggatggttcagccatctggcggtagaggttcgaagcttcaccagcggtacatggactggtgcggtaggttgaccgaagctgcaactggttaggcagggtcccagggaatacctgtcgggtgctgaagactcacccaaaagagtctgagcgggaagcctccccgtccacggttaagcaaaggcacgttagtgccggtgggaacgaacagagtgtcagtgggatcgagaactagaaacctcggttaatcgcgactgacagtatgctgggtagtatcggcgggccgattgaacaaggccaggcagatagcgcaaagggtacgggggatgagtgctgacgatcccgaagagtatgcgcaggacaagccagaaccgctgatactacagggactatgccaatgccaaggtttgtcccttgaggcccttccaccgaggggattcaagagacagacctagtgaggattgccgatggcacacttcaaggctaaggctcccaagtcgccctttgctgctcaggtagcgtactggcgggactgggaagccaaacgtactaagctcatcgcacaggataacgtcgaagggcgtaaagagcttcgcaagatgcgtgacgtgcgctacgccaccgacccggagccagcgccaggacgctaccataaccctgaacagaaggctttcgtgaagggtagcgaaggcaaggcgcggaacatcctgaagggatggaacgctaagaagtcgcaagggaagggtttgtaatgccacgtgtgaatgaactgacgccgcgtcaacgcaaggccgccaaggctcgccgcgacaaggctcgccggattgatctagcgcacaggatgccgaaaggtgccgactgcccgatcttccgcaaggctgagcaggcgcaagctaagcagccacgagtcgataccctgaccactccccgcagtgctggctacctggccgccgctgcttacctgaacaaatccatctgaggtacataccatgaccaacgcaatctccaaaaccgtaatcgcattccgtggcaccgaagagatcaaccgcgctatcgacgccatccgtgtccgtggcaaggaactcgacgaagccatccaactgaccggcctgtcgatcatccaccacatcgaccagtgcggcgacgtgaccgtagtcaaggcgctgtatgaagccatgccgaagggcagccgccgcaatgcgctggtcgagtggctggtgctgcacggcaaggtacaggttaacactgacaagaaatcgaacaaggacctgcccttcctgtacaacaagttcggcaagaccgatctcgtcggcgccaccaacagcccgtggtacagcttcaagcctgagaaagcgctggaccaggagttcaacctggctgctgccctggccacgatcaaaaagcaggtgctccaggctcagaccaagggcaaggtgatcgtcggtatggaactgctgggtgacttggaagcgctggccgccaaggctgcacccatcgccgagcagagcaagcgcgctgccgcccattgactcaagtcgaacgcctgctaagcgggcgttccgctggaatcaatgacaactggagaaacacgatgagcttcaaacaacgcctgcaacgtcaaatcgccctggcacagtacagccgcccggctcagttcccgtatggcgagcaagccgtccaggcgaagggggagtgaccatggacttctggatcgcccttcccttcctcgaactcggcctcaacctcggcgaggatgaactgcgcatgttgtggttcagcggcctgacgatattcttcatccacctcctgaagcggtgactcaagtcatggccctggcgggcgaccctcgcctactccggggccatcgctggactcatcacaagcgagaactaaaccatgcaagctttgaataccctgttgattgcaatccccaaggacccgaccgcaggcatgcacgccgccgacaaggtgctgtgcgcccacggattccgcatgggtgacctgaataccgcgcacgtcctgaccccaggcgggttcgtggtagtgggcgccggcgtgactgtgaaccgctatgacgaagcgtatcgtatgagccggaacctcgactccgaaggcttcgacgtgctgctggtccagggcagcccgctgtccgggcgtgtcacctgccaggcgtacggatggatcaacgccgagtaccacaagggctgtgcgaatggccgtcccatcttcgacatcgcaggaacctcgtaccatgtcatcgcgtgacccgtaccgcatcggccaccgcgttgggctggtgaactacagcgaccgctacctgggtgccgacgcggcaggcaccaagggcatcatcgaggccataacccgaccgtcgcgctgtatgacggtctaccacgttcgctgcgagcggaccctgcgcctgatcgaggcagaggcccgcaacgtgcgattcatccgacagcgggcggagcggtgagctggcgcatcgtggtagtgacgccaggcaacgggtgcgccttcgtgtggacccgtcgcaagcgcgtccggcctctgagattctactcccgcaaggccgctaaacgctggctccgtaggcaccgccgcccggcgatcctcggtagccagtacctgatcgtgaactggagcaaacgtatatgaccctcgtggccaccgtagtagacagcgcgcacaacctggaagtcgacgacctcaccgccggcaacctgtatgccgccagctcgcccagcgggaacatgttcatcgtggtagtgggtaatcacaatgggcgcaggcttcccgtagtcctgtcatccaccgatacccgcaccatcggggacgtgataagcaacactgggttccggtacagtgagatcgccgggttctccgtaaacctggcacagggagattatgactgatggtcacccgtactgtatacgtcacgcctgaagacccgacgccgccgatcttgtccgtgggccgactggctccgggagaactctacaaggtggtggcacccagctcggcggaaggtatcattgtgctggcgaccaagcagacgccggcgctagcccaagcagccgtcgtactgcacagcatgaaccctgcgcagtatcccgcaggttcggctatcctcaacacggcctggaagtgccgccgcctgggagtgggcgagtacgtcaagctcgtccaaggggaggaggactgatggccgtggcaatactcatcctggccgtgtggttgatcggcggcgccctgctattcctgccgttcgaccttgtggtctcaccgcgcttgccgctatcagacgaggccctcaaccgaaccgcactgtacaccgtgctttggccggtaaccctacctaccctgatcgccataaccgtggttgtcatgctgcattccgcgtacaggggcgccatcgaactctaccaggagatgaaatcatgatccgtacccatacccacaacgtcgagcgcacaccgcaccgactgtaccggcacactgagctggcgtctggcgagctgtaccgtgtagtgcagcccgactccaagcgcggcacgttggtggtcggcgtagcggcctgggacagccagggccggcccgcagtgctgcccgtggtcatccatgacgatggtgacgccaaggtgacctgcgcacgtcctaccgtactgcgcaacgacgggtggcgcatggtcctcgccgacaaggggacccaggtgacactcaccgccgagtgaccaaggcgaaggctggtgcgccagccttccaccgtggccattccctgccgcgaaccaactcaactgaggagctacaacatgaccaacgtcaacaccaccaccgaaaccaccaccgctgctgtcctgggtgccaagctgatcaagaagccggccaccgtcgaggacttccgcaacaacgtggtcttccaccatagcgccctgaccaaactgaccgaggtctacaacgaagcggtcgccgccctgcaaaccgccgagcgcctgtccagcctcgtcgccggtgacgtgatcaccttcgaccacggcaagggcgagaaagccgaagtgctgagcggcgaagtcatcagcgtggtcgccggcgtctatcaggtgctggtccgcttcagcgacagcgcaccggccaagctgctggacgtgaaggccagcgccatccgcgccgtccagtcgtcggcagcccaggctgcaaccctcgacgaagccatcgcccagggcgagtaaggcccgcacgtaataggcccggccctccgggcctattgcgagctagccataccataggaggaatcaccatgagcaagcgcaaccccgaacacatcaacggcaccgttcgtagcgtcagcgtccagaagttggcggccacccaggaactggaggatcgtctggaggctgccctggccgtgtgccagcagcgggcagaggacatcgacctgctgagccgccgtctccaggccgccgagcgcgcccgtcgctgggagatcgacgagattcgcaaccaccaggcgaccatccgcctgttgcaaaacgatctgaacgctgcgcatgatgcccacgaggcacaagagcgccgcgctcgcaaggcaaccatcatggcctgggtatgcctgctgaccgcaggtttggccgtcaccctgaagctggcaggagtctgaccatgcagtgcaaagacctttacacgaacctcgcgtcgggcatgttcaacgtgccgtgctcccaggtgaccccggagatgcgacgggtagccaagagccgggcattcgcccacgcctatacgcccaagaaacaggcttcgggcgggacttacaccgcccgtgtgagcggcgtcacctgtgacggtggtaaggtggaggtgcgcctggataacgtggagcgcgtcagcaccttcgactatgccgagctggagacgcgggtagcggccagtctgtgccaggccgacgcgaagcgcgccgctgaatacgaaaagctactgctgaaagcgttcccgtcggtatccccgaaggatggcccgctgtccgccaaggacttcgaattgcgcctgcatgatctgtgctcaaccaagctggtagtgcttcgtgccttgcgtgatgccgggatagagatggacggtccgctgcgcagccgggtacggaagctggcggatcggaataacgtgatgggtgctgagttgttcagcctcaagcaggagttggcacaactggtcgcggtcggccaaaaggctggactgaattgggacggggcggagactcagcgcctgctgacggtggccccgaccaaggctctctgtcgactcatcagcgcgctgaccggcgtgcggtatacccaccacaccgtcgtagccaaggccgaggctgaggcgcgcgagcgggcaaaggccgaggccaaggattcattgcaggcggcaaccttcgcagccgccatcgctggtggcgtcgtcggcagcgccctgatgttcctgctcggctagggcgaccagggcctactccggggtcaaatccgagggcgttcctagagcgccctctcgtgtgagtctggaggatcacgaacatgcaataccacttcacgcattacaacggataccgcttcggcgtcgagctggaggacgaggctgtcttcccgtgcatcgacggtaagcgggcgacctgggacaaggtggcggcatgtgccggtagccttgtgcattacatggcgcaggacctgatcgactttggccagcgcaagttaagggagtttgaagatgagcaagacgagcctgtatccgctgaacctgcatcccggcctgattcaaatcaggacgattcacgtattcagcatccaagccccgagcaacgccgagaactggtggcagtggttcctctggcagcggaagtaccacccgctccgggaaagcctgagtccagccggggagctgagtgcgagtatcgccgagtgtgtgctccacctccgccggaatggctggcaagatagcgacatctggcgcaagaagggaggcgtgctggccctcggtgccttcgacctgtccggcctgatggtaggttcctgcctcgtagtaggtggtgagctgaaggccctgtgcgttgatgaccggcacagcaggcagggtatcggcgctgagctggtgcgggccgctgagctggctggtgccgagtatctgacctgcttcgagttcctggagccgttctacgccgacttgggctggagcaccacccaccgcgaggcgaactggacagcaggagagccggacgtgctgcacatgagggcacccggtcatgacgtatgaggtgatgacatggcttatcgagaacaaaccgctggtcatcggagtcgccttcagtctggtggccctgggcgtgctgctcacacagaacaacggcggcccgcctacggcgcccgcatgacctggcacctccaggacatgttcgaggcccgaggcgggctgcggcctttgtgggaggaatggtaccaatggcactgcgccgtgactcctggctaaagcaagcgcaatccctggcggtcggtcaggcgggtcgattccgccacgtcctgggatgccagagcatgagccggggcgggaccaacatgacctgcaagaaccttcctgaccgctgggtggcttactgctactcctgtcaggagggtggcgtggtcgagaaaacgcatgtgcggagggtacaatgcgcggatcaagaacgcttcatgccctggcccgaggatgcctcggactggacgcaagccgactgctatcaatcgctttatggtttgctgctgtccaagggcatagactacaacgtgatgacgccagggctgccgctgctgtacagcgaaaggcagcatcggcttatcttccctaccgacgcgggctggattgggcgcgctactgccgaccaaaatcccaagtgggtgggttacgggtatcctgccccggattaccatggatggccccaggaattatcaatgggcaggccatgggtgctgacggaagactacttgtcggcgctgaaggtgcggtgggcctgtcccgaagtctttgctgtcggtctgaacggtacaaggctgcgcgacaggctggcggcgatcatgttgcagcagacctgcaagcgcgccttcatcttcttggatggcgaccgggcaggtgtccgtggtagtgcaggcgtgatgcgccggctccggtccctgcttatcgaaggccaagtcataccaacgccggacgggttcgaccccaaggacctgacccgcgagcagataaggagcctagtaattggacgtattgacgcttcacgcactgagtgaccgggaccgcttccgcacattgcggagtgtggtgcccgaaggaatgatggggccggagacgtgcttcgtcatcgactggatcgagcagtattggaaggtctacccggcgcatcagaaggtagacccgcaggcactgcgcgaactgatcaagctgcgaggtggctaccagccggagcaactggcggtggtcctgaacctcgtcaaccaactggacaagccggtggacccggactcgctacagggcgtcgtgtcccagctcaacgaactggatttctcagggcgggtggatgccctcctggcgcagtacaaccagggcgaggacatcgacctggcgtatgagctgcgccggctgagcgacgaggccctgcgccgcggaggggtcagcacgccgaccgactacgtgacggacgacgtgtttgatatcctcgcggaggagcagggtgaccacggcatcaagctgccggggctggtgctaccggcgtacatgaagggcctccacgccggggcctcggtgctggtggcagcgccgccggatgcgggcaagacctcgttcatggcctggatcgctgtccatatcgcgccgcagctcaagcggtacttcgaccccggacgacccatcctgtggctgaacaacgagggcaagggccggcggatcaagccgcgcctgtactcggcagccttgggcatgaccgtgggcgagattcttgccctggacccggaggaagttcgcaggatgtacgccgagaaaatcggcggcgactctgagctgatccgcatcaaggacttccacggcgggtccctggcccaggccgagcaggtcattgacgcgatgaagccgtcggtggtgttttgggacatgatggctcacgtcaagggtggacagcgcaaggaccagaaccgcaccgacgagatggagtacaaggtggccgaggtccgcgagatggcggtgcgccacgacttcatcagcttcatgacgtggcagattagcaacgacggccacgaccagttgttcccaccgcagtcctgcctcaaggattcgaagacagcagtgcagggtgcggtagatgtgcaaatccacctgggccgtctcaacggtgcggatcaacaggtcatgcgtggcctgtccctgccgaagaacaagttccagatggacgggaagccttcgaacgtggaggctatgattaacttcgacgccgcacggtgtcgattcttcgagagtgtagaccatgcaagctaagcatagccgggtgctcgaaggcaccaaagaaattccgctgggtagcatcgagccgttactgggcagcgtcgcgggcctgctgttgtgcctgtactccgacgcaactcacgaggagggcgtcgccttggccggtgggttccctcgcgacttgatgcacggcgccactcccaaggacgtggatgtggccctgtatagcatgacctgggggcgggcagagcacctgatccagaaggcactcccggtcctgaaccccatcttcgtccgggatggtgggtggcgctcggactacgctgatggtggtgacggtggtatcttcaagggcgtgatgtccctcgtgggctgccgtgggttgaatggcatggacttggactttaactactacgacgccgacagcctcggtcgagtgatggagtcgttcgacttcaccatcaaccaggtaggcatcgcgtacaactggcccgaccccgagggtgggccgcgcctgggtgcgtacctgcacaaggacgttacctggggcgtgaacaaggaagtcggtgccggctcacgtctgccggaacgatgcgagaaaatgcgagccaaggccgcgtactacggatgggagaacgtgtgatgagcaagcgcgacgtggtactggatatcgagaaaggcatctggcgtggtgttgaccagaacgacaaggccgtcgaggccatcatcaagaagaacgggtacgtgatcgtcgagcctaagatcgacgggtgccgtgccatcgtcggtgcgcatggcgtggtgtcccgcagtgggcgccgcttcccggccctggatggcttggaagaccgcatcatcgagcgactggcccgaccggggctggactccggcctggtgctggactgcgagatgtacctggccggcatgcccttcagcgaggcgactggccgcatgtcgagtaagaccccgctgaccgaggaagagctggagtgcctgcacttcgcggtattcgacgccacccatatcgacgtgctccgaaaggcgcgcacctcacacctggtatacgaagagcgccgagccatggccagcagcctcctggcagcctgtcggctcagcgacactccgacgttcttccaggtggggttcaccgtctgccggagaatgtctgacgtttaccgccagtacaagttcaaccgggaggtgggctacgagggatcaatggagaaagaccccagcctggtctaccgcaacggcaaggtcgccggctgctacaagcgcaagccgggcatcaccgtagatggccgcatcgtcgggtacgtgatgggcaagactggcaagaacgtgggccgcgtcgtgggctaccgcgtggagctggaagatggttccggcaccgtggccgccaccggcctgagcgaggagcacatccagctcctgacctacgcccacctcaacgcccacatcgacgaggccatgccgaactacggtcgtatcgtcgaggtctccgcgatggagcgctcagccaacaccctccgccatcccagcttcagtcgcttccgcgacctggccagtaatccaggagtcaaggtatgaagattcgaaagtcccgtaaccgcaactacccggaagatatggtgtaccacgccaccaaccgggattcactgctgtatccgaagtacgtcatgggttccgtgttcatcagccaggacggaacattccgcatctgcgtcatggcagggacctgggaccacgttgggtccgaagttctgcatcatgcacgggacatccaatcccttggcgccggtcgccgtaagttgcaccgggtcatgcgacggctgcgccgcaatctgcaacaggtaggagtcaaggtatgagaatgccaaccgaagaagaacgcacgatccgctgcctgctggcagatatccacgaacccttgaacctgctgttccccggtatccgtgtaaaggccgagacaatgcccttgggctggggagatagtatctgtgccctggtactccgggtgagctacgaacatctcacgctggggcgcctggagtacatgcacgaggtccccatcctgcacctgtcgcagtggggccgggacggcctgctacagcacctgatgaacgagattccccgtcgggtgctggatggcatgctacgtcaggcacagaaatacagccagagtaactggtacagcaaatgacgactatccgaatcctcgacctcgaaaccgagagctacgagcacaaagggcgcaaggcgtcgccctttgacccccgcaactatatcgtcatggccggctggcgtgacgatgttgacggcaaggtcggccagaaggtggagcatcgcttccgcagccgggccgaagccgaagacccgaacaaccgctggttcaacctcgacggcgtggacgtgatcgtagcgcacaacgccatgttcgaatcgaactggttcttcacccgctaccgggacgagtacctggccttcctgcgacgtggtggccgggtctggtgtacccagcaggccgagtatctgctgagtcatcagacgtggctgtacccggcgctcgacgagctggccccgaagtacggcggcacccacaaggtggacggcatcaagatgctgtgggaccagggtgtgctcacctcggagatggaccaggacctgctgagcgaatacctgtctggcccgtgcggcgacatcgagaataccgccctcgtattctacggtcagttgatgaagctccaggcccgtggcatgtgggctggttacctggagcgctgcgaggccctgatcggtttctcggcgatggagtgcgccggcctgaaggtggacctcgaagtcgccaaggtgaaccacgccaagcaactggaagaggtggccgggatcgaggccgagctgaagaagctgatgcccgacttcccggaatacttcgagttcaagtataccagcctctaccatatgagcgcatggctatacggtggcgaggtgcggtacaagggccgggtgccctacgaagatggccggatggagaaagccgacttcgtgcgcttcggcacagccaagcgggggactcctatcgagagtacctcggtacgggtcccgatccacgaagtgaccgaccagggtgaatggcactggcccaccatcaccgagctggcgaccaagcacggtccggtcatcacgttctccgccggcaagaacaagggcagcgtcaaagtgttccgtgaggatacggacatcccggcgaccaagtgggacgatgaccagcgattccggttccccggcctgatcaacctgaccaacctgccggaagtagtgcgtgagaaattcctgggcaagcgcccggagttccagtgcgccctcaccctggcggatggatcgcccgtgttcagcaccagcggcgacgccctcaaggctctggagaaacagggcttcgaggcggccaagctgttgatgcgcctggccgagctgcacaaggacaactcctcgttctacatcacccacacctacaacaaggatgggacgattaaggacacgaaggggatgcttcagtacgtggacgatgatggtatcatccaccactcgctgaatacgacggcgacggcgacaacgcgtctgtcgtccagccgcccgaacctccagcagctcccgtcgaaggacgaggacgacccggaagccggcagccgcgtgaaggagatgttcgtgtctcgcttcggcgcagacgggatgatcggcgagaccgactataccgccctggaggtggtgatgttggcggccctgtcgaaggaccggaacctcctggcgaaactgatggccggcactgacatgcacttgtaccgcctggcagggaagcacaacaactggaacgggttcgactacgaccagctcgtggccatcaagaaggaccccaaccacccgtggcacggtcgcatgatgcaggctcgaaagaacatcaagcccaaggcattctcggcgcagtacggcgcgagtgcggctggtatcgcattcaacaccggctgtaccgtggaagaggcccaggaattcctggacaacgaggcggccctgttcccagagtccatcgcattccggcagatcgtccgagacagtgcagaggccaccagcctcgtcatgtacaaggccgaggaccagatgccggcaggcgccttcagcgagatggggccggatggcaactggcgccagtaccgccggggattctggcaagcgccgggtggcacctgctacagcttccgccaacaggagcgctgggacaaggaacagcgcaagacggtcatggacttcaaggacacgcagatcgccaactactggaaccagggcgaggctgggttcatgatgaccgtgagcgtagggcgcatcttccgttggatgctgcatcgcccaggattcatggtcaccgagttcctgatcaacaacgtacacgatgccgtgtacaccgactgccacaaggacaccgccgccgaggtcaacaagggcgtgcgcgacatcatggccgacgctgcccgctacatgagcgagcgcctgggctacgacatcgccgacgttccgttcccagcagtggctgagatggggccgaacatgttcaatatggaggtgatccagtgaaagaactgcacccgctgcacacgcctgagttcgtcaagacattcctggaccagaccgggtgcctgccgggagtacgccgtacgggtcgcaccaccggcattgctctacaggccattggcatggcgctgtcccatccgagggaaaccctgacgttcgtggaccacccggacggcagcgcggcagcactggtggccagcattgaaaccatactggcgaccctgggctacaagaacgtcctcgttcgacccacaacccgtgcggatgggcgcagcgtgagcatcgtcttcaagacgctgccgaacgcctgacgacccttccctactccggccttaaatcttcatccgacacgagagagaccacgcatgactcaacaactcaacgctctgcaagccgccctcgccctggccaacaaggctgccgagaccgcaaccatcgacatgtccgaaacctccaccggcggtggcggcggtcgcatcttcccggcgggcaccgccatgggccgcttctgcatctacatcgagctgggtgaccacgccaaggaattccagggcaagctcaagaacccggcgcctcaaatccgcctgggcttcgcactgtggggcgacgtgaacccgcaggccggtaacccgcagagccgcccggacgacctgttccacacttacgaggccgacggctcgatcaagcccggcctgttccgtaccttcgagatgaccctcggcaacaacgaaaagtccaagaccaagctggccttcgacaagatgaactggagcgggcagcatacccacttcgctcagatgctcggccaggcgttcatcatcccgatcaagcgcaccaagatcaccaagggcaacaacgccggcaaggaacgcaacgacatcgattggggcggcatcatgaagccctacaacccggtcgatggcagcccgtacaacgtgccggaactgccgatggacctgttgcagtatttcttcttcgacgcgccgaccaaggagacctgggacgccctgtatatcgagggcacctcggacaacggcaagtccaagaacttcctgcaagagaccattcgctcggccaccaacttccccggctcggccctgcacatcatgttgggcggcggcgacgatctgatcatcaagccaacgagccaggccgcaggcagcaacctgccggcagtgcccaacgtggccgccgatgcaggcgtagcagcagcccctgccgtcccggcagtcccgcaggcagtggctcagacggcccccagcgtgccccaggtggcgaatgtggctgcccctgtggtaggtactgccgaggcgcagaacgtgctgcctgacgtgccccaggtggctcagacggcggctccggcagcggtcgaagtcccggcggtcccggtagtgccggcagtaccgcaggtctaatgcgcctgccatcggaagagttcctggcaggactatccgcgcagttcgaccgcagcatggcaggcgggacgttggtgtgtgacgccgatggacccgcctacgtggctgcggccactgctaagaccctggacactgcactccgaagattctggaagctcattttggagcagcagttcctagcgcactgcacagggacacgggttcacctcacggcagcaggtggggcgaaggcgtaccgcgacacgtatccgaccatgaaaccgtaccagggccagcgcaagggcaaggcaaagcccgcgctgctggagccactgcggcgggccgtggcggacgtgcatgagcgaggcggggcgccggaggggatcgatgtcatcctgcacacgttcttcgaggcggacgacggcatgatgatggacgcctacgccatgcaggacaaggccatcatccggtccgacgacaaagacctgcggatgacgatctacccgtattgggagatcgatacggcgtgtgtgagcaggatcgaaggcggcttcggctacctcaaggaagcgtacacgccttccggccagttcaagctcaagggccatggacggaagttcttcttggcgcagtggctcggcggcgacaccgctgacaacatccgagggatcgatcgattcaacggtaagctctgcggtatgaagacggccttcgacatcctccatccgatcacggatgaggacgaggccatcgacatgatcctggaggcgtacgccaagatcaagcaaaacccgctggcagaggccgaggtgctgtggatgcgccgaacgcctaccgacaacgcagcgcagtacctgttaagccgcgaccttcgtccggccttccgccagtggatcatcgagctggacgcctaccacgaggcgctgctccagaagcggagggagagcgattatgacgagtgagccgaaggtctaccagataccgcgcagtcaacagcgcaccttcaccctgaagctatgggccgagcagaacaagctgtgcccgctctgcggcaagcccatcgatatcagcgtgaagggcgaagcggtgatggaccacgaccacgaaacggggctggtgcggggcgtcctgcaccggtcctgtaacaccgcagaaggcaagataacgaatgcggcaggttcctggggatgcaagtcgatgaagtattcagacatcatcccctaccttcgtgccctcctgacgtatctggaggggccgaagcatccgctgatctaccccctgcacaagaccgacgaggagaaacacgaagcgaagctggccaagcgccggcaggcagccgccaaacgcaaggcggcgatggccgtcgcaaagcacaacgcgaggaacgtatgagcaaactccgcaagcaattcaccaatgagtacctgcgaaacgtctatgtcgagctgggcctcaagaagggtgccgagcacctgaccgagcattcgcgcttcggtgaggtgagccgccagtgcttccgcaactggtgcatcaagctgggcttccacgacagcaggacgcgcggcatgtacgccaagaagggcgcgatgcactggctgggccgcaaggctgccgaggtagtgcgcaagttccctggcgccgtgggcaacgtggtaggccagggtccgaaggtgctgagcctggacatcgagacctcgcctatcgagggctgggtctggtcgctctggaagcagaacgtgggcctcaaccagatcaagcgggactggaccatcctgtcgttctgtgcgaagtggatgcacagcgacgaggtgatctacatggactgccagggtgatcccttggacgacatgcacctgctggtcgcgctgcacaagctgttggacgaggccgacatcatcatcgtccagaacggcaagcgcttcgacgtgcccaagatcaacgcccggttcttcctgaacaagatgccgccgccgcgaccgttcaaggtgatcgacaccttgatcatcgccaagcagcaattcgcgttcaccagccgcaagctggagtacatgacccacaaggcatgcaccatcaagaagcgactgcacggcaagttccccggattcgacctgtgggcggcctgcctccaggacaacccggaggcgtgggaagagatgcgcctgtacaacatcgacgacgtacggtcgatggaagagctgtacatcctgatgcgtccatggttcgtcggccaccccaacgtggccgtgtacttcaatgacgccgaaccgaccatccgctgcccgaagtgcggcgacacggatgttaagcaagaaggctgggtgcatacgcagaccggcaagtacgagcactatcactgcggtggctgcggtggctggagccgagggcggtacacccgcaacacctcggaacagcgcaaagccctgctgagcaactaaggaggtagcatgagcctagcattcccggactcttacgagtcgacgatcacgactgaaccgtaccgcaaaggtgcgagtctggaagaacgcaaggtcggcaagcttcccatgcacctggtagtcgaggggttcccgctgctgaagcgggagcttgctcgaatgatgcaatgggctgccgaggtcaaggggtatctgccgcacgactggaagaagatgacggtgggcgagttcaagtccgcccaacacaggcacgagtccaagcggctgatcgacgggccgctggatgacgagtccaacctgatgcacctggtgcatgaggcattcaacgcaatggccgccgccgaggtggccctgatggaccgggagaaaggcaatgagtaaaatctgttggtgtacccgaccgcacgagaccgatgaaggtgttcgggtcatctgggccttcaacgagcggggcatcggggtcaactacgtcacagcgtacatcacgccggcgatggtcagccatcgggactggagcgatgtcatactcccggacattctccgggagatggcggagcgcctggagcgggaagtgaagctggtggaactgcgctggttccgcgctgagattctgagctgcggggaatggcgtgactaccgagcgatgacgctggagggggcggttagcctggccgaggccgagtggggtcccgaggatatcgggcgcgtaatcgaaagacgataggagatggaatggacctgatacagcagcagatcgcccacgaagaggccctggtcggggcggcgcagaatgacgcccgcattgccttggaaaaggcgattgcccaagggtccatcgaccgcatcccgagggcgcgcatcatgttgatgcggatgctccccatcgtgaccgaagcgatcttcgcccaccaggaagcgaaggcggcggggccggcagcgaagcttcggcacctgctgcggatcatcgacgcccaggacctcgcggtcatggcgctgcgggctgggctgtcgatgctcatcaactacccaacgatcacagcgacgaagtattacacccacatgggtaagatactctgtcgagagatcgaagtgcggttggccttcaaggtcaaccaaccctattacgaccggacgctggactacctcaagaccagcaggactcgcagcgtccggcacatccagaagacgatggacgctcttctggacgcggtactaccggaagaggcacgtatcgacctgccggatggcgactacctgcgcctcggcaagttcatcggtgatccgctgatacagtgcggcctgttcgagccgaaccgcttcacaggtcgtggaggtactagcgtccacctggagccgtcgccggaagccaaggagttcctgcaagacccttcggcggcgatgacctggggaggcccaggccgtagcgtgatgctggcaccgccgcgaccatggaacgactggtgcgatggcggttactacagcgctaaggcgcagaaacaccatgtgctagtgcgccgtaccaagcaccagaccaagcgggcgcgccagatgcagctacgccacctgggccgggacaagatgcccagggtgtatgaggcggtcaacgcgctgcaatcagtggcctacgagatcaaccacgacgtgtacgagatcatcgagcgcgtcttcacttccggcggcggtgtgctgggcatccctcagcgcacctacccggacaaacctgagttcccgctcggcgacgagtgggccaaggagaacgccagtgaacaagagctggaagccttcaaccgctggaagcgatccgtccaccgatggtacaccggcgagcgggagcataccgccaagcttcgcgagtttgctgcactctaccgagttgttcgagagcatcatggcaaggcagtgtacttcccgatgcacgttgactcccgtggccgcatgtactattggggcacaccgaatccccaggggtccgacatcgccaaggcatgtctgcgattccacgaaaagcgtgccctcggtaagcgcggactgtactggctcaaggtccacgtcgccaactccctcggatgcgacaaggtgtacttcgacgaccgagcagcctgggtcgatgagcgctgggacgacttccagcgagcgctcgacgaagggccggagaactatccgaatctcttccccgaagacgagtccccactgtgcgccatcgcaggtctgctggagttgcgggcggcctacgcttccggcaatcccgagggctacgccagtggtttcatcgtccacatggacgccacctgctccggcctccaacactactcggctattctccgcgacgagatcggcggggcctacgtcaacctgctgccacctggacttgcaaaagctgatatctactcccgagtgctcggactcgttaatgagtctctggagagagaccgagcggaaggcgcggatggcgaggcgcggggttatgccattctatgggataaagctggtctgacgcggagcctgaccaagaagccctgcatgacgctggtgtacggcaccacgttcaagggcgtcgtggaccactgcctggactacctcgacgagtccggtgtggagattcccgagggtgtgccgtcataccgcctaggaagctacatggcgacgctcatactggacgcaatccgcgagacagtaccatcggcagtcttcgccatggagtggctccagcggcttgctagggcccttcctgacgcatccaaggatttgcactggaccacgccgctcggcatgcaggtcttccagtcctacccgaagaccgaggaggtgcgagtacggctgcgcgccgaggctgtcgagtacgtcaccctgtacgaggccaaggacgagctggacccggtacgcaacgccaacggcatcgctccgaacttcgtccacgggctggacagcagccacctgggcctgacggccttggcatgcgcggcagagggaatcccgatccaggccatccacgacagcatgggcacttatgcggcagacgtggaccggatgcacgttcacatcagggagcagttcatcgccatgtacagtggcccctgtgtgctcgtagagctggcaaagcagcttggtatagaggctaccccgccccggagaggatcgttgaatctggaggctgtacgggactcctgggcgttcttctgctgaggcggattatgtcacccacataggagcaagtgcatccgtccaaggccctcgtagagggagcgggggagaggagaggtcagggaagacctggtagaggagaggtgaagatgagaatggatgactacgaaggattctagatagaatagactaaccagcataggagatatgatagatggctactatgaagacccaccgccctacggttatgtcacccacagtggaaggatcgagaacaggcaagggtacggcccgtcctgtcacgttcacctctcagcagatcgagtggttagaacagaccttccccgaacatcagatcggtcctggaaccacgatggaagacatccagttccaggccggtaggcgagacgtggtgcgagcagtacgcctgcgccgacgcgatgccatcgcagtggagctgaagtgatgaacaagtccatctggcgagtccacgcaaaggccggcactccctcggaactccagggcctgtgctggctggcgatacaggagttggaggagttcaccctcttccgctcgaaagacgacgccctgaatgcgatgctggacagtatcgagggcaatgatcgaaccgagctgttggtattccgcgatggccagttggctggcggtgcctgcattgtgttcgaggacgatccccacgtcggcccgtgcgtcacagcacagtggcagtacgtcctaccgcgctaccgcaatacaggcgtggtccgggagttcatccgcgaactccaccgtcaggccggctggggtcaaatccccctcgtgtgctggagccatcgtgaaagcgatagccggtacacgatccactaccggagagccaagccttatgggcaagaaagtaaagaaggtgctgggcaagaccatcatcggcaaactcgctgatggcctgctgggcaccgacctgagcggcgcacaatccgatgcccgcaagatggaagagcagaaccgcctaatgcagcagcaggcggaccagctcgcacgaaaccagcaggttgacctcaccgccgagaacgtggcgcaggttgacctaggagcgatggccgatgccactggcaccggcacgcgacggcgccggaatcaggcgggcacaggcgtatcgcaaaccctcggtatcaactactgacgaggtacgccatgaaaaccaccgcagctatgctgtgggagaaacttcgggatgggagcgtggagagtcgagccatcgagttcgccaagaccacgcttccctacctgatggtcgatcccatgtccggcagccggggagtcgtagagcatgacttccagtccgccggtgccctcctggtgaacaacctcgccgccaagctggcgagatcgctgttccccacggggattccgttcttccgatccgaactcactgatgcgatccgccgcgaggccgacagccgggacacagacattaccgaagtgaccgctgccttggctcgggtggatcgcaaagcaacacagcgcctgttccagaacgcctccctggcggtcctgacgcaggtgatcaagctactgatcgtgactggcaatgctctgctgtaccgagacagcgccgccgctacggtggtcgcatggtcgctccgctcctatgcggtgcgtcgagatgcgactggccgctggatggatatcgtcctaaagcagcgctacaagtccaaggacctggatgaagagtacaagcaggacctgatgcgcgcaggccgcaacctatccggttcgggcagcgtggacctgtacacccacgtacagcgcaagaagggcacggcgatggaatacgccgagctgtaccacgagatcgacggcgtgcgtgtgggcaaggagggccgctggcctatccacctgtgcccgtacatcgtgccgacctggaacctcgcacctggcgagcactacggtcgaggccacgtcgaggactacatcggcgacttcgccaagctgtccctgctgagcgagaaactcggcctgtacgagctggagtcgctggaggtcctgaacctcgtggacgaggccaagggtgcggtggtcgatgactaccaagacgccgagatgggtgactacgtgccaggtggcgcggaggccgtccgtgcttacgagcgtggcgactacaacaagatggctgctatacagcagagcttgcaagccgtagtcgtccgcctgaaccaggcgttcatgtatggtgccaaccagcgcgacgccgagcgcgttactgccgaggaagtccgcatcactgcggaggaggcagagaacacgctgggtggtacatactcgctcttggctgagaacctccagtcgcccctggcctacgtctgcctatccgaggtggatgacgcgctactccagggcttgatcaccaagcagcacaagccggctatcgagacgggcctcccagctctgtcccgctccgccgctgtgcagagcatgctcaacgcttcccaagtcatcgctggcttggccccgattgctcagctcgatccccgcatctcgctaccgaagatgatggacacgatttgggcagccttcagtgtcgatacgtcgcagttctacaagagcgccgacgaactggaagccgaggcagaacagcagcgccagcaggccgcacaggcccaggcagcgcaggagaccttgctggaaggcgcttccgacatgaccaatgcactcgcaggagtctgatagatgacccaaccgaacgatcagcaactgccaccgggcctcgctaacctggttgccaacgtaccgcccgccgccgcgccgaccccgagtcatgtgcaggtgttgccgaacccggtgatccagccgcaggctccggtccagcccggccaggtaggtgcgccgcagcaactggccatcccgacccagcagccgcaacccgttccgaccagcgccatgacgccccactaccagccggtagcggtgcccgtcgccggtcaacccgttgttccgcaagcacccgctcagccggccccggtagctccgccggctgcgggtgcagttcttcccgagaacctggaagtcccgccgcctccggccttcactcccaacggggagatcgtaggcaccctggcagggaacctcgaaggcgacccgcagttggcgccctctatcagctatctggaagcattctctgacaagctggataccgtccgtgccttcggcaaggccgccgagaaccgcgatccgcgattcatcgacgagcactatctgaaggaagtcctgggtccggcccaggcacagcacgtcatcaacgtggccaagggcgtcctgacctatgtcgatgcgcagaccaaggccgtcctgaatcagacctatgccgccgtcggcggtgaggccgtcctgaagcaggctgccggagtcttcaaccagcacgctgacccggccaccaaggccgccatcggtcggctgatggactcgggcgatgcccaggccatgcagtacgcagcgaagcaaattgtggccttcgcacaaggctcgggtgccgtggtacaggctaccggccaacccctgggtgctgcggcacctgcactggcagctctgagcgctgagcagtaccgcttggaagtatctaagctgccgctgaacgcatccgaagccgagatggctgcgctgcgcgagcgtcgtaaggcaggcatggcgcagggtatctaacgaccctgccctactccggccttaaacccacatccaaaagagagagaatcgcatgagctttctgaacgacctgactcgtccgaactacgctggcaagaacgcggacgttgacatccacctggaagagcacctcggcatcgtcgataagcacttcgcctacacctccaagttcgcaccgctgatgaacatccgcgacctgcgtggctcgaacgtggtccgcctggatcgcctgggtaacgtcgaggccaagggtcgccgcgccggtgaagagctggagcgcagccgagtcgtgaacgacaagtggaacctgaccgtcgacaccctgctgtacctccgccaccagttcgaccaccaggacgagtggacccaatccttcgacatgcgcaaggaagtcgccgagctggacggccaggaactggctcgcaagttcgaccaagcctgcctgatccaggtgatcaaggctgccgcgatggacgcgccggtggacctggaagatgcgttctcgccgggcgtgctggagaaactggacctgaccggcctgaccgccaagcaggctgccgacaagatcgtccgcatgcaccgccgcgtagtcgagaccttcatcgaccgcgacctgggcgatgcggtttactccgagggcctgaccccgatgtcgccgcgtgtgttcagcctgctgctggagcacgacaagctgatgaacgtcgagtaccaggcaaccggcgcgaccaacgactacgtgaagtcccgcgtggccatcctcaacggcgtcaaggtgctggagactccgcgcttcgccaccaaggcaatcgcagcccacccgctgggccgtcacttcaacgtgagcgccgaggagtccgagcgccagatcgccctgttcctcccgagcaagaccctgatcaccgcccaagtggcgccggtccaggccaagctgtgggaagacaacgagaaattctcgtgggtcctggataccttccagatgtacaacatcggtgcccgtcgtccggacaccgctggtgccatcgaactgaagggtatcggcgccttcgacatcaccgcgtgatgccacgaaaccccgcacttcggtgtggggtttcttcaaagcctaacgacccgcgcagattccctgcgtgggtttttgcgctttaggagaaaccctatgctactactcgacgcagtgaatgtcatcctgcgcaagatcggcgagctgccgattccgagcatggatgagacgtatcccaccatggccattgccctcccggagttggaggaccagcgcatccagttgctgacgcaaggctggtggttcaacacctggtggaagcacaagctgacacctgacccgcagggtcgcatcaacctgcccaaggataccttggcattctaccccgactccccggacctccagtgggacggcctgggagtacgggatgccaacaccggcgacgaccgtatcggcaagtcggtcgagggtcggctggtgctgtcccgcgagtgggaccgtatcccggagattgcgcagcgcgtcattgcgcaccaagccgcccttgcggtatacacccacgagattggcccggacgagaccgcccaggtcatcgcccaggaattgcaggcgtatcagaacgaactgtctcgcatgcacactcgatcccgtccgctgaacacccaggccaagcgtagcttcagccggtggcggcgtagcttgaggacctgagcatgagctacaagcaatccgcgtatcccaatctgctgatgggcgtgagccaacaggtgcccttcgagcgcctgcccggccagctcagcgagcagatcaacatggtatccgaccccgtgtcgggactgcggcggcgcagtggtatcgagctgatggctcacctgctgcataccgaccagccctggccgaggccgttcctctaccacacgaacctaggtggccgcagcattgcgatgctggtggcccaacaccgtggcgagctgtacctgttcgacgagcgggatggacgcctgctgatgggccagccgctggcccacgactacctcaaggccgacgactatcggcagctacgggccgctacggtggcagatgacctgttcatcgccaacctgagcgtgaagcccgaggccgaccgcaccgatgtcaagggtgtagaccccaacaaagcgggctggctgtacatcaaggccgggcagtattcgaaggcattctctatgaccatcaaggtcaaggacaacgccacgggcaccacctacagccataccgccacttacgtgacgccggacaacgccagcacgaaccccaacctcgctgaggcgccattccaaacgagcgtaggctacatcgcgtggcagctctacggcaagttctttggtgcgccggagtacactctgcccaactcgacgaagaagtacccgaaggtggacccggacgccaacgcggcaaccatagccggctacctcaaccaacggggcgtgcaggacgggtacatcgcgttccgtggtgatgccgatatcgtggtcgaagtgtccacggacatgggcaacaactacggcatagcctccggcggtatgagcctcaacgccacggcagacctgccagccttactgccgggcgcgggtgctcctggcgtgggtgtgcagttcatgggcggcgctgtcatggccaccggctccaccaaggccccggtatacttcgagtgggattccgctaaccgccgctgggcagagcgggccgcctacggcaccgattgggtcctgaagaagatgccactggccctgcgctgggatgaggctaccgacacctacagcttgaacgagctggagtatgatcgacgtggctccggcgacgaggatacgaaccccacgttcaacttcgtcacccgaggcatcaccggcatgacgaccttccagggtcgcctcgtcctcctgtcgcaggagtacgtctgcatgtcggccagtaacaatccgcaccgctggttcaagaagtcggcagccgcgctgaacgacgatgatcctatcgagatcgcagcccaggggagcctgactgaaccgtacgagcacgcggtcaccttcaacaaggacttgatcgtcttcgccaagaagtatcaggccgtggtccccggtggcggcattgtaactccccgcacggcggttatcagcatcaccacgcagtacgacctcgataccagggcggcacctgccgtgactggccgcagtgtgtacttcgctgcggagcgtgccctgggtttcatgggcctgcatgagatggccccgtctccgtccacggacagccactacgtcgccgaagacgttaccagccacatcccgagctacatgccggggcctgctgagtacatccaggcggcggcctccagcggctacctggtgttcggcaccagcacggcggacgagatgatctgccaccagtacctctggcagggcaacgagaaagtgcagaacgcgtttcatcgctggacgttgcggcatcagatcatcggcgcctacttcactggcgacaacctgatggttctgattcagaagggccaggagatcgccctgggacggatgcacctgaacagcctgccagcccgtgagggtctgcaataccctaaatacgactactggcggcgtatcgaggcgaccgtcgatggtgagctggaactgaccaagcagcattgggacctgatcaaggatgcctctgccgtgtaccagctacagcctgtggccggcgcctacatggagcgtacccatctaggcgtgaagcgcgagacgaatacgaaggtgttcctcgacgtgcccgaggccgtggtcggggcggtgtatgtggtcggctgcgagttctggtcgaaggtggagttcactccgccggttctccgggaccacaatggcctgcccatgacctcgacccgtgcagtgcttcatcggtacaacgtaaacttcggctggaccggcgagttcctgtggcgcatcagcgacacggctcgacccaaccagccgtggtacgacacgacgccccttcggttgttcagccggcaactcaatgccggggagcctctggtggatagcgctgtggtgccgctgccggcacgggtcgatatggccacgtccaagttcgagctgagctgtcacagtccgtacgacatgaacgttcgggctgtcgagtacaacttcaagtccaaccaaacctacaggagggtgtgatggctttctggctaccactattggccgctggcggcatgtccgcccttcaacagggattggccaacaaggaagagcgcaacaagatcaaggccgagaacaaggctcgactgaagacggacctcgacaacctgggcgccgctgcccgcgacatcgccaacctcggagtcatggctgctagctaccgcaagcaagccgtggcctcgcaggtggaggccaagcgccaggggatgctagccggcggaagcgccgaggctcaggccggggcgttcggcgtcaagggtgcatccgtcgatgcggtggccctggatatcgagcgggaggtcggcgaggccctgatccagattgacgacaacctggacaatcagatgtggaacctcgccgagcaggcgcactccatccaggctcaggctaaggccggcctgctgggtcagaagagtaccacggcggggcaacggtccccgctggtggccggtctgatgtcggcgggttccctgtacgcaagtcaatacttcaagttcggcgccacgcctaaaggaggcaactgatggcggaatcgcaacgtgcttcccaagagcttgggatcaacgtcggacagacgcaactccagccgggccagagtgctcggcgcggagtgcgcgactccgaggtcaactacagcggtccgagcgtaggctcgcagattctcgacggcatcctgggtgccggtcagcagatcgctggcaaatggttcgagcacaacgtgcagcaggaagttctgcgcggtgagcgtgcccgtatggccggcgaggcggaggaggcagtagacagcaacgtactggccaaaccattcgtgaagggtggttggcgtaagcaggactaccgtatcgcccaggcggacttcagcctgaagatgcagcgattcatcgccaacaagggccgggagatgactcccgaggagttccgcaagtacctgtcccaggaggctacgcacgtcctggactcgaccgagggcatgaaccccaacgatgccttacaggcgctggcgcagcagcagaaggccgaggaacagctcttcggcatgcaggctaaggcgtacatggactggtccatcgaccaggccgcccgtggcttccgtacccagggtaacagtatcctggccaaggctgtgcaggctcaggccaccggcgacgaactgtcccggcagctcagcctggaagaggccggcctgttctataccaacatcatgacctccgaggatatcccgctggaggtgcgcgacaaggtaggcatgcagttcctggcggccagcctggacatgaaccagcggggcatctatgagggcctgcgcgatgccgggttcctggacagtatgtcctttgacgaccggcgtgcgctcaacggcctctatgaaaaatcgaaggcacagacccgtgccaaggaatcgatggctaccctgcgggccgacgcggacttccagcagcgggtggccaacggcgccatcacagaccttgccgaggttgaagcgtactcacgaggcatggtcgaggagggccgctggagcgacgctcaggccatctcattcatgaccaaggccatgaccggtctgggcaatgcccaacgcatgcagggcatcatggcggccctggaagcgggggacatcaacgccctacacacgctggggacgaacgttactgaggccctggagcagtgggacaagatgcaggccgccaacggctcaagcctgactgaccgtctcgtgcagggcacacagctcggcctgcgcctggggaccttccccaagacctacggcgagtccgtgggcagcgcggtgcgcatgatccaggccgccaaagaaggcgaggcaaacccggagctggtcaacacgctgaacagcatcttcgagcaggtggcctcggcccaggagatcaacccctccgccggcaacgtgatgctatccggcatcccggaagccgagcaaggtgccgtggcctgggcactcaagcagatgaagatgggcatcgcaccagctcaagctctgcgcgagttcagcgccaacgccgaagtcgtgaaacagatggacgagttcgagaaaggccagaacaccaaggcattcaaggacaacctcggcaagcaggtcaacgacaagttcgtgaacaacatcttcggtcgggcctggaacatgctgaccggtgaaagcgacctgagtaacaacgaggccgttctcagcatgtaccgtcgagcaaccatcgacgaggcgaactggctggccagcgaccgcaagcatgcgggtctgctcaccagtgacacgggccgcgaggccctgctggagatcgccgccgccaacgtgcgtaaccgcaccatccaggtaggcgaaggtcggaatctgaaggaaggggacctattcagccgccgcgatagcgcgccgctgatcctgccgcgtggcaccaccgccgagcagctattcgggaccaacgacaccgagaccatcggaaccgtcctggccgagcagcacaagccgcatgtcgaaggactcctcggctacaagtcggtagtcgccttcgagtacgaccgcaccaggggcagcctcctcgccgtcgagtacgacgagaacggtgtggccctggaccgcacgcgggttgatccccaggcagtcggtaacgaggtgctcaagcgcaacgcggataagctgaatgcgatgcggggcgccgagtacggtgccaacgtcaaggtcagcggcacggacattcgcatgaacgggggtaacagtgccggcatgctgaagcaggacgtgttcaactggcggaaggaactggctcagttcgaggcttaccgaggggaggcgtataaggatgccgatggttatagtgtgggcctggggcattacctgggcagtggcaatgctggggcaggcactacagtcacgcctgagcaagccgcgcagtggttcgccgaggacaccgaccgcgcactcgaccagggtgtgaggttggccgacgagctgggcgttacgaacaatgcctctatcctgggattggccggtatggccttccagatgggcgaaggacgtgcccggcagttccgtaacaccttccaggcgatcaaggatcgcaacaaggaagccttcgaggctggtgtacgaaacagcaagtggtacacgcagacgcccaaccgggccgaggcattcatcaagcgcatggcgccccacttcgatacaccgagtcaaatcggtgtcgattggtacagcgccgcaacagcggagtaagacatggcaaagcaattcaagggccgcatgacgcccaagtatccccttgaccaagtacagctcgacgaggcccaagtacagggccaactcgacgcggtgcctaccgtggggttcgacgccctgacgggtggtgagatcggagaacggaacgtggcagcgggccaacgagccaatgcgcgggaactggaacgcatcgtagcggaccaggaactgccggcccttgaccgtgcttccgcactctggaaccagtccaccctcgtcggacgctgggtcgatgcgctccagctcgacgcagaccttgcggcgaacagtaccggcgaggtggaccctaacttcgacgctgggacctatggggtccaggcgctccaggcggcaggtatccagccgactgataactaccttcagatcatggcccgtgccggcaatgccgaggacgcggcctacctcctatcgaggattcaacggtatgagcaggacgaacaaatcgtgcgggacaacccatactggaacttcgcggttggtatgctggacccggcagccctggcagttgatgcggttactttcggcgctggccgtgctctgcggctcggtcgtgctggcatggctgctgctggcggcgctgggcaagtcgggtatgttgctgggctggatgccgcaggggccgatgtggatgctggaacctacatcgtggcgggtgctcttggcgctggcgtgggtgctctgctggggtctggtgcgggacgcattgccgcagaggccccaacgcaaccgcatgtgcccgaagtatcggcgcctactgtcgggctgccagaagtagccatgaccgccgaggaggccgcagcacgcggcttcaaggcaggtgacgtggtagacctgctggacgagggcactgtgctatcccgtgtcagtgcccgcgtggagcaggctgagataccggctattccgcgacgtgacactgccttcggcgacgagctgcatagcctgtcgggccggaagctgtctgaggtcctggaccacatcaagacccacgcagaggtgcccaagccgctccagggcatcgccgccaaggtggctgacactatcaggaccctggagggcctggggcagcgtaccgcgttccgtgtggtgcagggcggtgacactgccagctctgccttcctcaaaccgggtacggcggggattcactccacccagggcctcgacaccctggtccaggtacgcggcagcaccgcacctggtcgagttggcaccaacccggtgaccgtgctccacgaggcggttcacgctgccaccgtgggcgtgatgaacgccgccctgcgcaaccccggtgcgatgagtccgaaggtggctcaggccatgcagaccctggagaatgtccggggtaacgtgctcaacgccctgaagcaggaccgcgccgccggtcggcaactgtccgagttcgaagagacactgctggccggtaactccaacaccctggccaacgtcaaggaactggtagcctggggcctgacggatacccgcttccagcggaccctgaatcgcctccgctacagcgacggcgggccgggcctgtggtcccgcttcgtggagggcatccgcaccctgctgggtctgcggtccgatgctgacacggccctgagccgcgtcctggccgcctctgagacgattatggaggccatgcccggttacactaaggcacaggccaagtgggccaacaagggcgctccggtaaccgaggaggccagcctggagaccatcgtccggtccaccagggagcgcgcccgcgagggtgccggcttcgtgaacaggttcttcagcgaggcagacctcctggcacagcccggagagggcgcacggcgactcctgagccgtcttattgacgacccggtacgtcgggatgggttcagcacgaacgacaacgcagcgagctatctccgccgctatcggaacgagttcgagggctacgtgaagtcctacgacgagatgatggccaaggcaatggctgagcagggtgtgggcctgacggcacgtgcgctgaactcccgccgcgccatggcagtccgggaccagctcaacgagcaggtcacccgcgagctgctgcgccgggaccgggagtggaccgcctacggcagcgtccgcgtggaccctaacctacctccgaccatcaaggccctggccgaccgctcagacgagattcatggtctgatgggccagcgtgccagggaagctggggtgcgcgggttcgagaacttcgcaccgcgaccgggatacttccaccgctcgtggaactggtcgaagatggcgcagatggacgaggccgcccctggcctggcccgccgtgccatcagtgaggccgtgttccgtggcatccctgggctggagcgcgccgacgccgataccatcgcacaggccattgtgcagcgggcgcgggatcgggccaccggaatccgctccgagttcatgggcgcgatgggcgtggcggacacggcattcatccggcaggcgctggaggaggccaacgtgtcccaggccaagttcgacagcatcatggccaagatcgagcagaagcagtccgaccagggcaccgtcaagtacggcaagggccggctgtcgctggacatgaccgccgagatcaaccacaacggcaccgtgtatcgtgtgcaagacctgatcgaccgggacctcgaccggctgatggagaactacgccggcagtatgtcgggccgctcagcattggcccgcgcaggcatgccgggggactcggagatcgaagccttcatccgggagtaccagcgagaggcagcccacctgggcaccgataaggtgcaggagctgacggggcaactgcggggagtcttcggggacttcaccggcaacgtgccgagggagcatcagctcggcccggttgctcagcgggccagcggcctaaccagcgccaccatgctgggattctccggcgtgtaccagctcgccgaactggccacgatggcgcaccgtcaaggcgtcttcaacgtcatgaaggccatgctgaactcccgcctgggagacttcgtgggcgccatgcgtcgcgacccggacctcgctgacgagatgcagaccgtcctcggcctgaacctcgccaacgatatccggatgaagccctggaagcggcagttcgacaccttcctggtcagccaagacaccttcatggatcgcttcctccacgcaggtaagcaggctgtcccagtgctcaacggcatgaagttcatccacaactggcaatcccgtatgaacgccaacctcaccttgaacaaggtggcgcgggcggcgcagggggatgaagcagcccttcgcgtgctccagcagtacgggaaggacgtggactggacgccagtcctggcgcgggttcgcggttatgtcacatacagaggaaggaacgcccgatccatgaattggggcgcctggagccaagcagacgtgaacactgtcatgaacaccgcactgcggatcatggacgactcactcctgtacggtagggtcggtcagaactcgggcttcgctcggtctccggtcggtcaaatcctgggccagttccgcagctttgtggccttcgcacacaacaagctcctccggggaacctatgagaactccggcgtgcttggcgtggcctcgctcctcgcattccagtatccgctcaccgcgctgatgatgggtgccaaggcagcgatcaacggcaagttcgacacctctgatgaaggcatccgcaagatggccatcgacggcatcggttacactgccggcctcggcttcaccgccgacatgtggggtgtgatcaccgggcactcccggatgtccgcaccggtctttggcctggcggagcactccaacgaggtgttccgcggcgtcaaggacctagtaaccggcgacgaccccgcagccgccaccggcgatatcgtcaacggcgccgcaggggcactgcctttcgtcaacgtattcccggcgaccaagttgctgctggaatccatcaaaggggaataacgtggctcggttcaagaatcccgagaccatccacgtcgcagatggggtcgaggctgtcttcagtctcgacttcccgttcctgcggcgtgaggacgtattcgtccaggtcgataagatactcgtcaccgactatacgtgggtagacgacaccaacattcaattggccgtggtgccgaagaaggatcaagaggtccgcatcttccgcgacacacccgcccaggtcccggacactcagttcagccagggcatcccgttcctgcctcgatacatcgacgcgaacaacaagcagctcctgtacgctgtgcaggaaggcatcaacaccgcgaacctcgctctcgacggcgtactcgacgcgatccgcatcgccgaggaagctcgtcgcctggcacaggaagcactcgacgccgccaatgaggcgctgcgccgtgccctaggcttcgccgagattcgcaccgtgaccgaggactcggacatcgatccgagctggcgtggttactggaaccgctgcatcacctccgagcagtccctgactctgaccatgcagatggaggacccggacgagccttggatcgagttcagcgaggtccacttcgaacaggcgggcattcgcgacctcaacatcgtggccggccctggcgtgaccatcaaccgcttgcagaacaccaccatgcagctctatggcgagaacggtgtgtgtaccctgaagcgcctcggccctaaccactggatcatcttcggggcgatggaggacgactaatgcgtggcattatcgcaggtgtggtggcgtcgcagattcgccggcccaagccggtgctgaccaccatcacctacccgcagtcttcctcggatcgtgggggtatgacgtttcatgccatcgccgggatcatccaagataccgtgaagttcgcggatagtaaggacctgggtagttatgagatgcttgtgcgggacgctaccctgaagagcatggtcattacactcactgaggttaaggacagtagcgtctggagtatgggtgtgctgagtgcggcaatcaaatccgtagttcagttcttgacaccagtcgaggagaaatcctcgttggatatgagcatcatccacggcgagcacaagcaatcggtcattccatactcccgctgggctgaggctgggtccctgtccatgggtatcacagagggtaaagtttatgtaccatagcagcaccattcgaggtgagttcgatctggagattgtacgtcctgacggtacagtccgccagcacctgcacttcaagaacctgatcaccgacttggcccttgaggccatgagttccaagggcgtcccgagtggcggctggacgaacatgttcgccggcactggcaaccgtaccccggtccccgctgacgtgtccctcgtggcgcctgtggctaatgccagtgcctcgctgaactacggcaaccgcgcagtgtgggattccaccactggcgagaaagtgcatactggcacggggaccttccgcgcaggttccttccaaggccagtccctggccgaggtaggaatcggtcgggtagtctctgagctgtactcccgatccctgatcaaggacgccaacggcgatcctaccacgatcacggtgctggtggatgaggaactgcgtgtgacctacactctgcggattgctccgccggcgtccagtgaagtcaagatcacgatgaagggtatcgagtacaccctgagcatgcgggaccgccgtaccttccgggacttatcgcccgagcctgcggctgagtttggcactcgcggcagtctgtcgtggagcgctatcagtgcgccggacagtaacggccagaccaagaccgccaacttgagcggcgacgccgggaccgggattatccaggttcctgcacagtctgcacagatcatgcgtatccagcccgccgatgccaactggacggaaggtattcagtacctccgctgggagactccggcaggacgtgagctggagatcaagctggacccgcctctggtcaagaacagcttggagcgcgtggacatcaccgtaacccacatcttcaatcgggtatgattcagttcaagttcggtgactaccggacccgtgtgcccttccagggtgcgcgggaccggcgggatatcaacgaccgcagcgactacgtggacggtggcgtcgccatccaagaccctagtcaaggtctgttgtatcaggagtggcacgccgagctactcgaagacggcatctacctgacacctgagaaagagcgagtgactacccgcatcggaccaggtatcaatgaaggcgtggctagtatggcggtcacgttcgaccagaacatgaactatgtcctggtgtataccaagcaaggcgaaggcttcatcgacttcttcgattccgctaccgaagagcgcaatgtgatgaaccttgggccggtggactatatcaagacagacctagacgatcggcggccagagggcagcgcctgggcgcaggttctggtctgctacacacggcagggaaacttctacgtccgagccagctcaactcgctttactgaagaggagcttatcgtcggtacgggcaaagtgacccggcctatcgtcaaatgcggaatggcagcgaactggagattccaggtcctgttccgagggagaatgtaatgagcaagaagcagaccgcgagtgctgagcggctgggcctgctacatgagctggtctgcaccgccatcgagcgtaacttcaagtggtacatggacaacgacatcccgatccccgcatcggatatcgctgccgccaccaagttcctcaaggacaacgagatcacctgcgatccgtccgacaccatcaacatcgaccgcctccgcgaggagatgcggcaggcgcaggcggagaatcgccgtatcgcgctggagggcttcatcgccggtgagacggacgatgagatggaacgcctgtacacccactaaggaggcagcatgacgccgcaagaacgattccagatagcccacgaggtgcgggacatgtacccgcgcttccgggacttctgcctggacgccatgctgttcctcggcttcaagatgacgtggatgcagctcgacatcgccgacttcatgcaggactcgcccaacaaggcgatggtcgctgcacagcgcggcgaagctaagtccaccatcgcctgtatctatgtggtgtggtgcataacgcagaacccggctacccgcgccatgctggtatccggttccggtgacaaggccgaggagaacggccagttgatcacgaagctgatcatgcattgggacctgctggcgtacctgcgccccgaggcccgcatgggtgaccgtacctcggccaccagcttcgacgtgaactgggcgttgaagggtgtcgagaaatcggcctctatcaactgcatcgggatcaccgctgccctccagggctaccgggctgacatcctgatccctgacgacatcgagaccacgaagaacggcctcaccgccaccgagcgggccaagctgacgcggcagtcgcaggagttcacctctatctgtacccacggtaagattctctacctgggcacgccgcagtcccgtgagtcgatctacaacggtctgccggcgcggggcttcctgatgcgcatctggccgggccgcttcccgaccctggatgagcaggaacgctacggtgactggctcgcaccttccatcctagcgcgcattgcccgcctggaggagaaaggccacaacccgcgtactggcaagggcctggatggcactcgtggctgggcggctgatccgcagcgctacaacgaagaggacctgctcgacaaggagcttgaccaaggccccgagggcttccagcttcagtacatgctggacaccagcctcgccgacgagcagcgtatgcagctcaagctgcgcgacctgctgttcatcgacgccacgcatgagagcgtgccggagcaagtggcctgggctgccgacgagcgcttcaagctcaagttcgacgcccaccgattcccggtcatcaagcctgagctgtacctgccggcgctgatggctggcggctgggcaccactccagcaaatgacgatgttcgtggaccctgccggcgacggtggcgacgagctgtcgtatgccgtgggcgggactcttggcccgtacatccacgtcgtgagcatcggcggctggaagggtggctttgctgaggagaacctggagaaatgtattgccctagctgcgcgttatggcgtcaaggtgatctatgtcgagaaaaacctcggcgctggtgcagttggccagctcttccgcaaccacatgcgatccatcgacccggacaccaacaagccccgctatgaggggatcggcgtagaagaccgccagaagtccggacagaaagagcgtcgtatcatcgacaccctgcggcccatcatgcagcggcaccgtctgatcttccacgtatcggcgatggattccgaccacgtggcctgccagcagtacccagcggacaagcgcaatgagcgctccgtgttccaccagattcacaacatcaccaccgaccgaggctcactgccgaaggacgaccggatcgatgcccttgagggccttgtccgcgagctagcacccacgctcgtaaaggacgacgaagccgcaacccgcgctcgtgaagaggctgccaagaaggaatggctgaacaacccgatgggttacactaagtctgtccttcggtctctcggcatgggccgggagcgtcgcaagggccgcccaaaaggacgaagactatgatgctcgataccgccaccgaggcgggcaaaggcaccctcgccgtcactggcgtggggatcgccgtttactcgccctatgagatcgccagcctctgtgctgcggtactcaccgcgctctatgtgggcgcccagctcatcaccctgctcccgaagatgctcgatagcatcgcggagcttcgccggaggttcaagaagtgaacaagcccctgcgcggcgcagcccttgcggctgccctcgccggccttgtcgccctggaaggtagtgagaccactgcctaccgggacatcgccggcgtgcccaccatctgttctggcaccactgccggggtcaagatgggtgacaaagccacaccggagcagtgctaccagatgacgctcaaggactaccagcgcttcgagcgcatcgtcctggacgccatcaaggtgccgctgaacgtcaacgagcagaccgccctgacgttcttctgctacaacgtgggtccagtctgtacaaccagcacagcgttcaagcgcttcaaccaaggccgcgccactgagggctgccaagccctggccatgtggaacaaggtcacgatcaacggccagaaggtcgtatccaagggcctcgtgaatcgccgcaacgcggagatcaagcaatgcctcgaaccatcgtcgcaatactcgtccttgctgtggtagccctgggagcctcatacggcttcgtccagagctaccgggccttgggtatcgcccaggaggagatcaagcggcagacggcccgtgcggaggccctggaggtgcgttatgccaccttgcagcgccacgtcaaggaggtcgctgccaggaccaacacccagcgccaggaggtggaccgtgccctggaccagaaccgcccgtgggctgaccggcctgttcctgctgctgtcgttgacagcctgtgcaaccgccccggcgcccgctgtgctgtgcgaacacccactgattgaccctaccacccaggctggcctgatccgcgctgtagcggcctatcaggacgccctggacctatgcaacgccttgaatcaaggagactgacatggcgaacacccgtgagcaatacctcgctggccgtaacaccggcctgaccttctaccaggtctgccagcccggcaccgacaaccgcatcgccctgcacgacatggacgaggccgatgtcaaggccaaggccaccgccgtaatcgcagcagccaccgccctgggcggcgaaggtggcgctactccaccggacccgctcaccgcctacaaggtgaagaacggtgacaccctgcccgtggacggcggtggttccgtgaaggtgaccgtagccaacggtgctatcaccaaggtcgtgtacaccgcaccggcgggctgagctacagcccgtcccacctgactccatccctaacacaaggaactgaaccatggcaaccttcgccgctgcaactcagaaagacctccgcgccttcgccggcgctatcgagaacctgatccgccctctggaagaagcggccttgggttccggcttcaccgaggtgatcaccatcaccaagggcaccgatggcaacgagactcgcacctccgagcgtaaggtacgtcccgagctggtcgctaacctcgacgccctgatggccgctgtcgagaccgccaaagccgccgtctacaagtaaggggacaccatgagcaaagccaaactacgagtcatcgccgacaccccggagctggagtcagtgctaaaagcattgctgaccgccacctacgctatcgagga

SEQ ID NO: 5 - protein, 62 aa, Unknown
  Description of Unknown: Bacteriophage F391/08
MKRFVISSKPAAKLNKMASSELVKMQRDMARRYRSYQRGGQQGLPMIWDNMMRYLKSLQNNV

SEQ ID NO: 6 - protein, 86 aa, Unknown
  Description of Unknown: Bacteriophage F391/08
MQNVKTPMIGDSVFIPFVTGDVSKPGENEKIGYIKGAAMIPFDKINAVYAETEKAKNSDAKIYSVRVDSGDVVKVIRKDDKWLAVA

SEQ ID NO: 7 - protein, 134 aa, Unknown
  Description of Unknown: Bacteriophage F391/08
MTATKTEKFAWNETNAATAVEMYEKIIASDGLEVANSQGLIDIAKAVGAESHVKVRSKLVSAKVYQKSDKPRKVGGGSSLRKAHYVRVLTQHAIADGLIDDADGLASLEQMKLDQLDVIARMVGVQDEVKESAE

SEQ ID NO: 8 - protein, 89 aa, Unknown
  Description of Unknown: Bacteriophage F391/08
MALIKGSVIKLTGTVVDELIQTGYQDNKVMTPPSVKVPEYIVLWVNPDADTFGMAINREVFKPEMLELSSREIYLLNYAFSVEEKEVVK

SEQ ID NO: 9 - protein, 75 aa, Unknown
  Description of Unknown: Bacteriophage F391/08
MIFFPTESLILIAGFFAAACLYGYYNFMEIGSEQTDLLRRDFWFKKASICRRWSIIFIILAVTFGISASIIPAIV

SEQ ID NO: 10 - protein, 558 aa, Unknown
  Description of Unknown: Bacteriophage F391/08
MIIAIEKQKAILTAANNLNFWGKRLRAKKLEICDELSKEHYGTAKHSSEICDWLDSNKPVKPAAEKRAQRVAVEDSRPVAAGQLNSSVESWKVIPGRRFLLTSIQNNTFPHANFWKTLQEAAKYLGATLLVSKYAYNKKGFQNGQGNDELKYDDAFSDFICDENVFLGNRETGFAFMAEINILPTADFPLSGFGETATAYGLKGLAIGHAKITAESVPAMKGDTVRRMYSTGTATLKNYIQQKAGQKAEALHNYGALLVEIDDNGNFFARQIETMDESGMFYDLNHKFTVNGGEEVTGHVAALQYGDIHAEKLDHAVAFASWGPCDDSLVNVLRPRYQIVHDVHDFTSRNHHNRASGVFLAKQYAAGRDKVIDDLIDTGRVLEAMEREFSQTVIVESNHDLALSRWLDDSKANIQQDPANAHLYYRLNAAIYEAIENKDDTFNVLDYALRNVAGCDFAAIFLTTDESMKIAGIECGSHGHNGINGARGNPKGFRKLGKMNTGHTHTPSIYGGVYTAGVAGSLDMGYNIGASSWSQTHLITYENGQRTLIDFKDGVFFA

SEQ ID NO: 11 - protein, 150 aa, Unknown
  Description of Unknown: Bacteriophage F391/08
MKLTFIYNNRKSFTASNVVENSLVISRDSEGRPHVSYQKVNTVDGDTVLKALAAILPRPAEFKESGIVSQLVAADSILYEADICEIVEIDAAAAGLMFIVVSENDYDDTYLLGDVMDYSSSEYTPPLAIVPVMATRIKPAELADALTLFF

SEQ ID NO: 12 - protein, 238 aa, Unknown
  Description of Unknown: Bacteriophage F391/08
MAFNKLAIKAIKLWDLDGTVINSFARVFPCMDDKGNLDLNMYREKACVHDAIMTDTLLPLVEYMRASLNDPTVLNIIVTARYMGKSDYYFLRKQRIRAGRGGNIQILSRDVLHRYIGDADYKEVYYSKDGIYKTHYFEMLKAEYPNATITMIDDNRGVLAAAAAAGLQTMDATAINDILSIGVRLAGESFIDEALDDDNDYQYLCERLAHCWEGMTEEERSDYGIKPQQFIQSLAIAS

SEQ ID NO: 13 - protein, 153 aa, Unknown
  Description of Unknown: Bacteriophage F391/08
MTIVLIFTTFFFLAAVWFGVRAHDLRNAVVAADLRNKSLHQEILQTRAERQVAISKHQRVMNDLRNDPSNPYYIPPVTPQVAKRKQKRAGSDNSRKVSGSPSSNSGSSRSDDGSTAAIIATTAAVATYSGYDSGSSYCDSGSSSSSFDSGCSF

SEQ ID NO: 14 - protein, 74 aa, Unknown
  Description of Unknown: Bacteriophage F391/08
MEVVIGALVLLSIVLFVITVKQGKAIKQLERTNGVLQKSYDNQTRLLHKAQLNLSECKAELESANKIYITKGMV

SEQ ID NO: 15 - protein, 658 aa, Unknown
  Description of Unknown: Bacteriophage F391/08
MGFYAGRIGDKKVLSLTSGNNKDVNNHTNPGWDTIFHSDMPHVVVLETHERDLWDGGDWYRCTRMPDRIIQVLSADYDRVVLTEVEFEDGTRRFIYGTSLGVGAKAYNAYFSNTVGSQASAGTMASMKTNVCASADLHMDISFYFEETPGTINEKLRDGTGCMYTWGVNSEWGDRGPGPPVGAPIRPNFETIIKAGWVLYRGAFSGNIAGSVSPPNRPLTIGVDAMRHPWMRTTGVNSICLRGETLNRNMYGHMGPRYGQSSNPVGGPYAHNIQTESYQEVQYKAGFFRGPPNNFMGWENTDNNNAGSGWGNNAIYRDNNFRVPKRVRWYITNMKYNGQGFYAENVFGSRNQEIKISPREFIVNGINLMNTGWKFINQNDINYSPGNRPDIRVIATNVARFSGNPTVGNNGYVHFNQPLTRPDNGAEFGQGNVSEMHVTTVGVYNFRSDAQWYVKSNPPEIGNQWGPVWSESTRPLRLVGGTGSADIGGNLRTSGNASHHLATLWLGVNNSRNGACVVTLDWKNDEWIAAAGIGCYNPLEDLTQWSEVDSRLRIFGNHFQKRVHQIMCLPVNMCVPFHFIRGTVTQCGVIPGNNAMQMKAMWAPTTTNSATQGDYAIIYWLIARADGSVEVWVNVEMSNIMNMRVILPEVRIAVQRLA

SEQ ID NO: 16 - protein, 157 aa, Unknown
  Description of Unknown: Bacteriophage F391/08
MSNDLIVPDTMSPEGMLVIEAYLESGSDVAKAALAVGMEEPKFREIMRKPEVKAYLTDIFMESGFRNRDKFFGILDTVLTMKMEELDETGMGSEMDIMDILKLMHKMKMDEMKMQIEYEKVKQAKAPIHQNNTQINLAGGHDSNYTDLLSRIVGAGK

SEQ ID NO: 17 - protein, 438 aa, Unknown
  Description of Unknown: Bacteriophage F391/08
MEISRSYINTTDVVDFGVDKRFFKFPVSGLLATEGIVPNGPQCAIINALEDPRHRFVTACVSRRVGKSFIAYTLGFLKLLEPNVKVLVVAPNYSLANIGWAQIKGLIKKYGLQTERENAKDKEIELANGSLFKLASAAQADSAVGRSYDFIIFDEAAISDVGGDAFDIQLRPTLDKPNSKALFISTPRGGNWFKRFYEQGFREDLPQWVSIHGTYRDNPRVSLADIEEARKTVSKNYFKQEYEADFSVFEGQIYDTFSVSEHVQDLAGMGHFFAADHEFETILGIDVGYRDPTAVLTIKYHYDQDVYYILEEYQQAEKTTAQHAMYIQHCIDRYNVDRIFVDSAAAQFRQDLAYEHEISSAPAKKSVLDGLACLAALFQQGKIIVDASCTALIHALQNYKWDFQEGEEKLSREKPRHDANSHLCDALRYGIYSISRGK

SEQ ID NO: 18 - protein, 160 aa, Unknown
  Description of Unknown: Bacteriophage F391/08
LASNVKYKRDAISIMRDGIKAQYKRGNCCAICDSQENLELHHYSTVALLVKNFAKEFQLDFTDSEVVLSNRDKFYKHYWHELVEDTVTLCVFHHQTLHKVYTKEPPLFSANKQKIWVEKQRERCMNPEAPRTSNTGERSGFAKWLPTDVKTEKSGFARFL

SEQ ID NO: 19 - protein, 403 aa, Unknown
  Description of Unknown: Bacteriophage F391/08
MAIRDWLVTKLNRGQRIIRDLEDVSHRTNVKPFTTGKAYSSIEILNRSANMVIDSAAECSYTVGEQYKTITTYGTIRSKTLETLLNVRPNPYMDSSTFRRLIVSDLLFEGCAYIHWDGSSLYHLPAALMEVKADDKKFVNKFVFNNMIDYRVDEIIFIKDNGQNGGINSQITGQSRVATVINSLTKREKMLEFKEKFLDNGTVIGLILETDEILNKKLRERKQEELQLDYNPSTGQSTVLILDGGMKAKPYSQISSFKDLDFENDIARFNKDVCIALGVPQLLIDGGNNANIRPNIELFYYMTIVPMLNKVCSSLTFFFGFKVTPNTKDVVALTPDKEKEAKFVTALVNNGILTGNEGRIELGYEELADEQMKKIRIPANVAGSATGVSGQEGGAPNKDEEKQ

SEQ ID NO: 20 - protein, 239 aa, Unknown
  Description of Unknown: Bacteriophage F391/08
MIDYKALKALFPNGLPEAHNVFATVKAHLTYQILRKEYGYAATNSKTWDQFKEAYAEATKPVPVASVSITGAPASLDYTKTVQLAATVLPTNADNKTVTWKTSDATLATVSSTGLVTALSKAGTVKITATAGGKSSEVSIQVKAPVVAVTGVTMSPKTITIEAGKTGKLTGTVAPANATNKSVTYTSADTTKATVAADGTVTVPANLAADSTVVITVKTADGNKTDTAIVTVKVPTAGV

SEQ ID NO: 21 - protein, 198 aa, Unknown
  Description of Unknown: Bacteriophage F391/08
MQNINLNAEIKSVKAVGEGDNPPLKIKGYANTITKDRAGDVILSEAWTTSNALKNFMKNPIMLFGHNHSRPIGKILDLVPTESGLMVEGEVSAADLQIYSLIRDEVLKTFSVGFYIKDAEWDDMTETFIIKDLELLEISVVSVPCNQDSTFSLSKSVNHNDYMELRKSFVKSSQVQPVEQPELSNLEKFLVAAGYAKG

SEQ ID NO: 22 - protein, 460 aa, Unknown
  Description of Unknown: Bacteriophage F391/08
MSYDIAQLSKDLGLGDIAEQLKGLTASQKAEEARKFAAEQEAKELKRMEDLVAKATGEDRKNLAEALELVKNLDEKSKQSAEAFVKAMNSQQEEITGLKEEIKSLLAARENGRSFVADGVAKAMFGKQEDFEDEVEKLVLLSYVMQKDVFGTKRGEAHLKAVNGSSSIEVSTEAYETIFSLRILRDIQAKLIIGTMFEELPMSSKLLTMMVEPEAGEASWVDASTYGTPATVGAEDKTKLSEITFKTYKLAAKAYMTDETEEDAIFTLLPIMRRRLIEAHAIAIEKAFLTGTGAAGTPKGLIQFAKDDGKVVATTAKADGSVKVTAKEIHKLRRSLGRHGLDLNKLALVVSMDAYYDLIEDEEFQDVAQVTATTAIKLQGQVGRIYGLPVLVSEFFPAKAASAEFCVVVYRDNFIVPRQRAITVEKERQAERQRDAYYVTQRLNLMRFFENGVVAGAYAA

SEQ ID NO: 23 - protein, 170 aa, Unknown
  Description of Unknown: Bacteriophage F391/08
MQFMTDSDWRTYGGLKRPDLESNIPMLIKAANALITQLLGIDDTANVVDVLPTKPARKKYFLSSPVPSTITKITINDQEIDKSQYKNYPDGTLLLKFSPPEGYMEVEFTQTGFTSIPDDLVLAACFLVDHWVKKDYRESRTFGGETVTFNTTKSGVPEHIRTIIEVYRRL

SEQ ID NO: 24 - protein, 253 aa, Unknown
  Description of Unknown: Bacteriophage F391/08
VALGDLARQIVKEQLDIMSGGSHSTKNTVIYSAETMDNHKDGTIGKVSFRFTKPVSEDLLNVRTSSILKAVSSSLNLEGDVGVIDNLLNSITGKKSKIGRKRSTGRVEVNFGDPSDADNGYAGAISGASGRFVSNTNLRALLELVAKEYLVKDMKKAGAPLKFRTGRFANSLKIKDVLLREDAGAKTPDLNITYNYMLKPYSVFNPAVSTYRGLSLRPFPGARNPQKLIGEAIAKAARDLIHSRYRIRVNQGT

SEQ ID NO: 25 - protein, 161 aa, Unknown
  Description of Unknown: Bacteriophage F391/08
MNYRTSIADALVERLKKDMDGSNPTEFFTNMYGNVSRQTYSFEQINEFPYIAVHVGTETGNYLPSAQQWVYLEIPILIYDKEKDDINMQLEKLIADVKTSIDTGGNLQYTIMKPDGSTIDSEATDMQITSVSTDEGILSPFGFAQVNVTVRYMPLRRALDR

SEQ ID NO: 26 - protein, 375 aa, Unknown
  Description of Unknown: Bacteriophage F391/08
MSVQLLRNTRIFVSTVTTGFTKANTQEILVQDDVSWSQDSNSTDITLNEAGPKPTRGSQRFNDSLNAAEWSFSTYILPYDDAGKQILPDYLLWHGLATGAAVNLAGTTGVFQNATNLVVNFKDNGYHELAMLNIYILTDSSWSVIRNCQVGQAEVNVDIDDIGRVTWSGNGTRLETLASQPFDPKTIGIDDALYAKIQSSYIKNKLTILKLKNNATGGKTYNIPITGGSFTMNNNVTYLTPNIMSRVDVPIGSFTGSFELTGSLTAYMNDAANGSIQLYKDLVSDLKAVNDFEVAIILGGEYDTARPAAVLVAKHANLNIPSIETDDVLGVSIEFKAIPTQMDAGDEGYLGFSSKYTKTSIAKLISSGDGNPVTP

SEQ ID NO: 27 - protein, 295 aa, Unknown
  Description of Unknown: Bacteriophage F391/08
MLYSLMRESRVVIEYDGRAYGFDALSDYTAGTSYEEFKANRRTIHRRSNYAYSKITAQSPSSISLTLNFSSNALEGLFFELMGFIEIDGMYQMPLFSNNIEPKMFSVYIINKNTSLRFDNCFATTCDFSLDKSVPVLNVGIESGYFEEVGHPLNSYTLDQGEVLPFSLPQVSSNGRVLPGLMSAGMSFQQQCEWRGDRSLFDINKIYNNRRAIVNELNSSALISMYYAKSLQIDSTHNIKPDIGLPVQIRNKYIVVDFPSTRITKRLDLTDVYKIDYDVIPTEQSDPVRIKLIGE

SEQ ID NO: 28 - protein, 140 aa, Unknown
  Description of Unknown: Bacteriophage F391/08
MSINLKDIALDTKQITIAYPGLPHFKLKVNYVSRKLSKKILEAAQENQFVNGIAVKVQNDDKFAEEFVKVAIAGWEGLTVADVEKLMLIEVPEDRLEDKVEFSIDNAMMLVRNSSAFETWMNSTVFHLDTFRGSKSEPTA

SEQ ID NO: 29 - protein, 108 aa, Unknown
  Description of Unknown: Bacteriophage F391/08
MCESLGEEPNPEVLKRFVEIHDFPEIAQTALTIYNNLSDNYIPGDYPTYLGKDKSALLVFFDIYGVEDADEKSLILQIINIFDSHAVAASRKRVEAAIKKSKMKSSSR

SEQ ID NO: 30 - protein, 1692 aa, Unknown
  Description of Unknown: Bacteriophage F391/08
MTDRLIRELLVDIKQRGGSKAAKQIRDVEAALDGAAQSSEGLNTSLGKLPGSFTALERSVSRTAKSLEKLSSTTSITALAASIGMLSGKFTSFEVDLAKSVLKINANLNGVTSAANKMASGFDTAATSSVADLNRVNKALQELDAHASSVAKVLQTLKAGAGLESISSSAAKASTDLSHLVSGVEKIGNQLARMAEQAVLAGRSLQGLKADSLGAAGEHLSKAASGISVAVSSMGEEVNKLNKLLLELAVKADLASKSIANIAPGTKLNSLGTEIQKINTSLATAANTSVAEISKIKAALTSLVSSTATAAASMKTVGTGSGLSKLISEISAATSASTSDISKVTAALKQLNVDATAAGKALQSIKAGANLSSVPTVVGKIGTSMTQLRAQLEGSVTGIEKSLNDLSRAFATMGGTGNLNPLGNSIRGMIPSLTQLAKAAVQVNSALSKIQAGRGVLQLPTQFKAVTASLNALETKLASTSQILERGFSKGFQDMASKSTSSSTRMINNFQKVVPELNAIEAAAIRSAAAIDKLIAKRIRLGQAGGGGNPAAFNMGALVAEMNRIVTSIEAMGNKMNTTMADMARSTDKVSDKLTDLNSGVRDVNTGLGGLNSTLTGTGSAANRASRALGNTSGSARGATRNFAALAMVTGPMPLIYGAIASNVYVLKAAFDQLKLGDQLNRLEQFGSIVGAKTGTPIQSLAVALQEATGHAVSFEEAMRQASTAAAYGFDAKQISEFALVARRAAATLGVDMTDALNRVIKGVSKQEIELLDELGVTIRLNDAYAEYVKILNAANTGITYNIQGLTSFQKQQAYANAVVAESTKRFGYLDEVLRATPWEQFAANADSALRKVQQAAAKYLGPVIASINAAFYTSKASVSAEAATAQQESIKQMDGKDSNAVVMNLEASQKGLDDAVKAKEEVKNKLAALNKEIMDREAKMDMSTALATAANYSGFGNLLTLGASKANKEFTQQTADMRRQAYMLQQELADSAGAIQKWKDARDSALSKAQKENPELAGKLNIGQNVEASNGLYTFDNAALDGAVALRKEFNNIKKTSGDLSNDIQNFAQDSNTASRATAALGDALKAVESLAGGSTEKANQMTKDLNLGYSTVTEMNTAYKAMSNYQKIVNDEAKSKLDVEKRIAEVYAATRNKDKAEEAGRALEMQQLSAKKEALKAVLATNKDNKAIQKELTLLETEELKVKNQGMEATKKEKFYKDKIVGIDREIALLNNRTMTDSQYNVANLKLNLQVEKDRLALLKTQADKEKEAEQSRRNIASIEREIWKEQLDRNAKTAEMRKEEFERNQSMKPLMGESQKMQEQLAFYQEMKEFTKGNADEQARWSKEIANTTAQMAALKAQRTAQMMDRVGQSLGADYTPTTGLEGEDKKFADMENQMASYDTAIGKLSQLNSEATATAQSMGNLANAMIQFSQGSLDTTSMIAAGMQTVSQMISYGTNQQISAIDAAIAAEQKRDGKSEQSKNKIKKMEAEKIKLQQESAKKQIIIQTAVAVMQAATAVPYPFSIPLMIAAGLAGALSLAQASSATGMTDIAGSGGETASYLTLGERQKNVDVSMGANAGELSYVRGDKGIGSANGFIPRAEGGNTYPGVSYKMGEHGTEVATPMVPTKVTPADKVASETSSGGARRPVNLNIQAMDAKSFMEYALENPAAFQAAVELALNEQGLSLKNLN

SEQ ID NO: 31 - protein, 204 aa, Unknown
  Description of Unknown: Bacteriophage F391/08
MRLPDPFTHPQYNGLGFDKATLIDNDPVIRDELPNGKVNEVKTATQYWGLNISYPVMFPDEYAVLSSAILEYKRTRGYLDVILPHYESYRVRGDANNCRIAAGQKGSTLVITNTNSLSGEPKPGDLFQLTTHPKVYKITSFKNVAGVWTLNLYPDLLLTTNGSERPRFNGILFQTKLMNGDSFSEEITVDGVYDGVNLVLRESL

SEQ ID NO: 32 - protein, 948 aa, Unknown
  Description of Unknown: Bacteriophage F391/08
MRQILPSAKAYLANNDKIRLAYLVSIELPGSTGNNAVYAYMTDYMRDINYGGILFQSGKIKTISSHKQNRTLTVGSLSFSVTGTDANEVIKLVQSGVSFLDRSISIYQAIIDDNGEILPVDPDTNGPLLFFRGKIVGGGIKESNTVSGVGTSVITWNCSNEFYDFERVAGRFTDDASHRGLEIVNGELLPSHGAKRPEYQEDYGFFHANKSVNFLAKYQVKEERYKLESKKKLFGLSKSYSLKKYYETVTKEVDLDFNLAAKFIPVVYGTQKVPGIPVFADTERNNPNVVYVVYAFCEGEIEGFLDFQFGDAPMICTDQTDSTSRTCFGQKRVSGDTMARISTGLPSTSLSTHGQEYKYNDGNGDIRIWTFHGKPDQTVATVLRDIAAANNFFLQGENGNGPEYWDSRYKLLDTAYAVIRFTITENRTDIPEVSAELSGRKVKVYQADGSVKMDKTSQNGVWQTFDYLTSTTFGASIPIDRMVIGDWRKEADLLNIIDTSYQTSWQPFWRYVGWESWTAENRQIMQMNTILDNSNSVFKNVQELLESFQGALNNLSGIFRITVEKDSKTPLELNFLDTYGDLDLSDTTGRNKYNSVQASLIDPTLNWKTNSITFYNSKFKNEDRGVDKKLQLSFANITNYYTARSLADRELKKSRYSRSLSFSLPYKFLGIEPNDPVVFTYDRYGWNKKFFLVDEVENTRDGKINVTLQEYGEDVFINSTQVDNSSEAVPEISNNVLPPRDFKYTPTPGGMVGDVGKNGELSWLPSLTPNVVYYSIRKSDRVDPYIVQQTAFTPNVRMFQDIVGEPAGLTIFEIRAVDINGRRSSPVTISVDLNSAKNLSMVENFRVLNLAPDPAEWVGPDLELGWDKLQEEGLISGIFYTLEIRDNTNKLLRSAKITSLYNYSYLLGYNKLDYKANNSNTLGIYRALQPRIQAEGPKGEKSVAWAYI

SEQ ID NO: 33 - protein, 3463 aa, Unknown
  Description of Unknown: Bacteriophage F391/08
MISNIAPAKMVLQNIVTGYTIASIQHSIFSDYDVIGRTFWLTTGGVTTRRDFTGVDTFIATINNLIAGATYSAQGAFYDSMVDAELMAAKVGMNLSSTINFKMKTAPKITKVSSFAESVDVGVGAPMVVVELSGEAEYVTIEMKPEGSSTWTKYYRGPITEQIIFGGVPVGRYNIRVSGVVTMPDGVTVDVSGYDTWPSLFNLTYNFTPPSAPTNLRFKTAHIQDGMERFDVRLEWDWTRGTGANVREFIIQYISNDEFAKTGWTKANKLNVGAAKAGTITSFPYKIRHRFRVLSVAWGPDTQSITNSNEVTYIIDESTTFDNAFINETGVEMTYAGIKGKLWNSNTKQWEQTFLVDAATGAVVLGTLDENGKAPISFDPVNKIVNVDGKVITKDINAANVILTNLTGKDNPAIFTQGKKYGNNAGGVWMGVDNVDGKAKFDLGNNTQYVRWDGDTLRISGNVVIGTPGGDVDLETGMQGKQTVFAYKLGTSLPSRPLDQVYPPAGWSAFPPNRTAQNQNVYVVQGTLDPKKSPPALVDGTNYSAASQWSGVPGTGGTDGSNGDYTVQIYQISASKPTKPGNINDPSGWSRTPPTGTPLWMCSGRFNGDTNALTVEGWSDPIRVDGEKGATGATGATGPQGPQGPAGGSVEVQWSKDGTTNWHANFTTGDIYMRQRVGTGGWSSAIRAVGEDGTNGTPGSKGNYIGMRFRVAAEKPATPTGQTPSGWSDAPPQGNPLWMVKAEFNGQTNALVGTWSEPVRIDGEGIGVNLYPVKKTLDQWTGMSNGTMVKNPDTLSFTITNTESTTSSTGPGAHPVPFQGSQGPIVEIPVKPNTAYIFTYEVSTDSTSFVLRDLLLEFSSITGSFTNFQELLTGAKGKQEAKIVTRADTKFLSFRPGVRTAGATVTYSNLKLEEGIKATAYSVEASDSIGEKGDQGTQGPQGPQGNQGPQGNQGPQGAKGDNAKGFSLSSLGQTFTYDAEGKLKSDATILFQAFRQNTTANVTWSAKDEKGGNITLTSTSNTGATLTAANFKTSKSVVVTAVCDGITDQITIVRLDDGSNALVGLLTNEGSTVLANYAGYVQNYSTGSGDFKVFYGAKDITSECTFSTMEKNNLDADITSAGKYTLKGMPAGTDVINGWVDLRAVHPTYGAVVRRVATTKSILAKGYDRVITTSFENGNKGTWSTGSVQGVSGATIVAAGFSKALVISARDCIEDANAFPVVAGQKYRLGMWIMASESKVNINMGMRIVRAADGVVDWQGTLMIAQGTVVPGGWSYIEKEFTVGSSNTGIAMPWIQMAGSSGSDLGKAYVTDIHIFALEMDGEKGDTGATGATGSQGPQGPQGNKGDKGDTGATGAQGPAGSSVNVQWSKDGSTNWHAGFQPGDIFMRQQVNGVWGSAIRAVGEDGKNGADGTDGDYISMKFIVQDTKPGTPTGNNPGSWSDAPPVGSPLWMTKGTMNASGQLQGTWSNPVRLDGTINPNLFAVRKWMAGMTGTEAGTSKNDIEKLAHTLTRTSGTDNTAPGCYATPYLGSGAFSHPVTPGKRYTLTYNIDAASEVQTRDTIFWQANPDSGQSTYIEELNTGTSIKVKRTFVVPTGMNYLTLRPSALTLNVATTWSKIKLEEGGEKTEYQVEYSDSIGIVGKSVLVQWSKDSSSSNWHDTFQTGDLFMRQNVDGVWGPAIRAIGEKGEIGPDGKKGNYTNIIFRISDTKPAKPTGNKPTDWFDAPPDGSPLWMATATFNGDTNAIIGAWSDPVRIDASGVGENFLAFKEWMMSIQRAEGTGSSVSKNPDQMRFRVTAGPSRNDAYTTPYQGTGTHFIEVSPNTVYTLSFEMETAVSTRMMLLQFDNGNGGTHARNNQVISTSTGINSLTITTGANTTHLSMRMSISNMGETNVLMKPKLELGAFPTAYVAHPSDLLGKDGATGATGPQGPQGNTGATGATGPQGSKGDTGATGPQGPQGPKGNAGENAKGFALTSDYQSFVYDTVGDIKSATTILFKGLKQNTTAGITWSAVNNTGAAVTLMNSGDNRQLTAANFGASKWVTITATCDGLSDQITVVRLQDGENVLTAVMTNEAATVLANYSGYCQSYENAKGQMRVWYGSTDVTGQCTFSEGGRSNVTPSINSANGNYSVTGMLDGTDITEGWVDVKATHPKYGAITKRFAVTKVFLAKSYEMVITNTFENGNKGSWAGALQSVSGPTNQSISKALRITARDNLEGRNTIPVAGGQKVRIRFWYNPLGLEEAIFRVGFIVHRKDGGKGYPSRTVVTGPAPNSSWAYFDQELTLSANDEGIAWPWFQLDNKTSGSSLGYMLVADIHFEDLSMDGADGATGPQGPQGNTGATGPQGNKGDTGPQGPQGPAGASVGVQWSKTGNASDWHTNYATGDIYMRQQVNGVWSSAIRAVGEDGRVGADGKYTSLRFQVAATKPARPTGNSPANWSDSPPEGSPLWMVKGEFDSSNQLQGTWSDPVRLDGETVNLNLFANKAWIASITGASGSGSVVAKNPDELRLRITAGSGATDAYTMPSGGDGTFFTKVTAGKRYTMSFDTDSALEMRMHVFFIQAGANTTTSSFSWIASTTAGRTSWSFTVPAGCDRVSVRVSLNNNPGGTNVVSNIKLEEGDFATAFIRNELDTIGADGSQGPQGPQGSKGDKGDTGATGPQGPQGPNGTSAKAFALTSDSLSFSFDTSGNLKSNGTIKIDSWRQNTTAAITWTAKNQAGSNITLGGTATNKTITSAQFGSSEYVTVTATCDGITDSITIVRLQDGVNSLVGYLTNEAANLSCNSYGFVQNWDGTTGNFKVFYGTVDVTSQCTFGVEDKSNLNGNIGSSGYYAPSAMPNGLEITSGWVDYKATHPKYGTLIKRFTLKKSLPGIGYDRVFTGSFDSGNNGSWGRTVVDIATGSPGGHTKAIQCTSRDTMESSNWFPTRKGMRYRVTAWVNNSEGEYQLRLGLHTQNSSGSVNTGYPTMLAASAKDSEGWKLVTGIVTVGDGSTAETGRARPFIQMNGSASPFGNAYVAAIAIEDLSMDGADGATGPQGPQGNTGATGPQGDKGDTGPQGPQGPAGNSVNVQWSKDGSTNWHSTFTSGDLYMRQQVNGSWGPAIRAVGENGANGTPGSKGNYVSMKFAVMASTPSRPSGSNPAGWSDSPPPGNPLWMIKAEFNGETNAIIGNWSDPIRLDGDSINENLFYFKAWLDSITGVAGNGSSIGKNYELLRARIIAGTGVTDAYTLPSDGSASMFTYLPPSTTYTMSFETDNAVEVRCHVFWYAKGSNTTGGVLKTIASTTAGLSSFTFTTPANSDRISVRFSVNESGGNNVVGRCKIEKGAFVTSYVRNQYDAVGDRGPGFYTQAITNLTGWNDTQAASFFQSTFGGPPVKYDVLTQYKSGSPQNSWTRQWNGSAWTAPALTVHGDMIVSGSITADKIIANNAFLAQIGVDILYNRAAALSSNPEGTYTMKIDLANGYIHIR

SEQ ID NO: 34 - protein, 139 aa, Unknown
  Description of Unknown: Bacteriophage F391/08
MSTENRVVDIILDQNVSYGLMLQFMDIDDSAYPATETPVNLTGVTLKSSIKDSLESTGVKLADFVVTVVNATQGQASLGLTAATVATIVSKASKERDKYNPRLRFAGYYDVIMTKGTGATATSYRVMEGSVYVSDGVTA

SEQ ID NO: 35 - protein, 679 aa, Unknown
  Description of Unknown: Bacteriophage F391/08
MAITTRIIAQQVTALDGANSRVSKYPKFTVQLGYSVSSLAATELLDAATRSAASAAAAKTSETNAKASETASKNSQTAAKTSETNAAASAQVAQNLAGKASLVTPLGVMTGSAEAKIASITIAANQSSSVHVLFALYATGNGANRDDIYNMEIVSLALPGPVTSVTADNIGSFLSHRVIGPANTNGFMVGLKSTIEGSNVTYDVYLKSRSSFRDPKMAFLSGSISVTPPTGPLVDGTSPAWKTTGFDTDVIYVNRAQVIDDGISLARIKQLAITNGKTDSSILLLSYLNETGILSTNKKSISLRPGGTSDSSIAATEFLPNGNIILPNGDTGNQTISWLGGPRIRVNSNGSFVLSTNNPSNQTSGFITFRPQGDQVTSTELQIRDDGNIKQTAPQSSAGNALIRQDAAIQHIMDKAPAAGITANPLSDLNVIPTPEGTDPWGADGVRVFQSGVSTKNTPDGTTGRLGTILNVRHTQYRIMQFFMQSNATAPILHIRSLRADQGNTPPAWFKVYTEYSKPNIQSDIAGITIDGNGFVKKASPIAKLIAEIPSKEDSFFWTGVETVGGYVGCNAEAQGVFAVKTGLGKYTIKGSLGWNTEGWKFELPRDDNGNMLCFVESDWNEEEKELNIQVFTRKFDINTGNIIAGEPMEIPQGRWIDLRLEMPKVEIPEVEFPEDPEV

SEQ ID NO: 36 - protein, 147 aa, Unknown
  Description of Unknown: Bacteriophage F391/08
MRIKLSHPDCKPHVGSSEAAGMDLRAYFGDRASDLLRAIPPGESLMIDTGVAVEIPEGWVGIVVPRSSLGKRRLMIANTTGVIDSDYRGTIKMNLLNMSNETQPIDNFERLCQLVIVPHYNPNDIEIVDSLTDTDRGEGGFGSSGKM

SEQ ID NO: 37 - protein, 292 aa, Unknown
  Description of Unknown: Bacteriophage F391/08
MSKSWGTMKREAEQRLASRRNLMIVDGTNLGFRFKKDSGKPIAASFANTINSLANSYDAKHTIVLGDKGKSIFRTNIFPEYKGNRDAKYADRSEAEVEADRQFFEYLDDAFDLIASQFPTFRIRGVEADDMAAFIIQLIGHHYDHIWLISTDGDWDTLLAPNISRFSFTTRKEYHEKDMFDNHNVDTVDQFISLKAIMGDMGDNIRGVEGIGEKRGYNLIREHGSVLDIIDALPLPGTQKFVQALNKSGELMERNLTLVDLPSFCGEAVAAAGQDIYDQFVKDITAIATGEV

SEQ ID NO: 38 - protein, 160 aa, Unknown
  Description of Unknown: Bacteriophage F391/08
MAVDSREKGKRAEYQIRDMLRKYTSLDWERVPGSGAFGQSHSLKGDVYLPPSVGKMSQYCFEIKHYADEKFNSNILNVGESQLEKWWAQAAREGEQMNMKPALIFKKDRGQWLIALDSSDPMIDNLMSRAHFIVNKRGMEIVIGLFEPWLNACEIGDLVK

SEQ ID NO: 39 - protein, 611 aa, Unknown
  Description of Unknown: Bacteriophage F391/08
MSIVINKLTISHFMSYAENVVIEFDNHRVTQLIGRNGLGKSTIGTALEELLYNKNSRGIKKDDLFNWHTGSKAYTLEGQFTKDGDVYNVKKVVKSTAKVTLTKNGEDISGHTATQTYKLIEEVLACDFTTFTKLVYQSVGSSLDFLKTTDAQRKTFLVNLFDQEQYKEVSERVKAGRKAVSAKLSGLEGSLRTAQSILSSKASLGAPQSEIPIPVFDEEPLVEELTEAKVKVALAQKQKASIAKRSSLDMAVQAAEKTFAPFENLPAPTSKSEELLSVTRNLTVVATRADDLKKRYYDFKNAAGKTQCSACGTHLDTSAAQEAMRRTKEEYDPLYKERQKLEAEVEELRKEDRAFKDYISKFNALEQARKNLKEFDEVNGTQDEIVDASGLAERIKAIESSIRQGRSSVELARTHNESVVRENAKYEAKREQIQKAEQEFDKIQAELSLVAEEVADLDILITGLKDLVGYKLEHSVKVFEEMINHYLSIMTSGKFALGFELDETKLQVVIYNDGNRTSMVNCSTGQQSRINISTLLAIRMLLSTISKVNINLLFLDEVVSYIDPDGINTLVELLQEEDQLNSIIVSHGHTHPYAHKIEVKQDEAGLSILEA

SEQ ID NO: 40 - protein, 330 aa, Unknown
  Description of Unknown: Bacteriophage F391/08
MKILFSADHHIKLGAKNVPQEWQKNRFILLGEKLDEVFGATGCDLHIIGGDIMDVSDPSSEEVELLFAFLATLQHPGIIYTGNHEMKSKTISCLDHYAAAISDATDGLWKVVKDYRSPEFDIIPYSSLHKASWKPRVSDICFTHVRGAIPPHVVPEIYLERFVEHGYSKVFAGDLHSYKNSQKIGDVDLLYPGSPLTTSFHRERTKGTNGAFIIDTVLPRDHEHYLSWIELGDLPQLIRKTIEVGEPMEADAYDRVIYEVTGDVSQLKTLKNSELLDKKINNRVTKDAKLDLDDMSLLQELDTYFTNVQKLDEASRTRILKRAAEYVDSN

SEQ ID NO: 41 - protein, 257 aa, Unknown
  Description of Unknown: Bacteriophage F391/08
MATKSWGSTTGGSNGDKLDYMKFNNGKNVVRIVSGVLPRYVYWIQNKEGKPAPFECLRFDREKERFIRGASDPVHDMGFKDPEKKDGKAQPLRPKKNYLAVVIDRTDNKLKLMEVKATILTGIHSIMAQLNLEDPGEIDITISKSGTGFDTKYDVQQIAAMQFQMAKNQPGSKEAALHEADVALIGEALYNEADEFEGFEKVPKLDVTYPVPSYDEQKKAIQAWLEGKKDEEGDESKGNEGSANSGNIDHEAASDLD

SEQ ID NO: 42 - protein, 117 aa, Unknown
  Description of Unknown: Bacteriophage F391/08
MLFYDYEKIYILARGNSSLIVQIIRRMVEDPEAHVMLTGRSFILNEDTIVYNKRKLSDRQLAEYLGLLSFRNYAEYSFSKDTSLDMQYIPPWVPRAVIEHHPLIAINKSKLTFIEEN

SEQ ID NO: 43 - protein, 452 aa, Unknown
  Description of Unknown: Bacteriophage F391/08
MKIVISNKIYCKPSNELWEYLLKHTSYQIFKPGAKYPLMFQNSGSVGKEIKWFPVTRLDLLESFGQKVTEIVDKRTLVPMDIPKPSFTLRPGDQLPIYEDCNDTCIINGKPGFGKTILALAIAHKLGQKTLVICTNTTIRAMWEKEVRKFFGIEPGVIGSGKFNIDSPIVISNIQTVNKHGAALAKEFGTVIVDEVHHCVATTFTKFLEQSSARYKIGLSGTLKRKDGLQVMFKDYFGTKVYSPPVNNTMPPTIHRFALKTQVSGNMNVPWAIRANDVYSQPEYFQQVVDLCELYSMAGHKVLFVSDRIDLIERVTNALELRGVKTYTITGVTSLDDREQVQIDVTNDGPCVLAASQSIFSEGVSLNALSCLVLGSLINNESLIEQLAGRVQRMADDKLDPILVDLKLGGVGFKQAAGREAVYRLNGWEVLDFNEKNMANLDKILFAKNPKV

SEQ ID NO: 44 - protein, 165 aa, Unknown
  Description of Unknown: Bacteriophage F391/08
VLNFSLPVYALRAYDVLFQEGEYIVIQTRFTRYVLDNPSLPGTFSQRRLFLYGERENLPYKLYPLKKQFKYLSQIINSGLKHFIDSTGKIVTWKPTTYYNIITERVRGSTRIFNGKYQCYVKNVPYPFLLSEPANYISYALVRGSPVIFDTHEEEPETPRLRVKI

SEQ ID NO: 45 - protein, 856 aa, Unknown
  Description of Unknown: Bacteriophage F391/08
MKIAVVDKSPNNVRYQKHFELFDHEVETFFMASEKVTGRLLKKHITIGTPENPFNPEDFDYVILVGADPFLKFAAKKGISDYSGKRVEHDGYANWIASISPAQLHFKPEMKPVFEATVESIHAILNGREKRSKAGDYRPIQCPDEAEAYVKMVYTMCPGMIAYDSETSALYCRDGYMLGISISHQEYQGVYIDADVITENTVYYLQKLFDSPEHGVVFHNLKFDMHFYCYHLGLSFDKAAEEKRLHDTMLMHYALDERRGTHGLKSLAMKYTDMGDYDFELDQFKETYCKTHKIKKEDFSYDLIPFDIMWPYAAKDTDATLRLSNFFLPKVEANPRLKSLYYDVLMPGCVFLQRMEDRGVPISKDRLKEAQVQLMTALQLAKAKLYEYPEVRKLEEDQGSVFNAASVVQLRKLLFDYVGLTPTGIMTDTGADSTGADALKELSDQHPIAKTLLEIRKISKLLSTYIEKMLISIDADGCIRTGFHIHMTTSGRLSSSGKLNLQQLPRDESVIKGCIVAPVGYRIIAWDLTTAEIYYAAVLSGDINMQQVFINMQNDPENYSDFHGSIAHMVFALPCKPTEVKKLYPALRQAAKAISFGILYGSGPAKVAASVNEALLEEHMKTGKPYTECTTGDAKEYIETYFGRFPQLKKWIDKSHAQIQTNGFIYSHFGRKRRLHNINSEDRGVQGEELRSGFNAIIQSASSDSLLLGAIDTDNEIRSLGLQDEMKIIMLVHDSVVAIVREDLVDQYNEMLIRNIQVDRGISIPGCPIGIDSDSEAGGSRDYSCGKIKKQRPSVACIEDKEFEEKVRSIIGMEDFDYAAIAANDENHPDHDKYANIKFLPEISKDIVNVRRVLGA

SEQ ID NO: 46 - protein, 294 aa, Unknown
  Description of Unknown: Bacteriophage F391/08
MSRITELLDLKGIEYRDTGGDILIRCLNPDHEDAHPSLRVDPDSGVFHCLSCGFGRGIPSIFHYFNEEQYRTSPRLLRVRRMISDLRTEGRSLEIPESAMIFDQDFRGIKAETFKKYFAFQQTEDWEGRVVFPITDAVGRNLFFLGRNMDSSAPPKYMIRPKKVSPPIFPVRYNTPALILVEGIFDMLNLEDKGCHNVSCCFGTHQFSLDNIADKFMPFQIAGTTHVVIILDNDKSGNEAAKKLAKLIRDKTRIIPIIGNFLLPEGKDPGDLDAEEVDQLIRNVEILIAEHVKI

SEQ ID NO: 47 - protein, 492 aa, Unknown
  Description of Unknown: Bacteriophage F391/08
MYNVQAVVLKMLLASDQKQVALETFSRLRKDHFNDAFTAIYQAVQNYYKKHNGMPSLDALMLESNRNARLSQALTVLANTQIPDVDISHAIHVLESEYTQDLFLNLLETDVLQDITILDQGELLDRVAALHMKLEERVTTTGKVFNADTMRVFKRKEDSMLNLISLGISNEFDAQLGGIARKETLLLGGWRGTGKSIICSNIQVAQYYNGDIAPYFSIEMPENEVFRRNLAIMAGVSAKAMRNDSLQGIELNKLAKTRAKMFEGGLEVYNDFVSRYTLNEMSDFHDMETMLMQERPLHTPMIIVYDPELSTATIDVELTKLTSKYGDKVTIALLDYINQVRLPDTKTLDMYDWKQQMVVSSTFKSTCQKHNVAGVAPYQIDQQGNARMARGILDSCDMAANLNAAKQNEGHDGAIKFDFVKTRNSEGMTFMPKINWNSLRMDQTSDLKLEDIRQMEAEFVIPLESDKPKDKPKRKKASDEDTNPTGESSRDL

SEQ ID NO: 48 - protein, 252 aa, Unknown
  Description of Unknown: Bacteriophage F391/08
MAKLTWNEEITASLTAKANALNATVISQEAVANIAAELAAETGKEVTARSVGSKLRKEGFEVQKASDVTKSPWTPGQEDELVAFLNDHPGQYTYAEIAAAVVGGAYTAKQVQGKILSLELTAAVKPTEKAAAVRSFSPDQEAAFINAVASGASVEAIAAQFERTVKQIRGKALSLLREGRIEAMPVQEVSNAKAREDVLEGLNIADMTVAEIAEATGKSERGVKSMLSRRGISAKDHDGVAKRAKLDAKSAK

SEQ ID NO: 49 - protein, 249 aa, Unknown
  Description of Unknown: Bacteriophage F391/08
MKIEIPLNCHSCGSKLDLVNDQLFCRNKSMCPAQSSKLIENFCSKMKLKGFGPQTIAKLEITKVSELFFLTKEDLVRAVGDKVATKLELELETKLRQDVDFGSVLGSLSIPLIGEVAAKKLSQLYNDFQSVKAEGKAGENLASWKNTPAGQNVINLPWKFSGAREAQVTPATESNGVVLCITGKLNDFKNRADATKYLESLGYTVKTSVTKAVNYLICEDETKIGSSSYKKAQSLGIEVLTIKILLENK

SEQ ID NO: 50 - protein, 320 aa, Unknown
  Description of Unknown: Bacteriophage F391/08
MQHVKEFIKLCQDAYYKGMSIISDEEYDALIRRFPLEEEIGPKGDVPHLFRMFSLQKVYPGRGEEVPFQGIETPKLDGCAISLLYIDGKFVSALTRGNGVLGNDVTHNVKLLNIPKRISQKTPVQITGEVHITKEVENMRNFASGAINLKDSGEFLSRIAEGGLMFTAYSIQCETGKVGLTATFCGDMHILQGDGFVTCLDISSRVDWFPTDGVVVRMDGNNQFNAAGWTNKFPRGAYAIKEDDEGEVTTLERVEWQVGASGKVTPVGYFTPVVIDDAVISKATLNNVGYITALDLEIGCQIRVIRSGGVIPRIVERVYE

SEQ ID NO: 51 - protein, 91 aa, Unknown
  Description of Unknown: Bacteriophage F391/08
MQKITLNAYSSPPLQGQELVLTWLEKEKGKPVVRTMSGFQMLGMWYEKNVLVCELYSPKSKRRVMSTFQAVCENFYWEGKTQMLFDYYEAK

SEQ ID NO: 52 - protein, 45 aa, Unknown
  Description of Unknown: Bacteriophage F391/08
MKDHEIAQLVNKLTEAAKTYAHTQQLRAHMSRIVNEALKNAKDNA

SEQ ID NO: 53 - protein, 102 aa, Unknown
  Description of Unknown: Bacteriophage F391/08
MNQNICQDYEGHIDDQSHVIFEDEGRQIRMTVSEFRGNLYFGFRLWLLDIEDNWFPTKSGFSFPYTLEMTSTLFRAFTKILSNSEVLHEVYRESQKTQASDD

SEQ ID NO: 54 - protein, 98 aa, Unknown
  Description of Unknown: Bacteriophage F391/08
MNKAQVVAICEKHGEFCMQYTKLRTKGVTYLYGTTEFDPKQDKYLAERIVREGLEPADKDHILVFSRSSDKFRYIPIANIKRITSLNQELDRATPVGR

SEQ ID NO: 55 - protein, 134 aa, Unknown
  Description of Unknown: Bacteriophage F391/08
MSTPTQWSPELEAELTSAYVAKIELFPEDERPGVSMEIVAEIAKEHGVSPNGLRMKLSKAGVYVKKEAGKSTAKTGGDAPKAGGRTSKSDAQAELRAAFNDAGLEDGFLDESIVDKLTGKAASHLAEAIRKITK

SEQ ID NO: 56 - protein, 72 aa, Unknown
  Description of Unknown: Bacteriophage F391/08
VSKYQLLNLFQIYSEGATAIRDLHYALPMDEAEDNGWLTKYDRGLLKMYRLSPNGLVAVNQILENSVCFAAQ

SEQ ID NO: 57 - protein, 231 aa, Unknown
  Description of Unknown: Bacteriophage F391/08
MAIRKKLHANSIPDEKFKEAIQWLEEGKTKKGACEILGVASNSTMERLIEEWKDNQRVSAEMRKKKRGTKIEGAELANVIDSYLSGDSFEAIAERFYRSANMIRMVLSAHGALLRVNGEVDPLFPPAIPEESMKEVFEVGEHVWVPGYQCIGEVKKALDNPVGAYRVYLLSEARQQYVNYMYWDLASVEHLVALGVDIKSLGFKWGKEDVAELVNNAVKAALKLEKRGKGE

SEQ ID NO: 58 - protein, 94 aa, Unknown
  Description of Unknown: Bacteriophage F391/08
MSKRDARWETRKFPKRDTKARKAKEIELCRVIPIRLAQMPNIYDWLEAQRKTRLSIRINMELNMGYKSLSEFMHVTFDPTFYENRDCLEAKSVL

SEQ ID NO: 59 - protein, 929 aa, Unknown
  Description of Unknown: Bacteriophage F391/08
MFSILEGHAGFSRDPASGNWKEVKTTDYLFAKEFSNEHPEGKPASMPYKFNVVDTVDPKNLNEAYELMVQLTQDPHLVAVRGTCLVAEKAVRRKRTNFKIDHKSNIIAMDVDGISDTGGCDRFDIVGMGRHVIKLLNSISEDMFPLNAGFIAHASSSAGIKPGIRMHMLLESNIPVTQGQLKFLFTSLNDSSRQKYGFDIADLAYYSSVQLHYFADPIFRDQFTDPFKAEGKPRLVKVNGARIELPNTMPDYEATRGEFKEEFLSLLNQIKGKRVASEKVEQTIAELEEAEDGVYLRIIPKLYHRALEDGVDFAWLEKEITSALSDYINTKDNSRSLQDYFNNGRKQALKAFVNNSMRDIPESNVKGVPVHKLTSDSPDGMNYLKINRPPPEGHLTFIKASLGTGKTTAVTKWLERDQLKGNFLAVTNTRALVSSNAKKFEAGQYDKSVDMLNFKRGAIDRMSTTIHSIHKFKNFVGQIDVIFIDECDAVMNDLLFAPVVKQRRECISVLREILLSAKVVILSDGDISAETIEAYGSLIDFDKPVSYYKHHRKMLSDAQAYEFPDESSIWVALQTSLEMGEKSILVSDCGPDELNEKGLTLRNNTGAIVKEIHSNSTSDIDIRRILDYTTNELIEQQIDCLLCSPSVTSGVDFNYFDNVFVITRTANQAPNMRFQAIRRDRGAKNIFYFIDKSTSGFSAGSEQYNIDEGWLELAQQLYVKRRELESRNFISTLRYYLLDQGATIDIFSESWGKIDSSAAEYTAERVSAILSSTPDWCAPRHADAYEAKLMLVKYFHLDSIKSITQEHAEMWISKKPHKRAEFFHKLQDIFWKDIKKCSNVTISPFIEALKKHKKDFFIRTGQSANPKYARMYLTQMGINKEMETEQIVDWYRTYCSIEGISVPYEFMTDEEKALADEAQNELGVRNEQA

SEQ ID NO: 60 - protein, 131 aa, Unknown
  Description of Unknown: Bacteriophage F391/08
MSIPKMERISWADIPKELIDVAENLLRAALRDEELCFIIQHDVCVGLSKGSLAQDYEILFDWDDLSDLGLMVLVNNVVFHPSNFAAFREPGAGISPGFLVADEPWTYAPEVLREGKQNASSNSINIMGWNA

SEQ ID NO: 61 - protein, 133 aa, Unknown
  Description of Unknown: Bacteriophage F391/08
MLVNEKVVNQGVGLVPWAEIPLDVKESLLDHLRVWCDNMEVYFDYDNMHLGLWVPMDEDQDEVLDWGDLTEMGLVFALGYVCLLRESYIPVGVTGVSAGIWVGRNEDYYAPENINGWIQVLRRFGFQVEGLTK

SEQ ID NO: 62 - protein, 54 aa, Unknown
  Description of Unknown: Bacteriophage F391/08
MYHPDDILLWPNGSWCYRSDVQDMSHLSDDYQVLRADSEQWHEFIQMGEEYAGQ

SEQ ID NO: 63 - protein, 260 aa, Unknown
  Description of Unknown: Bacteriophage F391/08
VPTFRKGAITPLWDKYKLTEVCNIQAFDKGFHYLNDPMPPLEALSEGSDDEPSRNLYELTHEFYNMRRQELGTVEPNIAHLRIAEWYERFPGQVVNFTTNVDDLLERAGIPHDDVIHAHGYLTEIMYRRGKDVIVEDIGYTAVDYRKYEWVKPAITFFGETAPWYMGQINLFDTLTTQDLVIVVGASNQVIDFNWELFPAHSRGTKVWVVNNGINYLEQSLYEERGIPVWYDTAANVFSNKHFIGQVEAWLEEKIYVPSR

SEQ ID NO: 64 - protein, 70 aa, Unknown
  Description of Unknown: Bacteriophage F391/08
MKIHKTDEKRIYFMMDSGAYGSISREDVVKLLRCRNHLWKDKVDPRTSECLSEKAEQLRKEEMRNYMEFL

SEQ ID NO: 65 - protein, 609 aa, Unknown
  Description of Unknown: Bacteriophage F391/08
MNELDLIDNIYSILDNEGEEDLMFNNANKASEQFPTQRDMIAGEVSKYVVAQELPAYLLAAHNRGEIHIHDMDYRAQGYTNCCLVDLAGMFKNGTKIGGAEIETPKSISTAAAVTAQVIAQVSSCQYGGTSIDRIDEVFAPYVRKSYDKHLAIGQRWLHDSKKAAVYATEMTEKEVYDACQGLEYEVNTLFNSNGQQPFVTFGFGLGESWEARMLQKAMLEVRIRGLGASGHTAVFPKLIFAVKEGLNKSPSDPNYDIKQLALTCTSKRMYPDYVSYERVTAVTGDFKFPMGCRSFLSAIESGETAGRNNLGVVSINLPLVAVESEGYFDRFWKLLDEYIDKAMAAHDWAIERLKRVRAKQAPILYMHGAFGVRLKANDLVWPIFEGRASVSLGYIGINELVEVMFEDTDPMSPPAIEFAVQVLNHMKDRCNKKAEETNLGFSLYATPSESLCNRFNTKIAEQYPEYDWLTDKGYLTNSHHLDVRTKVAPNVKFDYEANFTTIANGGNISFVELPEMRKFIPALEWVVDYGLSKSHYIGVNIPVDECEECGYLGESVSGEHGFVCPQCGSGNISVTRRVCGYLGSPGSRPFNPGKQQEVMQRVKHMNLK

SEQ ID NO: 66 - protein, 249 aa, Unknown
  Description of Unknown: Bacteriophage F391/08
MRKAARRKESRRNGSAKRERHENVIPVDFEARERFQPTAKELKPKNAEQKHYISTIRNFTVTVGIGEAGTGKTFIPSVLAAQELATPGSVYEKFILVRPNEPLGKSLGMLPGDLNEKMAPWLEPIADGFKWALGERSYQGLVERKAIQYLAIEHARGRTFNNSYVIVDEAQNISVEAMKCILTRVGQDCKLVICGDVAQKDIKSDSGLQLIMDIYDQYEHVPFSLVELHDNVRSAESKAFQAIFNDMGI

SEQ ID NO: 67 - protein, 59 aa, Unknown
  Description of Unknown: Bacteriophage F391/08
MITCVPLNPKHSRQSLTIWESNMVTELIIGYGEGITSEENWGFVGFGEGITSHDERPDL

SEQ ID NO: 68 - protein, 69 aa, Unknown
  Description of Unknown: Bacteriophage F391/08
MNNVFTLNNFRTRKTKVHPVSLATVNKYNANYPEDERRHHAAFKIANEFPNQPLGTKELVSRMKKLHFY

SEQ ID NO: 69 - protein, 774 aa, Unknown
  Description of Unknown: Bacteriophage F391/08
MTQRIEYVIKRDGTKEPFMAQKLNDWAKYIGIRSDVPWSPVAVAAVKNLPKGDVHSDDLQTMLIKSAESMIERDHRYDRFALELRLAQLRKNLFDSYTPPSLRFFHDHMVELGAWEDMSGWISDDQFEALNEVIDHSRDELFTNAGLKQFMDKYSRRNIYTEEIYETPQFAYMGMAMAMLSQPHWSMLDAIDLYNALSLQKINVPTPPLVGLRSADRGFASCCLVDGTDTLDSIDAAEHVVFKMVAARAGIGYHLESRSIADPVRKGAFPHSGKLPYYRHIDRSVKANTQQSRGGSATVYTAFFDPEIIQVMEAKSNRSPDEKKIDKMDYNLKFNSILLKRFLRKENITLMSFLYAPEVYAAFDSGDVAEFERLYIAAEKRLAGVTKRGFKGEVLPVAPVIPAAELIEFWKTVRMETGRLYTMDAGEVNRNSRYKDPVRMSNLCVEIVQPTFPIPHVVDLYRTDEELDKMDVSEYGEVSLCNLGGFALGRIKTLEEWEKISYILLKFVDTIIEIQHYPFPAMKYTALRRRNVGIGLMNAAGAMAAEGLAFEGEEARNWIHREAEKASFFLHKASVRLAKEIGPCEWFHRTHTSDGTLLIDTYKKTVDDLVSVGLEMDWESLREEIKTHGMRNSVLTASMPGESSSVLIGVTNAVEPPRSAVTIKTSGVNKVITVAPGLDDWDTMQSYKYAFDIDRTEHIKWLAVLQKFTDQAISANLYYDFNKYPGGIIPGTEIIKDLLNSTKYGIKNLYYANFDVDTGGSAAEQGCSSGGCTL

SEQ ID NO: 70 - protein, 386 aa, Unknown
  Description of Unknown: Bacteriophage F391/08
MATVFNREWDHTESKLFLGQDLGIADYVNVRYPRLEELALLQRSQFWVETEISLEADKKQWPNLPQHIKNKTLLNLAWQTQADSIITRAPEDAILKLVSRPELEGMLIQWSYFENIHSRAYSNIIRNVLPNPGEFIATVQANDEAFARLALPVSVIDELAEIADIWLDARANLEIAEKEGTLEYTEEADFLALTEQVQQKILEFYYAVYALEAIMFYASFACTFALAENDILTGIAKNLQLIAKDEALHTVMAMEVLRILQNGEIPPHVVAAAQANAPKILRSILETEINWAHYIFPEGEDIPGLNADLLVEYLYYNARLAFMAINIPWPEDLPVIMEDPIGWMKGWLNTKNQQVAPQEAQITNYRVGATSQANPDDLSDEFGEFL

SEQ ID NO: 71 - protein, 187 aa, Unknown
  Description of Unknown: Bacteriophage F391/08
MITALYAMRVDAAFGIFNPATMDAYGELPWGSIPEELEQFYRILDTYQVVIVGHNTYETAPPRLKKALEKKSMVYVVGSKAPVLIKNPPRNVRFITHLGSKIRDFCNEVEVVCIGGKALLETLATMGCLDAIYRSTIYPKAGTVPSLDHIMYLEHPILTSTPPDAVVTHIASGENERYRFVMEGVYL

SEQ ID NO: 72 - protein, 284 aa, Unknown
  Description of Unknown: Bacteriophage F391/08
VIHYINEGKRILEEGVWLENPRTGVRCLTVIGSNFEYDVLGKKFPLITTRKAYALQAIMELIGYLRGYDSAEQFRAIGCNTWNANANENEAWLVNPNRKGTDDMGRVYGVQGRTWLRPDGSHFDQLYKIYENLRRGIDDRGEILTFWNPGEFDQGCLRPCMHTHQFSLLNGNLYLDSFQRSNDFLLGQAFNMVQCYTFLALMAQITGNRAIRANQRIVNMHIYENQYKVLMEHGQFDRKPFPAPRLEINPEIKTLEDVLTWVSKDDFKIVGYKSHDPIAYPFTA

SEQ ID NO: 73 - protein, 77 aa, Unknown
  Description of Unknown: Bacteriophage F391/08
MGLFNRRPKITFSEREESQLKFLVQSSGLHIDVILGMVKYKGMDALMRQFAPKPPKENPPAKRDYNSNLLVPPAKLL

SEQ ID NO: 74 - protein, 91 aa, Unknown
  Description of Unknown: Bacteriophage F391/08
MSFTDAKAMAAKAKRSNDMAVIAARRSIISNIDGSASSGKTEVDSYALNGLPIAARSQIMEDLKDAGYEVKVNHPFDQRDTESITISWGHA

SEQ ID NO: 75 - protein, 160 aa, Unknown
  Description of Unknown: Bacteriophage F391/08
MFHVYTDGGCRGNTRGVDNVGAWAMVVYNSSEEQIGTKSAPKRNTTNNEMELQAVLEALLWSNKNPGRPMTIYLDSTYVKNGCESWVWGWERKGWKKADGDTPLNLDQWKWIIDELKKYRLNHNEIPTFVKVKGHSGVEGNEAADNLLNVRMTELEMEDM

SEQ ID NO: 76 - protein, 53 aa, Unknown
  Description of Unknown: Bacteriophage F391/08
MLENLRRLVSEMKYEVLLMEPGVDRVVMKLRIARMEAQIFEAEWKALRGGDEL

SEQ ID NO: 77 - protein, 116 aa, Unknown
  Description of Unknown: Bacteriophage F391/08
MAPDLRDLFPNVPQYQLDLYAAFLEASKSGNPLRVYRQDRRHGKSWILRWLKENEPLLKKLSERNSVQHRHTTKVGTSTSAQKSRQNISGGNRYEFIIFDDLVDENEKTQLLNAKN

SEQ ID NO: 78 - protein, 136 aa, Unknown
  Description of Unknown: Bacteriophage F391/08
MAKQTSKKAVETKVATFPKTEANRKARLERHLRKHPADTQAASAVGKPAPRRKKPVTKGSTSGYVSKIVGWSTPDKADTKEVLRKTQGRFGSVKPNIFGCEYSRENVRALCYGVGIKFTGKANKPRNQKRKPAKKA

SEQ ID NO: 79 - protein, 334 aa, Unknown
  Description of Unknown: Bacteriophage F391/08
MRNFVAKNDFNRAATHKSALDYSRVNSRELMDSCYEELEDWAADWPSMEENWDVSEDMTKPPPEVASKCDNTSRSNFNNKGNNMQNLQDRWISVCDIESLGTPGDCKSTFIAMPFFAFVLMKDLSLDPYIVLGTPNVAQQLALGAKVSAGTIAFWMNEARAGSAPSLSIIEALNAKDGESTVLVCNPTHESPVSKHTFMDLICPFVEAKQVIEGIIDEQGIDTRSLRHYGNGPQFDMSIYETVAAQANVFSPSDPAIVPWKFWDISSARNPRDYFEALGGDWKALVRCAEIYAHDVIERYNLIPEGVYPSKHDPVFDALVEAYCIKTIESKLKI

SEQ ID NO: 80 - protein, 153 aa, Unknown
  Description of Unknown: Bacteriophage F391/08
MKAAILMISILTSFHAQAKIDAHEIECIAKNAYFEARGEGVKGMTAVAQVTKNRVNYGKFPSTYCKVVYQPGQFSWVGKKKHKLDRKDEEWKQAKEIARLVYYMDLPVDPTKGALYFHSKDTKPYWTKDKDFKRTSKIGNHVFYKLKSQLPNA

SEQ ID NO: 81 - protein, 108 aa, Unknown
  Description of Unknown: Bacteriophage F391/08
MNDLSMLTKIRSDIESMVSRRSELTKAKQIISGGTQKRFTLQAGDIKFDLCGSQTRDYTFEMKPCYDMVKLGLIKALDKQIDQCTDAIKTLNVQFAAECDRLKNSIKV

SEQ ID NO: 82 - protein, 58 aa, Unknown
  Description of Unknown: Bacteriophage F391/08
MVASVHTPPYERPAPNLTPEQKQLIARRTLEFKESLHKSVGRYSEQVHDLVVKTLKLY

SEQ ID NO: 83 - RNA, 73 nt, Unknown
  Description of Unknown: Bacteriophage F391/08
gcuuccuuagcucagaggauagagcaacggucuucuaaaccgugggucacagguucgaauccuguagggagua

SEQ ID NO: 84 - protein, 97 aa, Unknown
  Description of Unknown: Bacteriophage F391/08
MAYKIEYLKKGVLTELVIDANMARNEGTKSVFYKDGSVARMINTEDIQDLYVISDEEAGFVKDPEPAEDTPTEDTPVADTTTEEPPVEGTPEDEAAV

SEQ ID NO: 85 - RNA, 72 nt, Unknown
  Description of Unknown: Bacteriophage F391/08
gggccgguagcuuaaaguuaaagcaguggccucauaagccaacgagugggaguuagagucuccccuggccca

SEQ ID NO: 86 - protein, 65 aa, Unknown
  Description of Unknown: Bacteriophage F391/08
MSTKNAIVSFVDDSGIVLESTVTDISPKRLLHRDGDILEILNKRSETMLVIPVNRLLSIKIVWED

SEQ ID NO: 87 - protein, 69 aa, Unknown
  Description of Unknown: Bacteriophage F391/08
MDAQLQTQYYMLLGMLEDAGPTVRGHYERHKAAFEALLKEVNENEGGKGSDSYAAFIIALQVFLINQLK

SEQ ID NO: 88 - protein, 164 aa, Unknown
  Description of Unknown: Bacteriophage F391/08
MLNIKRKGFFYKWLNFSSASFTYRLNDNRVTLCSLFWHSVWYFLLQIGVTAIAVLFSLGMGSILSTFLGLTFELGITPWYMLVGLSLAGLSTIIAILLAIAGIGWACAKIGDRIQEWNASKSFERAQKEYNARDEELRFGNIYQKMRIYKKDKLCPLIRVDHGE

SEQ ID NO: 89 - RNA, 73 nt, Unknown
  Description of Unknown: Bacteriophage F391/08
aagggaauagccaagugguuacggcaucggccuuugacuccgagaucgguagguucaacuccuccuucccuug

SEQ ID NO: 90 - RNA, 77 nt, Unknown
  Description of Unknown: Bacteriophage F391/08
gcuccugucgucuaagcugguuaggacaccacucuuucacagugggaacacggguucgaaccccguugggaguacca

SEQ ID NO: 91 - RNA, 79 nt, Unknown
  Description of Unknown: Bacteriophage F391/08
gggggaugggucugcugggaguggacaccgcacuugcaaugcgggaaucagaacgguucaaauccguuauccuccacca

SEQ ID NO: 92 - RNA, 87 nt, Unknown
  Description of Unknown: Bacteriophage F391/08
ggggauguggcgaaauuggcagccgcgcuagauuuagguucuaguggugaaauauccguguggguucgacccccuccaucccuacca

SEQ ID NO: 93 - protein, 78 aa, Unknown
  Description of Unknown: Bacteriophage F391/08
MNIEIMQLDRKKNEFRKVHTFPSKEALEFHIKCMGLVLPESEIFDLACANGVLYVWEITYHADPDELRKEVEQILTGE

SEQ ID NO: 94 - RNA, 85 nt, Unknown
  Description of Unknown: Bacteriophage F391/08
ggagaguagugcucaugggagcaagcugacuugaaaucagucgccaucggaaacggugaggguucgauuccuuuauucuccgcca

SEQ ID NO: 95 - RNA, 86 nt, Unknown
  Description of Unknown: Bacteriophage F391/08
ggaaagcuggugaaaugguagccacgcaucacugcuaaugaugaguccgcaagggcaugaagguucaaguccuucgcuuuccgcca

SEQ ID NO: 96 - RNA, 77 nt, Unknown
  Description of Unknown: Bacteriophage F391/08
gggauauuaucauaacuggauaaugaccucgauuguggaucgagucuaucuugguucgaauccaagauaucccucca

SEQ ID NO: 97 - RNA, 75 nt, Unknown
  Description of Unknown: Bacteriophage F391/08
gcaccauuaguuuaauggauagaauauagagcuacgaacucuaugguugagguucgauuccucgaugguguacca

SEQ ID NO: 98 - RNA, 75 nt, Unknown
  Description of Unknown: Bacteriophage F391/08
ugggguauagcucaguagguagagcggaggucucugaagccuaggucacaaguucgauucuuguugccccugcca

SEQ ID NO: 99 - RNA, 77 nt, Unknown
  Description of Unknown: Bacteriophage F391/08
ugcaccguagaggagaggccguccucgccagucucauaagcuggagaucgcaaguucgaaucuugccggagcaucca

SEQ ID NO: 100 - protein, 64 aa, Unknown
  Description of Unknown: Bacteriophage F391/08
MMRISFTERVLGTGVMLITSWDGDSWCNVTGLRKSEQTPENIAKIKKRMAEAASRPGAPRNGKR

SEQ ID NO: 101 - protein, 59 aa, Unknown
  Description of Unknown: Bacteriophage F391/08
MVNVEVTMTRYQGMLINTHTKEIVFLAPAFHDTYNEAEEDARIAKIHPDEEICVRQQEQ

SEQ ID NO: 102 - RNA, 76 nt, Unknown
  Description of Unknown: Bacteriophage F391/08
gcuucaauagcucaguugguagagcaaacgaccgauaaucguuaggucacugguucgaguccaguucggaguacca

SEQ ID NO: 103 - RNA, 77 nt, Unknown
  Description of Unknown: Bacteriophage F391/08
ggucaguuggcagagaugguuuaugcacucgcuucauacgugagacuacagugguucgaguccacuauugaccacca

SEQ ID NO: 104 - RNA, 76 nt, Unknown
  Description of Unknown: Bacteriophage F391/08
acuugcuuagcucaaucgggagagcaucgucuuuacacggcgaggguagcugguucgaaaccagcagcaaguacca

SEQ ID NO: 105 - protein, 93 aa, Unknown
  Description of Unknown: Bacteriophage F391/08
MEKITATGIESALVVDWAGWDGDHEWMVFYSCTLQPELWTRLTDEHAMPYGIIDVEIEINKLVGTIMVHRAEGDHKEIFRKSIKLVVSTGDFI

SEQ ID NO: 106 - protein, 125 aa, Unknown
  Description of Unknown: Bacteriophage F391/08
MYTRPTNGNSAVVRLMIVQDNLSNNIESLDRRIEEYRTEMLSLMREREAKIEEQLEVCEAIDRLVDGTAVFMAEAPAEPTFTPVAPADMQYAILPFHLEEEDGEGPSLEDVVRFLLASGFPNGGR

SEQ ID NO: 107 - protein, 71 aa, Unknown
  Description of Unknown: Bacteriophage F391/08
MDFIVVCGANTDCFELLNDALDKVDEHMQEGRTPTFIDLSQGKTYFYPSLDVEPTVLPIFMHSLSWDEEDD

SEQ ID NO: 108 - RNA, 77 nt, Unknown
  Description of Unknown: Bacteriophage F391/08
gcggcuaugguguucagcggucaacauaccggccugucacgucggagccacggguucgaaucccguuagccgcgcca

SEQ ID NO: 109 - RNA, 78 nt, Unknown
  Description of Unknown: Bacteriophage F391/08
gggagagaagcaguaagugguauaggcggucgccuguuaagcgaaugacagugaguucgaaucucaccucucccgcca

SEQ ID NO: 110 - RNA, 74 nt, Unknown
  Description of Unknown: Bacteriophage F391/08
gcaucauuggccgagugacuaggcagaggcuugcaaacccucgaagcaugguuaaaauccaugauggugcucca

SEQ ID NO: 111 - protein, 59 aa, Unknown
  Description of Unknown: Bacteriophage F391/08
MIKYKAFVTRESQTGDSSIKFEGTTLHDTFEAALTEAETHIVSKSCYAHVWEVNTILDR

SEQ ID NO: 112 - RNA, 76 nt, Unknown
  Description of Unknown: Bacteriophage F391/08
agaucgcuagcucaaugguuagagcacucgccuuuuaagcgauagguuccggguucgagucccgggcggucuacca

SEQ ID NO: 113 - RNA, 78 nt, Unknown
  Description of Unknown: Bacteriophage F391/08
gcaacuguagcucagcgaggugagagcacugguuugaaaguccaggggucguucguucaaaucgaaccgguugcacca

SEQ ID NO: 114 - protein, 64 aa, Unknown
  Description of Unknown: Bacteriophage F391/08
MNQKILMRYNPRALWFRWEVIVSYQIRVRNGDPENNIIVLETFSNRDAAVKFLNTIDNTLIKVY

SEQ ID NO: 115 - protein, 112 aa, Unknown
  Description of Unknown: Bacteriophage F391/08
MDIFTTPAINLVGVGLFQATVYRIDDSTDVVTFIVPEFFLEKFFEEFEQFREEHDAYSNMEDLAAMFPTVYGYIFEGNDLLLDKSELVELNWGISFEVGSPFPRYFQGLEIR

SEQ ID NO: 116 - protein, 49 aa, Unknown
  Description of Unknown: Bacteriophage F391/08
MGGYSNFIENYINSVDSWNQETLVVVLKERFNISTLEALEAIEAYLDND

SEQ ID NO: 117 - RNA, 78 nt, Unknown
  Description of Unknown: Bacteriophage F391/08
acccacuugguccaaucugguagaggcaugaggcuuaagacuucaggguucccgguucgaguccgggaguggguacca

SEQ ID NO: 118 - RNA, 77 nt, Unknown
  Description of Unknown: Bacteriophage F391/08
uuccccuuagcucagucuggcagagcgggcgcuuugggagcgucaggucaaguguucaaaucacuuaggggagacca

SEQ ID NO: 119 - RNA, 76 nt, Unknown
  Description of Unknown: Bacteriophage F391/08
gccucaauagcucagccgggagagcaaccgccuuguaagcgguaggucguggguucgauuccuacuuggggcacca

SEQ ID NO: 120 - RNA, 76 nt, Unknown
  Description of Unknown: Bacteriophage F391/08
gcgacuaacuguacggguuacagcguccgccuuccaagcgguacugagugggguucgauucccccuagucgcucca

SEQ ID NO: 121 - protein, 33 aa, Unknown
  Description of Unknown: Bacteriophage F391/08
MKAFDAELVFSLLAEMEACVDRVRALRLSMFSS

SEQ ID NO: 122 - protein, 63 aa, Unknown
  Description of Unknown: Bacteriophage F391/08
MLTVKVMSPNGGEEIHDGSSVGFNPKQKSISIAGLDQHIFLKEDEVAYVMNQNGKTVSVYHGS

SEQ ID NO: 123 - RNA, 77 nt, Unknown
  Description of Unknown: Bacteriophage F391/08
auuccccgaguguuacuggacagcacgccggucuccaaaaccgugcaguaggaguucgagucuccugggguuugcca

SEQ ID NO: 124 - protein, 118 aa, Unknown
  Description of Unknown: Bacteriophage F391/08
MITYSTNFMGPVSNNWYIRMGIPYTEVTEPNRFADGGQLTRKVFAKRYAGGRIDVRGTDDYFGQEIGVPIMEAESWNELQQFLWTFSSDKVLTLEQIVQALEDETGFRIVWFKEPACT

SEQ ID NO: 125 - protein, 126 aa, Unknown
  Description of Unknown: Bacteriophage F391/08
MYIDRNQLFKFLELDLRWPLSVNPGRATGKTFEAINTAYEFAVFKGIQAVYVASGVREMARLEKKYNELQPHVKITTYSMLEPYRIGRRFSCIMFDEPSLAIKYGVNAYVVRIARENQCPVIIFGE

SEQ ID NO: 126 - protein, 58 aa, Unknown
  Description of Unknown: Bacteriophage F391/08
VEQEFQVFVDASKRVLFIQATDEGHGLQLSFDSLEQINQIVLRAQKSLEKNTEAPPDL

SEQ ID NO: 127 - protein, 71 aa, Unknown
  Description of Unknown: Bacteriophage F391/08
MREISKMKVTMENTEEFIAICTAYADTLPPEGMDDHTMQLVADIYRLAELAKEQHNRLVYVKERLEMMDKE

SEQ ID NO: 128 - protein, 90 aa, Unknown
  Description of Unknown: Bacteriophage F391/08
MNELNELNELHYAERAIDELDFAGGYYTRHVNAMTAEGLNSKSAIAAELAVRDFVIDSLQKTISNLSENNKAALEALDKLSNHLLALGIK

SEQ ID NO: 129 - protein, 180 aa, Unknown
  Description of Unknown: Bacteriophage F391/08
MNKQSLRGIRVFRSSLVDSFYIWGKATRRTVEQALDGTFYDWREKERNPVFSRPGLYHDRVSKTAWYEIEVTPGVIRAFYTDWEHEKWVWDNQIAPGDRIMNYAEYKEMKRMFELYDVPRLSRPAIFIASQEYWHTVRMKRDFNKHHLRYEKEHGTLRERVAKRKAELREKRLEKKYGES

SEQ ID NO: 130 - protein, 75 aa, Unknown
  Description of Unknown: Bacteriophage F391/08
MVKASLLRFTPGVGLQYKIVGGHKFQYFTPGKLYFVELHDSRAGYKLRSDANEGIWVSFTQVKRWFTVEGYNDYE

SEQ ID NO: 131 - protein, 122 aa, Unknown
  Description of Unknown: Bacteriophage F391/08
MIMSKVVYFVKCCRDTLELVDHKMQTCKCGASSIDGVAGAYVRFLGDKSNFMRLNEFQLEVEKNRPALEAEAERLKDFDGNIVAYNMVSGKDFWSELAEKLNMPRQAAKALYHGFNYSPRWN

SEQ ID NO: 132 - protein, 88 aa, Unknown
  Description of Unknown: Bacteriophage F391/08
MASTTRHVGIKFSNSNRTYVYRVPSYWKYSPEIGDVVVIPGNVMFNNPRRAKVVEVHGMYGKPEYKERKNISYVELHDYLPKEERNGR

SEQ ID NO: 133 - protein, 101 aa, Unknown
  Description of Unknown: Bacteriophage F391/08
MDDKIAREAIELVRKRLEERNVEVPKIMLIGYGGIGGFPSFTDLERMERESQASFLELESYAREMEHEHPIGNNFMPRSSRQEVTHGKTNSWPTPKRRGRK

SEQ ID NO: 134 - protein, 69 aa, Unknown
  Description of Unknown: Bacteriophage F391/08
MITTGFGYSHEELCKMVESAPFIKKLVEEQRPVCLHAACTKCHGTGVDKNGKMCVHALSCPCPKCSWSC

SEQ ID NO: 135 - protein, 145 aa, Unknown
  Description of Unknown: Bacteriophage F391/08
MDLGYCVVHEFMEQGLPDRICVVTSRNLEAAQSLVERLSGYYRDHERYQQKVFDLTKLYHQKALDMPTPQLDDLKQFSPEAWYSVKDASPVDYTVQVFSHYGTRHWINRKWDSMVDYLNSELEKGAAEYKRKRAEAKVLKNSVAL

SEQ ID NO: 136 - protein, 107 aa, Unknown
  Description of Unknown: Bacteriophage F391/08
MSKLSIESIIRPLMHGYVQGSCVSETEALNVIEEELVANGYNLHEGVIEDLFWQTAEDMEIFRCVNCGWWCPAFERAENQIEEICRDCEPDLEGEVDEQDNEGEDYE

SEQ ID NO: 137 - protein, 99 aa, Unknown
  Description of Unknown: Bacteriophage F391/08
MNKITKVKTMSKRSIAAIIAFSMMYSGVSLAAERNKVEISDNGRVRVTTNGITKGAGKFRKSETRFGETKIYTNKTYGKPAVTLDRYGRQVEDEDDSDE

SEQ ID NO: 138 - protein, 144 aa, Unknown
  Description of Unknown: Bacteriophage F391/08
MSNLHPKLQETLDWINEECAFEEAPYCVWARAGAAPSEWCTVFDNRYRITVELSLKEDKVYAKASMTALGLSGFVEMQELCMPNTHLRVQIEQLATIRLMLPEDNINDHFHKVIENEYKLRRQRRKARREVEKTRMMCNMNPHV

SEQ ID NO: 139 - protein, 130 aa, Unknown
  Description of Unknown: Bacteriophage F391/08
MFTLFILAVSAWMAVGINHGLDSAKLLSAKAFEFLAKFATRKDIEAIIAKGGAKDASSVLKSFDKILELRNGKHAAELRCMSRKTIGRLCKAIFIVQGALKGPFAKYKPDSIKRAKIFNDYCVEHHPLNR

SEQ ID NO: 140 - protein, 232 aa, Unknown
  Description of Unknown: Bacteriophage F391/08
MRIISKLKDVYDLQGTMYDAERAWYREEVKEVVNVSADFEQIIFYAEILRNRTSSGYGGVNMGTLEVRPVLICGTLRWLYGYHTGLGADAVHIQTFDPVKVKEVLEEQGYYLRMGWDMNTIEKIDAHVRNATATASAFLETFNKPIAMAWDAAKSKTDPTVNITVKTDFNFHAEDFPWQEIDPNLYRWHQTLESYIFGVLGQGEPKTESTSDRDRLIAKGFDAKVSFRNMER

SEQ ID NO: 141 - protein, 153 aa, Unknown
  Description of Unknown: Bacteriophage F391/08
MLKFLSGIWSGKTGAILFLAIAAGTFGGAYYITNKLTDMSSSLQSLSNRNEQLEKTVGNLQTEIRNRDRNTTTYITNLAKNQEDLDGRINKLDAARAKEGVVAAKPKLATKVAKDKVNEFQERLSCVTGNMDSCSRLQLSHPGVQNGQTQVAQ

SEQ ID NO: 142 - protein, 109 aa, Unknown
  Description of Unknown: Bacteriophage F391/08
MRNWKYGLLLSAAIIASGCAERPDPSSTVTGVEPQHLPWPASLQTCPFNFEFINEEGKVYVRIPYQDWITMGKCNEQVYTYIANLTALTCTYRVSLNEYRCKPFNKETK

SEQ ID NO: 143 - protein, 253 aa, Unknown
  Description of Unknown: Bacteriophage F391/08
MKYVLGLIGDAGAGKDTFADMAKVWAWEVLGPEYSISKFSFAAPVYELAAVILGVTPEKLAERRTKEIKQWFWVTQEALERTANVWKRFGIDKYADFSYVWPQFEASALYPLIAKTAPDFYQGRETPLYPLYTSPRKMLEFVGTELGRALVDENLWLNIVVDRITATKADISIISDVRFDNEAALVRNFPGAQNSSILKVHAPNNIHAIQSTHASARGVAPEFIDDVVTNNFDGLENFRKNVNAFCDERILFI

SEQ ID NO: 144 - protein, 203 aa, Unknown
  Description of Unknown: Bacteriophage F391/08
MGQINNVEQKGGNKTPNYFASLVATKAEYNIYHYHLDGPIVDVDYYRDLSVTLATMQEGDTLNLYINSPGGYVDTAVQLCNLIMNCQGTVIGHLVGPSASAACSIFLACHGWLVHPYVMLMGHTYRGAHYGKGKNEIQHYADQFNSFFEDMMLDLYYPFFSLEEITEMIEGGKDIWLTSKEINERVDRMAAHREQEARKAAGQ

SEQ ID NO: 145 - protein, 220 aa, Unknown
  Description of Unknown: Bacteriophage F391/08
MDKFIQLISLLLQEAKDPASLLKRLLTLLVGLVIYLFIANTSEVMSYLKTFSTSAVLQDVKVQRTLEFPNVAREKAMILFSQTRADAVFVVKYKPEAINDYQTIIAWESNVQLDKSDVSDKAVDKTSMLYRAHLDGLNFAIDAREKRGLSKWSGTGLPPFKSANFEYVYTCPYFNLNNIYSGYVAVAWEKYPLQDEDMGMFNDYMAKICASPQRSLGRSI

SEQ ID NO: 146 - protein, 137 aa, Unknown
  Description of Unknown: Bacteriophage F391/08
MSFRFGNRSLQQLDTVDPKLKALAIRALELSPHDFTIIQGKRTVQQSAQNIANGTSFLKDPSKSKHVTGKAIDFAPYINGKIDWNDLEAFWAIVGAFKKAANEMNIAVRFGADWNNSGDYRDEIQRGTYDGGHVELL

SEQ ID NO: 147 - protein, 134 aa, Unknown
  Description of Unknown: Bacteriophage F391/08
MSDRFYTQMCEHFKVSPYELNIALWDRESPEFKKIAKKSEGVMSNGKKMTRIDLNNALTKLLGVNIEGQKLSMPTLTTILEKVKAGDVKKVAVPEGRLKKPYQEAIIEAFGEKLDLDTATVKTMKALLESINNV

SEQ ID NO: 148 - protein, 94 aa, Unknown
  Description of Unknown: Bacteriophage F391/08
MSKKIVFLKGSSCVPCKQFEPVFDKLTAEFNLPVEKRTDDVDSLRKFGLRTVPAVVLVDVENGREEAHHILSGATLRSAVVSKAIQDFIDYVEE

SEQ ID NO: 149 - protein, 134 aa, Unknown
  Description of Unknown: Bacteriophage F391/08
MTKQAYLILNNGFAVGTTFVDLGYTKEEWQALDAAQKNQLVNEAAWEYAEAYVEAVDDELVIVVSLGAVGCDAHVHTDFQSEEEWDELDLTHQNALINEAFWEVVDCYVAFCKDDDEANTCTNYGYEHDDVECA

SEQ ID NO: 150 - protein, 120 aa, Unknown
  Description of Unknown: Bacteriophage F391/08
MQKFSRDWSSDMARKNRAAAYYNKKIQLDKLIKGITYNVERGFSGIKVDARSLDYSCILWAKQNGYAFKRIGNEILIAWEPEGLVQYVIYDPYRGEYVRDHRQQPTDFSLPKRYYLETRY

SEQ ID NO: 151 - protein, 276 aa, Unknown
  Description of Unknown: Bacteriophage F391/08
MNVHETVTVPDNANIFFIGDIHGEYDMMMGALKLAGYEEGRDYVFCVGDLIDRGPKNLQVLAKFLYNPKFRSVRGNHDEFMIQDDYANWMYNGGSWTITEGFDTDTMKGIAEDMDSKMPYIMTVEHRGKRYGVVHAGIPLRYQAQGMGVTVPVWDDIVHEHESTPDLRRLGVLLWDRDVIQEVGFNLYRSGEKHPYFDRYASFSEECAVDVPEIVGVDYTFHGHTGVPFPIRWKNRVYLDTGGTFNGRMTVASPVLGQLYTFTTDRDDPCGSADII

SEQ ID NO: 152 - protein, 77 aa, Unknown
  Description of Unknown: Bacteriophage F391/08
MKLFKDLEEGEVFVVAGGFELQKCVAMLDNGNSVFTDDANISVTIAPDTETWKPKEFWEIHKDRPLDDLLDDILFTA

SEQ ID NO: 153 - protein, 122 aa, Unknown
  Description of Unknown: Bacteriophage F391/08
MKLESRYIVFKQSDAAKYLTSTAIREINDSLSLIYKGREADGKVGFPNYIVLEEDWPEYPIAKEALEGRIVLEEFNKRAEKKRGAKAAEDHYKQHQSTELLRGISPFCAGWNDYMRRLVIEE

SEQ ID NO: 154 - protein, 39 aa, Unknown
  Description of Unknown: Bacteriophage F391/08
MYTGMGNDMAKMFIGLLILAALVGAAIVGGIWALVAFVF

SEQ ID NO: 155 - protein, 142 aa, Unknown
  Description of Unknown: Bacteriophage F391/08
MKNAMIELNANMESLRHAVNTARASFNLLMRDESIPLSARVKAFEEFADELLHMGDYLSDSPFNEDRRDYQHAYCNRGEIVYLTDVLESVLEYANSFMRTPDEWEDASNDYVLDEIQKNWPEIKKLVEEHIHSEVYAYRIDW

SEQ ID NO: 156 - protein, 101 aa, Unknown
  Description of Unknown: Bacteriophage F391/08
MAKNTISYTTGKTADEQANTLTKDEMVAVLVILLDMSGFEGQLAKLSLPALRALYEGTNKNAAAYNLAKNEARWAKEHQQVAERRAESFERDLKREKAKKK

SEQ ID NO: 157 - protein, 93 aa, Unknown
  Description of Unknown: Bacteriophage F391/08
MVLEILSGLLIAALVTGTGLAVWVSILRENNRRMRLTNNGLHEKLMDQVQDADEFSAAAERLLVRLAKIEEIIGQDSTMSKTTKMRLITEIKK

SEQ ID NO: 158 - protein, 82 aa, Unknown
  Description of Unknown: Bacteriophage F391/08
MISPIVAALYLVVVGYLSGKYHGFGLKGTIKAAMLVPLYPLAILLTGYYACVLRIFGRGKVNYDNCTALLDDIENTIKKEEK

SEQ ID NO: 159 - protein, 113 aa, Unknown
  Description of Unknown: Bacteriophage F391/08
MNLNSKERQVLVDALRQVVDHDLLCDEDIVESIALIAKIELAEKDSWRPLSELPPLGLAIVVQRADGAPFNTVMVRRDLAKSYSPDIITLHTKITNEPFEFNTRHYYWRLTNA

SEQ ID NO: 160 - protein, 75 aa, Unknown
  Description of Unknown: Bacteriophage F391/08
MLNQLRIYNFLDCNFQVWRELPSRFLGWALFLSMVVSVFHNVPATFYMEAIQPVTVFIYEMYLVAINGWKDGRIN

SEQ ID NO: 161 - protein, 155 aa, Unknown
  Description of Unknown: Bacteriophage F391/08
MAASTEVLNQYFNREHQEFSDLFIQMFVNANNALDYRFFNEFHETTFSHQDINSALKELIGSKVIPFRQTANAETLELSVVWGLFKKAYEFGKYQNARHWIYEVYLNTEVILPRQMMLGWIAKQRPERNAKSFAPINDGNLYHASEKFDAPKSVA

SEQ ID NO: 162 - protein, 108 aa, Unknown
  Description of Unknown: Bacteriophage F391/08
MLLVEGLTEEDICLNSFYNCKTHVMQALDEERVELSKFMVNIATAQVHWQTQGLSADDILKHTLNAIAEYGKARGEALLASKKEFDKSESMLKMAIDIHMEGIDGTIH

SEQ ID NO: 163 - protein, 95 aa, Unknown
  Description of Unknown: Bacteriophage F391/08
MAKKRVVVNFLEEDSGDCEYGCWNTGYGVEVMVDGKCVHRQEAWASCTNNSSVDFDVLAHVLQGIKTKEGYPVKADHIDFGDPSDYPEEFLDLFT

SEQ ID NO: 164 - protein, 62 aa, Unknown
  Description of Unknown: Bacteriophage F391/08
MKSIDNYLRGENPVDQAAVTVEKVRKECFILTQRGGGNRPNRVYLNWTQSKDLYERLKREFE

SEQ ID NO: 165 - protein, 158 aa, Unknown
  Description of Unknown: Bacteriophage F391/08
VEELRQKINQELVWEAKSFPINQFLKRDGSINHNKIKQLRPDFRQDAKNLIFINRALDAHGVFFGYEKLVFHSLNQLVEIWCPDHQDYFMQTARSHLEGNGCQKCRHRMVTRVTDYGSYTVPAYYHKFSIDGDSIIWYNNSSKLIKPLEVKDEIRFPE

SEQ ID NO: 166 - protein, 133 aa, Unknown
  Description of Unknown: Bacteriophage F391/08
MKYDSLNNPSTNYLTDQSVSEIKFHPNYSPDSSKPSVAAISFRFRNLRFTFVGEEDKMISIIDKVKAVSELSGSDTVKFEALTSLLLTSGATVGKFELIQPHVSALTNTRNFWDQANVESLIKWDSATEFYNK

SEQ ID NO: 167 - protein, 169 aa, Unknown
  Description of Unknown: Bacteriophage F391/08
MLFCTVDFEEANETYIVYGMSESKVRILWNQFQLEVPDDISKTPKDFFHLIDIKAVKARKKLTPYVFPGAVFVHELTAYTNVVLKKSRQHPGYLTMLTYKVGAIHDGELVVRVDARLQQEVEEMIRQCQNKAELKQRARLFDMAAPSEAVAAYHGFYKEIAESDEDFFM

SEQ ID NO: 168 - protein, 106 aa, Unknown
  Description of Unknown: Bacteriophage F391/08
MNEKYEVWTPVGENCSYLLRTLCTREDGTSFSEYLSECHAKAQQDNPLFKIRGEDILKVNGVPYTPVDSFAALQVFKEHREREHRRMIERLTGREPFSHPRWNEET

SEQ ID NO: 169 - protein, 254 aa, Unknown
  Description of Unknown: Bacteriophage F391/08
MSRVEKLQHIYNLVKKADQKKLSELSEEEYQAVLFCCSAMPAKLDGVLAKSDIHNGKETTFQPPYKWLASNIQQMVGKVTGFSNRKTPNIFIDITPRTPEFTKDWRDALDSFPSWKVFYKPDDETYAHLPFLKHPGYTVEDPSSGVNFKDFKCTDENIAYGLMRTSVRIAMDHELDKQDLAVIALCKDRYIKVKRIAEKLSVLSCFETIRDCEPEGEYPKGSLYWKDVKHLGLSEEAVFLGLVVTGRFLRLQEK

SEQ ID NO: 170 - protein, 109 aa, Unknown
  Description of Unknown: Bacteriophage F391/08
VGYSRDPFYRLNSLQLHRLPHRGLQDIVIHSVYIIDDASEFSAKLLEKAAHKKFKPMRVNFGDKFDGHTEWFDVEPHVIEKFFLSVGAKQVPIDKLIAQEQKIRKSTKK

SEQ ID NO: 171 - protein, 56 aa, Unknown
  Description of Unknown: Bacteriophage F391/08
MRTLRGGSPKSRSHNTYQLNVIRDGQKKGGDGGGGEWGFRVIMVIIMTLVFLQSCQ

SEQ ID NO: 172 - protein, 321 aa, Unknown
  Description of Unknown: Bacteriophage F391/08
MLQKFTPVANLPMVRGGARNLLDGSKCASIGHILGVYRSNMESRTSRAFEHSRDYVLANPGAAIVIFHDDQYLVDSQPIDLIVSTTTDAYLYKASEGKQASRRFCYHESELLAFTDARAWIKNLCDHLELPPARISSEMMIFVLDKDGSILLPCDPYDIDIEEGARTGNYRYDGELEEVAPAVTENVVNPNNFETGALQMNTIKSTATAIVAANKNAAVNAAKLEAGSIVLKKVSGIAASKAPFMVRGYVDTAVGRVVIANLLNFAVSQYAPNNRKAVIAADAAMQAAMLELVQSFNVGEMIDEVLKGVNLSSLIESDVAE

SEQ ID NO: 173 - protein, 164 aa, Unknown
  Description of Unknown: Bacteriophage F391/08
MERLTATFEGEKMTIANVWQRLRQNGDRGNFAIFIEPKNLDNLARQIDRRDCYPDTDDMLGIPLRIIGVYGYGFDICIGDSSFEIDCESGATEIEVFLINLGSLTFLDTPPAEPEPEKLEVKTSVIVSSLTMDELADIVSTYDEIHADAIKELNNRLDTFRDKL

SEQ ID NO: 174 - protein, 175 aa, Unknown
  Description of Unknown: Bacteriophage F391/08
MFHVKSCVPGINYTVEAEEGLYLEGGRIESQEVAAVLKCDTNVCGTSWTDLHFLGRGIDVDSLSWEKACEHAESMLNEDDWDDDDSDEKYANAGVEGSFYMYWPGHSCNLVNGGSPLHSVLERAIYLGYIQIVDGKAVINLRELKTFIYIPDAETILHIEEGLKSGWKVSGVVYL

SEQ ID NO: 175 - protein, 115 aa, Unknown
  Description of Unknown: Bacteriophage F391/08
MIYIYVNKYFLAHYKTMESVIQYVSRQNARHIDEVATLKIGLRGDAINISWPLLILICRDLVAGKPVSVSALGESYPLSDDLDLYDLLTKYKTERLFYRGGSVCSSGETIETVFR

SEQ ID NO: 176 - protein, 44 aa, Unknown
  Description of Unknown: Bacteriophage F391/08
MLKENVMSSEIVNEFTVADAEHFIETYLNVYDVDLAFIHKDGQI

SEQ ID NO: 177 - protein, 88 aa, Unknown
  Description of Unknown: Bacteriophage F394/08
NPEQGQAAAAESTPADPAANVSRETKPEDLIKNDVAPAELTPAFYVVAEGRAITSKRGILAAGEAVEARDFVGGEETLNSLLERGLVE

SEQ ID NO: 178 - protein, 151 aa, Unknown
  Description of Unknown: Bacteriophage F394/08
MNIRDLAAQDFLNIVNDKNSGFGVPVVLIAPDGNAQPLSGLTTDISSYIDPETGVLVAGRVASVTFANKAIRAAGFAEMPVAVADSNKRPWVVCFRDPEGIPYLFKVVKAMPDRAISGIVLELEVYKRSIYFNGAYKFDGTTLYDGVLDLL

SEQ ID NO: 179 - protein, 225 aa, Unknown
  Description of Unknown: Bacteriophage F394/08
MNIEGFKKLQSPINKLDSFEIVRDQIAAILFLELENQKAIAGRAQIDPARFDMKVYKERSNPWDLFDDGENKPIINVWFSNSDFDYTNSSTVDKQKTTAIFNIDCIATAISQETATGQTLGDEMASLEVQRVAKVIRNILMSDTNTYLQLRGLVWSRRVLSLNIFQPSAENGMMQNLCAARLVLQATFSEFSPQYEPQELEILSVTVHNCDGQILFNKEIAKNGN

SEQ ID NO: 180 - protein, 500 aa, Unknown
  Description of Unknown: Bacteriophage F394/08
MAISTAVDISAVARVLGIKTNFKNLRDGRVVILPQRIALIGQGSTGMVFATSKRQVTSANEVGSLYGYGSPLHLAAKQLFPNNGDGVGTIPVTVYPLSDADGSQAATGSIELLGTQLESGAYRVVVNGIRSEQFSILINEAGQTVLNRVAAAINSVLDMPVRATADSELQKVTLVSKWKGLSANAISVQVDGDLGQGIEFAVTQPAGGLINPSVSGALSQFGNVWETMVLNCLNIQDTEALSAYSDFGEGRWGALVRKPLIVFTGNTEADVNSAVSVPDARKRDRTNVQLVAPDSIDLPFVVASRQLARIVKIANENPACDYGSQVADGINPGEDGKQWLYNVRDMAVKKGSSTIEIRDNQVFIGDVVTFYHPEGEENPPYRYVCDIVKLQNIIFNLNLIFAVPEWDGAPLIPNDQPTTNPRAKKPSMAVAAIASLVDSLGLNAIISDAAFTKKNTFAQINEQNPKRLDVSTTVKLSGNTNILSVDLNFGFYFGNSVIVG

SEQ ID NO: 181 - protein, 125 aa, Unknown
  Description of Unknown: Bacteriophage F394/08
MSVGGSIESLTLDGRTFSVAADADSTRNLGGTDNEVEMNGDGTYRIVKTRVPSKLDGITVAIDDVRGDAEYLQELKDRKEGFPYSITYASGVIYQGTGTIVGETGISSQNATASITISGSALTKQ

SEQ ID NO: 182 - protein, 148 aa, Unknown
  Description of Unknown: Bacteriophage F394/08
VEHIENTENQTLWGLPVKVAREVAEAEFIRFCDAMDVDYNTDRMTDEDAKDFNESKGLLLDALQIGVLEIDSDGMAVVYPKKGDIKQIKFNELCGADYVAMDNKKDTQSFAKMFAMMGSITKLPPATFSKLKKFDAKVCLSIAKLFLV

SEQ ID NO: 183 - protein, 497 aa, Unknown
  Description of Unknown: Bacteriophage F394/08
MQSGISRFTRRAESGLRRVSDMTWNISKVSGAAAAAIGGAFMAAAGGIALFVAETNRANSEINEMSKAMGVSALSARAADSLLTPLGMNWENYTDLIEELGNKMGELKNTGEMKTFQEAIGLTNIKMKELKALKPEQQFTRIMDSLAKMEDQQKAQFIADEIFGGEGNKFVSALKARGLTMTSLIENYKKYNFYNEQGEKATAAFNAALTPLTTTANSAKSQIAALTGGAMVPYIQKATEWAAANKELINSKIEVFAKGLADSLVWVVVNFSEIVTWVKRVAIGIGIFLALTAVLKTFVLIMTAVNLVMMMNPIGLIIIAVVALIAVIAYLINKFFGLQGVIAAANGVLMGIGAAILVAMGPIGWLIGAAVLIWKNWGVLSGFFSGLWAGIVSVFQGAQNIIMGIINGIMGAIDNVINKAVSMGSAVKGFFSFGGGGGDQKQAAAAGGRVASPQERTAKSVTENNSHSTVTIQDKTGRAKMSGKPGNGVRLVKTGTM

SEQ ID NO: 184 - protein, 410 aa, Unknown
  Description of Unknown: Bacteriophage F394/08
MSWEDRLKEAAYTAPGGTRATFLVEDVSRSFDKKTNGFTFPDASGTYVQDSGVSGFKYPLTIYFSGPDCDVEAEAFEALLRETGIGRLEHPLYGVINVVPFGTITRTDAIKTEANQTKIELEFWETNLLIYPLPQADQLSAVFEAISDVKAALSGDVLDSIDVTDASALARFKNKITGALSKVKTALGKIKNLADLPGQLMDKVNGLISPGLEFISDVKAQLGDVVNSFFELATLPEQIVDSFKEKIAVYKDLFSELTSFEGIFPSNEEYEAACTGVTVTLSGLVVDLVESEFNTQSEALEAAEDLLAIFDDVTGWIEEKAQGLGRTDSNAVYQRLHSAVMTAASYLVQQSFTLKKERKLVLNRSRTIIDLCAELYGEVDSALDFFITSNDLSGAEILEIPKGREVFYYV

SEQ ID NO: 185 - protein, 398 aa, Unknown
  Description of Unknown: Bacteriophage F394/08
MSDVSMMIHGTRFHFWSGVRISLNIDAVATISFNAPFDHEAPGFKRNFAPFGFSPVAIDVDDQRLFTGTMLDVSPVISEDGKKEISVNAYAKCGVLQDCTAPPESMPLEFNKLNLLDIARKMASYFGVGVVFNADPGPAFDRVACDPDKKVLEFLADLAKQRGFVIGSDENGNLLFSKSSIGGIVAKLEQGVSPLLSVSPTFNPQEYYSHITGLSPVEVAKPAAKSTAKVKKDAATPEKAGQGSEKATDKAGQAEIKKEPKKEEKTKKEKQKPKPTTYKKFTAIDEAPVYRPLVFKIDDAEGATDVETATKAKMARMLGNMCTYAITVSTWFDASGDLWRPNTKIKLKAPDSMIYDFFEFDIKSVELSADENSQQANLTLCLPGSFTGEPPEIFPWEL

SEQ ID NO: 186 - protein, 161 aa, Unknown
  Description of Unknown: Bacteriophage F394/08
VGIVATVLSNDGKDLKVDRGNGDNVTAQQFGPSGDDAPPLKNDYSVLGSAKGSGNASAVAYRDQKAENYIAKAGEKRIYSRDESGAVKAEVYLKADGTAEIKNASGLFVMEPGGDVVINGVRITKAGVIQTPGGASMSSDFTNAGGITLGDHAADTSLHKP

SEQ ID NO: 187 - protein, 245 aa, Unknown
  Description of Unknown: Bacteriophage F394/08
MSFFDVHLFDSVDGGNVTDDLETRDGLETAVYLSLFGGNALDDGRPQNLSTWWGNIGENEAAKQYKSEAAFLLRTVPPNTANLKRIEAAASRDLAWLIPEYVNKIQVKAFMPKLNAVNLTVSLDGLDPLQFRTNWGEKVKEPVYRLLPPKVSRNNGVNLEGTAETKTKLILIRADGSRLSTLVDGSGNWKFDFYPLYGGERARMYVEGVGGKISAIVTVIGVLPLRYDGMAIYDGTHKYNGVRLN

SEQ ID NO: 188 - protein, 387 aa, Unknown
  Description of Unknown: Bacteriophage F394/08
MSTPTTKEISNRILSKLETTFGQSLPKSFTRVLSTVLGGVFVILYKYGGFIALQMFVSTASAKDTDFNGKTINPLREWGRLIGAGDPNPAVNAIILTRIVVEKPGEILPAGTQLVNSGNGVTYITQEDIELVEGAQDIEVLAASDTSGNSGAGKAGNLNAGDVLTFANPLGSVGRYSTVVTTIREGLDAEAIETYRARVVSRFQLRAQGGAMVDYKIWGESVSGVSRIYPYTSDLPGQVDIYVDVLEGVASQAILNQVKNAVEFDANNGLAQNRPLNALVNYLPMEFVEFNVTISGLSVEGALSVRAEIRAALEHYFNIRAPYIVGLSTDSRADRITLAAASGVVDDVVNKAGGIFNDMQLFKGQTPISFYMLGIGEKATLVNVEYL

SEQ ID NO: 189 - protein, 239 aa, Unknown
  Description of Unknown: Bacteriophage F394/08
MNMFKHLLPSGRAWNLTAEKPLKAFFRCLDVLRTDAVNYFNLLFLDINPKTTRLLDQWEQQFGINRGFLTEAQRRERVAAAWRDVGGQSPAYIQEVLRNNGFDVYIHEWFDPADRGEVGEKQPITPRNPLSIMSAQYAEVLPVVDCGEPLALCGEEFAHAGNYLGLVGYPLVNKFVYDADKYGYTVPVDPAYWYHFFYVCGPNFGDVAQVEATRRAEFEALILRIKPAHLWAGVIVRYV

SEQ ID NO: 190 - protein, 200 aa, Unknown
  Description of Unknown: Bacteriophage F394/08
MSLVFNEKFPGKTAGATQNYPYGEARNVSGPGNGDGTPWDAALVNDIFGLLQGLLVRANIQPNGQSDTALNSQYLQALLALFMPKQTPISGKLEQNGYLTIPFPVVINGQTVEREFTIQWGSKDWSSYPGEIQDSIVFEKPFKTACFGVFPIRKMSQHSAYGDGGVKPISVSKTGFTVSLQAYGGSVGHLLGYYWFAVGV

SEQ ID NO: 191 - protein, 128 aa, Unknown
  Description of Unknown: Bacteriophage F394/08
MEPISTGGTAAFLKVYGVWLAVVTALVFVATVVLMMRLPRSPQEFLVGIITTVVSSLMGGSFLILYFDLQIWANSAYGLMVIGGLYFVAGIPGWALVRWVFNFIDAREGSTLLDIFREFNEEFRGGKK

SEQ ID NO: 192 - protein, 182 aa, Unknown
  Description of Unknown: Bacteriophage F394/08
MSKIIAICAGHSDKDPGAVNGKRTEAAIVLDMRKMVASYLEKAGVKYLTDGKGGVNQPLAEAIKVAKQASIAVEFHCNAATSKKATGVEVLSAEKNKALAKQIAAKINGVLNIPLRGESGWKSEGSGQHSRLGFISSGGGLIVELFFISNDDDLAKWDAKKWLVAKEVAAVLIEQVKKAEAA

SEQ ID NO: 193 - protein, 85 aa, Unknown
  Description of Unknown: Bacteriophage F394/08
MAALTIFNAISEVTSFAGVAREIFDTAANAMDAAQNEKKGGGNKKVWVMAYMESFINDLGENWERWAKAIFSFIDFAKSIFNSKR

SEQ ID NO: 194 - protein, 79 aa, Unknown
  Description of Unknown: Bacteriophage F394/08
MRNTADKSTIDFIEETTGDAYKPVKGCGTVRGYKAGCACNNCHKAQIGRMADKIVKAALRTRIKSSEPTHQPKEQAWNF

SEQ ID NO: 195 - protein, 138 aa, Unknown
  Description of Unknown: Bacteriophage F394/08
MTKTELKTAIIEFSALTTLQVAGQFSIEELTGLKTHLNGQREALLMDKAPAHIKGEKEAKINAQLSDVNNLIKKANKAIGLIQVNQAELKQSKVKQDTHFLSTFHDVAQSYLTNELYADLKQKALNVMRIAKANGKND

SEQ ID NO: 196 - protein, 75 aa, Unknown
  Description of Unknown: Bacteriophage F394/08
MSETTNLFNPDALDANFFYENSGQALAAALDPIEKCVLEKALKYSKYNIAEVSRILGINRLTVIKKMKKHGLTEI

SEQ ID NO: 197 - protein, 76 aa, Unknown
  Description of Unknown: Bacteriophage F394/08
MKQPVIQRQQLSNFSQETANHGAKIKEILSTLFFCFMLAALSYMFIIKQADEIDKQAEFVAEYNAQFKEYPNERNH

SEQ ID NO: 198 - protein, 323 aa, Unknown
  Description of Unknown: Bacteriophage F394/08
VKKFNTKFKQNLDDANNNAFIPNSFQITNAFVDNIMDKISDAAVKIYLITVRKTTGWGKQIDSISLSQYEAYSGKSRPTVVKCLKELVKVGLLVEHTGTRYGNSYSVALVNSIGFELLSASKKILLVKSFNYTSKKSLLPLVKIFNTQKQLSKNTNQKQINKRDWFSLKTLKDELFKTGLQIEAEDLTAAKWFDREKTAFENYAPNQNLSDPQKMYYFVDWLLKAKRKYDAAERQQAAKAKAEGKNQNQNPEDTKTENDPFKLSTKQISFFASQLAHLPSFAKYCTGNKGFKEFEMWIASMLNNPENVKKWNKYLNELGYLIG

SEQ ID NO: 199 - protein, 76 aa, Unknown
  Description of Unknown: Bacteriophage F394/08
MKISNFHFQMQILLLISKNTVLDFEGLKEKLAPSITDNALTECLEELLMWGWVQVQKGLYMVSGVAYQIMGDICQC

SEQ ID NO: 200 - protein, 74 aa, Unknown
  Description of Unknown: Bacteriophage F394/08
MEKYKYSESNAVLSPHLNCGLTSVSRVGSSGQAKHKPHKRSEIADQAEKEICKNWALRQQAFLNNSVSNAVLGG

SEQ ID NO: 201 - protein, 173 aa, Unknown
  Description of Unknown: Bacteriophage F394/08
MNKFIHIEGKPTAQQVREALAMYAKDIKRPEFSLIVQRELIESFRNDTAHALKSAVAFYFKNRVIQRPGLVLASGKDQALIVESCENKALKRHLVAVSGYSSQFLQMVIDHKTPLSAVAARDLKQALPKAEKLYKAECKEKDAKLKKNICGFVACYRNGCHCTKCTTAYKKYR

SEQ ID NO: 202 - protein, 63 aa, Unknown
  Description of Unknown: Bacteriophage F394/08
MGVSIINLVLLVGVCLLLTNIALNCLFHTENKTYLVYACGFSAASVAGAIAGVIGCLAYGVTV

SEQ ID NO: 203 - protein, 91 aa, Unknown
  Description of Unknown: Bacteriophage F394/08
MKNKSILMGLFVAAAGVVFYMGADSACNQKAVIDPGALMSLGGITVENKKASLVRVCDTPVKENLVSFVLIKDGLRVGGVVDKSHVALIGE

SEQ ID NO: 204 - protein, 55 aa, Unknown
  Description of Unknown: Bacteriophage F394/08
MSLGKRPAGATHIESDGTYWKNEDADWYFWRDLWGWCQYVGPKNRNFLNKFSVLG

SEQ ID NO: 205 - protein, 61 aa, Unknown
  Description of Unknown: Bacteriophage F394/08
MDLYIGQIVGHSSPTWVVQGKLKITKINEGKRSGLKIITATDESGKEFTAVYGVFFSVDRY

SEQ ID NO: 206 - protein, 135 aa, Unknown
  Description of Unknown: Bacteriophage F394/08
VRNENFEDYLKQTDDYAVLLNNYGSSLFIHENGVYRALPVRVAYAAWVSGGDRWGEVQHLKGKIKKMAERAAETADFYHTKIEKLESSTVKKAGLLDMAEQWDGLELRGRDLELNRVQESIYKRCAYLLRVAVNG

SEQ ID NO: 207 - protein, 166 aa, Unknown
  Description of Unknown: Bacteriophage F394/08
MGNRWTLSGKVKGLKDLPESITAAQFREMIERGQVKNTPQAPKKRRSGKVSSPGEATLAQALKALKIEFVQEYRFCEYRKWRADFHIPGTNLLIEVEGGVRSGGRHVRPQGYINDTEKYNEAAKLGFVVLRFDTETVSRGTAINEIESYLERRGYFQNKGLTCEES

SEQ ID NO: 208 - protein, 90 aa, Unknown
  Description of Unknown: Bacteriophage F394/08
VKKVKKFKYDWRAVPDHINWLATYEGGEMAWGYVNKPYRKENAGIWYETGGEWRHRVPVAPYRGHWTQSLEKRPSKAQLVEWVLNGAVVV

SEQ ID NO: 209 - protein, 685 aa, Unknown
  Description of Unknown: Bacteriophage F394/08
MAENSFIQPIARKDAIALIGRDELVEGGPEGAANKQAIALANNIKYLMGLIPENWGVEKTEYGLDEVVRLSNGDVVKSVIDENINNPNENLSGWSFVTSNSVNTISDLLSIKNPKNGMKVYVLGYHKPDNFALLSPYEGGGLFIYSGNKAAENDGGVVLNGWIRQYVGDVDISWFGAKQGQDASPFIEAALKVKMSIVIRGEYKLETICGIPRQNNYAAKVIRIKGENQASLTVNCPDGAVFTSLDAKANPTSLSNIFTAKIDVFGINFVGTTVANSVLFNGDRLYNINIHHNNFKTNITIVKAYLKREASRQYTQSVSINHNHLAEIHRVIESDKSYNFDFAYNMCEACKGGMYIGVDAPYDPSGISITIHRNLWEASGVLLKTNGGIIAGSVSKNYFEANVYQDAAIDKCLIYINRSGTGAGYSGGLTFENNLFSGTSSIPDYVDVRVLGQSTETSGNSKSATTRPPVFIGNWSNSYMLTNMAQAILIGNKCSNREKMLNAYSPQEARVTYYSGYFTKQLANILTDKKLNLLKVNTSAVHAIGSSQANFKTTLDVIVFFKTSGAVGTAMATFKLDLFVYESVGLGAGNVPKANLKAVMYNFMQSTADDKITPTVNMFSAISDPLINVVDNSDGTYSIELSSFTNKSSPNWGFVSELHIEYTAQATLIASHTSSYSAANLLTIS

SEQ ID NO: 210 - protein, 226 aa, Unknown
  Description of Unknown: Bacteriophage F394/08
MFDIDTKQLHGLERRLERLNRRGLPYATRQTMNDLAFESRAVARAELPTRMVLRNKHAINSIQVTKATSLNISQQAAHVGSTADYMATQETGGIKTKQGGAAVSIPTTTAAGQGRNAKPRTRLPRAALKMGAIHLKRIAASRNAKNRKQRNAIAMATSDKYVFLDLGRRKGIFRKDKGGGVTMLHDLTRASVQIPKNEWLKPATEAAERKLPGFYGRALEFQLRRF

SEQ ID NO: 211 - protein, 283 aa, Unknown
  Description of Unknown: Bacteriophage F394/08
MVKKLISRSDFAAKAGVSGAAISKACKGPLLDAVEGKFIDLNHKSAIAYLESKKNGKTTPALEGIDSLYEEALEVCREAGRCSQTLLRDKLMIGSDRARKLVALIQNANIQDFEKPAAEKVKREEKARPHTRGTAAKKQQAIQEDDEELFELLDRNVAQYADMTLRDIVRKFGTATRFAEYLRAMKEISMIEDREIKIAQTKGELVHRDLVSQLIIEPIDSAHVKLMRDGSKTIAVRMAAMHGSGADINEMQLVTSELIASFIKPVKAKVNKIATELKRGAEA

SEQ ID NO: 212 - protein, 659 aa, Unknown
  Description of Unknown: Bacteriophage F394/08
MNFIGMDWLCDKVENLTEYIKHVTPSQFNEENRYLPESVTSIPGFIRYDVNPFMREIVDCFDINSPVREVNLKKGVQITYSTVLESGALYYMGHVKTLPIMYMTADKELAKARIENNFIPMLAQSDMAHIVRSSDEGNSRKTGKTDNHIQFEGGGYLVPFGAINANKMRSFSIAVMLKDEIDAWPDRVGKDGDPDKLSDDRCSAYWERRKIFRGSTPLIKGSSKIEKAYLRGDQRKYHVLCKKCSFPQELRWSTPDGVGGFKWDTDEDGILKLDSVRYCCQQCGEPHFEHDKERLFSEKFGAKWIPTARPVEPGIRSYHLPALYSPFGMQPWYKCVIAYLDAFDPVERKVKDIELYQVFYNNVLAEPFEIQGAKVRFETVSHHRRTVYRLGHIPNRYAVQYAGSPILFLTCQVDVHKSFLAVSVMGWAKDAKCFVIDYLRIEGEDFSDSAEPGWGKLRELIEEKQYIADDGKKYRVALTFIDSGYANDTVVKFCSEYSSSVYPILGRDRPSKNQAIKEFADFKTQEGTTGFRIIVDHYKDRLAPVLRREWDEMGGGLQPVYHFNAPVDLSDKSLKELTVETRKEKTDASGNTSYFWHRPGNARNELWDLLCYGHAAVEIFAWSLCVKNMEQKEVDWAWFWEFLETEAPYFEQGEPVASE

SEQ ID NO: 213 - protein, 69 aa, Unknown
  Description of Unknown: Bacteriophage F394/08
MQYENNLEKLKGNKPEGATIVAVKGDRIAYFKEAEQKGRLLTFNRIMWVKTWFTPDHLNLKHFDFIAVL

SEQ ID NO: 214 - protein, 74 aa, Unknown
  Description of Unknown: Bacteriophage F394/08
MNNQSFNNWRGHKIEIVQAGATIQQHGYPVQITDQNTIAFDGKIYMTQNTYNSIAKNMPQCQTPNFNNQGLNIF

SEQ ID NO: 215 - protein, 82 aa, Unknown
  Description of Unknown: Bacteriophage F394/08
MIDKKYLVFGGWVRSKHDKQSHYVAPRMVAYLYNVNPHECIFITDKTELNPRTHLPYGLNENHNLIKLGPQTNGKYNLPATN

SEQ ID NO: 216 - protein, 63 aa, Unknown
  Description of Unknown: Bacteriophage F394/08
MGQSEARQKQKSDYEKKRVIKNFSLLKERDKHLIEYIETVPNVGDLVRDLLNQHLKNEAVSKK

SEQ ID NO: 217 - protein, 71 aa, Unknown
  Description of Unknown: Bacteriophage F394/08
MLMIGNTQVKTPRELTKPLKKILGPEYKVKRDVWLMVEGKNLNEAKRIIESIGLFANDMGGFLTVFMAEEM

SEQ ID NO: 218 - protein, 84 aa, Unknown
  Description of Unknown: Bacteriophage F394/08
LDQAFLKERIEATKRQIVAYEDAVNQLSSGAVQSYSLNTGQTTQNVTRFDVARLNGDIDGLYNRLATLEARLNGSGSTLVRPGW

SEQ ID NO: 219 - protein, 557 aa, Unknown
  Description of Unknown: Bacteriophage F394/08
MNYDFSRGLVKVPTVGLKTEFKYSGATIAPPPMQGAKSDAIEINALGGGFNHSAFTGEKFIGGFGPTSLFTMDYWTLRKRSEQLFSENLYAAGLIERLVTNEINTGLTPEACPDERILGLKPGDLEDWTELVENRFSIWANSSEYCDFYGQNSLGEIQRIARREALICGDVLVVLRQNQSTKMPQVQLVSGSLIRTPPDIPRKGHKIKHGVELDTQGRQCAYWVLQDDGTYKRLPAFGEKSKRRIAWMVYGAQRRLGELRGQPLLSIVLQSLKEIDRYRDAAQRKAVVNSILAMFIEKTQDKMSTLPITGGAIRRDKVTDNSNTAAPRSFEIASQVPGVVLQELQAGEKPVGFHSQGTDINFPAFEEAVISAVAWCKQIPPEILKLSFSSNYSASQAAINEFKIYLNMVWNEWGANFCQPIYTEFLISEALLGKIDAPGFLDAWRDPVKMDIFGAWLWCDWFGSIKPSTDMRKMGQGLALAVEQGWTTNAQASRQMFGTKFTKNIARQRRERELQASLLRPMLELQKEYGISAEHLVNVAHAIGGTISAQTEETEEI

SEQ ID NO: 220 - protein, 383 aa, Unknown
  Description of Unknown: Bacteriophage F394/08
MDWFLTPEALKEIQELHARGLVLTAEQMTEFNALYSDDFPGSRIFQKVGTVAQVNIAGVLTKEPNWMYRYYGGGNTAYSEIISAINEAERDPAIKEIILAIDSPGGQTNGLCSAMDAIKNTKKTVLAVVEGQAASAAYGLASQANKIIAADRGCMVGSVGAAASIVVSENVVDIASTNAPKKRPDVTTDAGKAVIRETLDQIESIFIADIAAGRKVTADKVKLEFGQGGMYVAAHALERGMIDEIKTADSSATTNAKSSATYTASEENSTMDAATLKAQFPAVYTAIYNEGKTAENERVSAHLTLGEASGDMQTAISAINDGSELTASIQAKYMAANMKRGQVAGRETDDTAAANALDGVKPGATATDANAVTNMVAKNLGVA

SEQ ID NO: 221 - protein, 129 aa, Unknown
  Description of Unknown: Bacteriophage F394/08
MMQVTQHTNSSINWGEVACQDDTLTLGANATLKEGTILARAATGKLIPFVKGGADGAGVPVAIAMHEIKTVAAGDVSVRAGISGQVRKNNLVIHADGNATNIDGAVTDALRSYGIVAFTVNSTNKPDNQ

SEQ ID NO: 222 - protein, 361 aa, Unknown
  Description of Unknown: Bacteriophage F394/08
MTTSTIAGVYTQVAPKPLFLSGFFKAPPQNHFNTESVELDIERDSQQVAAVVQSLGSDYNKNETGEFTNKKFTPPVYKEGFSLNAFDLLKREAGQSGFNTPSEQIRGNLITRFIKGARKVEAKILRGIELQASQILQTGNLLLKDQEGKDAFKIDYKPKATHFVNVANVWTGANADPMKDLESLSEVIQTDGLVIPDIIIMGASALAAAKGNEKFIKNFDSRNISGNVLADMQITARGGIYQGTLRVGNAVCELYTYGVGYQASSSAVATPFLNTNKVLMLSSESQLDALFGAVPNIADILGVSLREQLLPELPTRFDSNSTDLFTNVYLSASGEQLMGGVASRPILVPTAIDSFGCLTVA

SEQ ID NO: 223 - protein, 55 aa, Unknown
  Description of Unknown: Bacteriophage F394/08
MNPLQWGFFLLNLEIFDVTKTDLINAIKAIDSNAKTSGLDKDELQALLTELQAKA

SEQ ID NO: 224 - protein, 410 aa, Unknown
  Description of Unknown: Bacteriophage F488/08
MAKINELLRESTTTNSNSIGRPNLVALTRATTKLIYSDIVATQRTNQPVAAFYGIKYLNPDNEFTFKTGATYAGEAGYVDREQITELTEESKLTLNKGDLFKYNNIVYKVLEDTPFADIEESDLELALQIAIVLLKVRLFSDAASTSKFESSDSEIADARFQINKWQTAVKSRKLKTGITVELAQDLEANGFDAPNFLEDLLATEMADEINKDILQSLITVSKRYKVTGITDTGFIDLSYASAPEAGRSLYRMVCEMVSHIQKESTYTATFCVASARAAAILAASGWLKHKPEDDKYLSQNAYGFLANGLPLYCDTNSPLDYVIVGVVENIGEKEIVGSIFYAPYTEGLDLDDPEHVGAFKVVVDPESLQPSIGLLVRYALSANPYTVAKDEKEARIIDGGDMDKMAGRS

SEQ ID NO: 225 - protein, 521 aa, Unknown
  Description of Unknown: Bacteriophage F488/08
MTIKTKAELLNKWKPLLEGEGLPEIANSKQAIIAKIFENQEKDFQTAPEYKDEKIAQAFGSFLTEAEIGGDHGYNATNIAAGQTSGAVTQIGPAVMGMVRRAIPNLIAFDICGVQPMNSPTGQVFALRAVYGKDPIASGAKEAFHPMYGPDAMFSGQGAAKKFAALKASDTLEVGTIYTHFFQETGTVYLQATAAKQIDSGASDADKLDAEIKKQMEAGVLVEIAEGMATSIAELQEGFNGSTDNPWNEMGFRIDKQVIEAKSRQLKAAYSIELAQDLRAVHGMDADAELSGILATEIMLEINREVVDWINYSAQVGKSGMTLTPGSKAGVFDFQDPIDIRGARWAGESFKALLFQIDKEAVEIARQTGRGEGNFIIASRNVVNVLASVDTGISYAAQGLATGFNTDTTKSVFAGVLGGKYRVYIDQYAKQDYFTVGYKGPNEMDAGIYYAPYVALTPLRGSDPKNFQPVMGFKTRYGIGINPFAESAAQAPASRIQSGMPSILNSLGKNAYFRRVYVKGI

SEQ ID NO: 226 - protein, 269 aa, Unknown
  Description of Unknown: Bacteriophage F488/08
MLKEQLIAEAQKIDASVALDSIFESVNISPEAKETFGTVFEATVKQHAVKLAESHIAKIAEKAEEEVEKNKEEAEEKAEKKIAEQASKFLDHLAKEWLTENKLAVDKGIKAELFESMLGGLKELFVEHNVVVPEESVDVVAEMEEELQEHKEESARLFEELNKRDAYINYVQREVALSESTKDLTESQKEKVSALVEGMDYSDAFSSKLSAIVEMVKKSNKDESTITESINTPDTEAAGLNFVTEAVEDKSAQGAEDIVSVYAKVASRF

SEQ ID NO: 227 - protein, 212 aa, Unknown
  Description of Unknown: Bacteriophage F488/08
MNEPQLLIETWGQPGEIIDGVPMLESHDGKDLGLKPGLYIEGIFMQAEVVNRNKRLYPKRILEKAVKDYINEQVLTKQALGELNHPPRANVDPMQAAIIIEDMWWKGNDVYGRARVIEGDHGPGDKLAANIRAGWIPGVSSRGLGSLTDTNKGYRIVNEGFKLTVGVDAVWGPSAPDAWVTPKEITESQTAEADTSADDAYMALAEAMKKAL

SEQ ID NO: 228 - protein, 141 aa, Unknown
  Description of Unknown: Bacteriophage F488/08
MLLIPETHELVLENVEALIPEAQGRFDELSSALNKDDINTIVENMLDDETDLAVALASINENMPLNEFIVKHVSARGEITRTKDRKTRERNAFQTTGLSKAKRRQIARKATKTKIANPAGQSRAQRKRKKALKRRKALGLS

SEQ ID NO: 229 - protein, 79 aa, Unknown
  Description of Unknown: Bacteriophage F488/08
MEGLIEAIKSNDLVAARKLFAEAMAARTTDLIKEEKIAIARNFLIEGEEPDDEDDDEDEDSDDKDDKKDKDSDEDEDDE

SEQ ID NO: 230 - protein, 524 aa, Unknown
  Description of Unknown: Bacteriophage F488/08
MKFNVLSLFAPWAKMDERNFKDQEKEDLVSITAPKLDDGAREFEVSSNEAASPYNAAFQTIFGSYEPGMKTTRELIDTYRNLMNNYEVDNAVSEIVSDAIVYEDDTEVVALNLDKSKFSPKIKNMMLDEFSDVLNHLSFQRKGSDHFRRWYVDSRIFFHKIIDPKRPKEGIKELRRLDPRQVQYVREIITETEAGTKIVKGYKEYFIYDTAHESYACDGRMYEAGTKIKIPKAAVVYAHSGLVDCCGKNIIGYLHRAVKPANQLKLLEDAVVIYRITRAPDRRVWYVDTGNMPARKAAEHMQHVMNTMKNRVVYDASTGKIKNQQHNMSMTEDYWLQRRDGKAVTEVDTLPGADNTGNMEDIRWFRQALYMALRVPLSRIPQDQQGGVMFDSGTSITRDELTFAKFIRELQHKFEEVFLDPLKTNLLLKGIITEDEWNDEINNIKIEFHRDSYFAELKEAEILERRINMLTMAEPFIGKYISHRTAMKDILQMTDEEIEQEAKQIEEESKEARFQDPDQEQEDF

SEQ ID NO: 231 - protein, 163 aa, Unknown
  Description of Unknown: Bacteriophage F488/08
MFVDDVTRAFESGDFARPNLFQVEISYLGQNFTFQCKATALPAGIVEKIPVGFMNRKINVAGDRTFDDWTVTVMNDEAHDARQKFVDWQSIAAGQGNEITGGKPAEYKKSAIVRQYARDAKTVTKEIEIKGLWPTNVGELQLDWDSNNEIQTFEVTLALDYWE

SEQ ID NO: 232 - protein, 659 aa, Unknown
  Description of Unknown: Bacteriophage F488/08
MTLLSPGIELKETTVQSTVVNNSTGTAALAGKFQWGPAFQIKQVTNEVDLVNTFGQPTAETADYFMSAMNFLQYGNDLRVVRAVDRDTAKNSSPIAGNIEYTISTPGSNYAVGDKITVKYVSEDVETEGKITEVDADGKIKKINIPTAKIIAKAKEVGEYPTLGSNWTAEISSSSSGLAAVITLGKIITDSGILLAEIESAETAMTAVDFQANLEKYGIPGVVALYPGELGDKIEIEIVSKADYAKGASALLPIYPGGGTRASTAKAVFGYGPQTDSQYAIIVRRNDAIVQSVVLSTKRGEKDIYDSNIYIDDFFAKGGSEYIFATAQNWPEGFSGILTLSGGLSSNAEVTAGDLMEAWDFFADRESVDVQLFIAGSCAGESLETASTVQKHVVSIGDARQDCLVLCSPPRETVVGIPVTRAVDNLVNWRTAAGSYTDNNFNISSTYAAIDGNYKYQYDKYNDVNRWVPLAADIAGLCARTDNVSQTWMSPAGYNRGQILNVIKLAIETRQAQRDRLYQEAINPVTGTGGDGYVLYGDKTATSVPSPFDRINVRRLFNMLKTNIGRSSKYRLFELNNAFTRSSFRTETAQYLQGIKALGGIYEYRVVCDTTNNTPSVIDRNEFVATFYIQPARSINYITLNFVATATGADFDELTGLAG

SEQ ID NO: 233 - protein, 610 aa, Unknown
  Description of Unknown: Bacteriophage F488/08
MEQPINALNDFHPLNEAGKILIKHPSLAERKDEDGIHWIKSQWDGKWYPEKFSDYLRLHKIVKIPNNSDKPELFQTYKDKNNKRSRYMGLPNLKRANIKTQWTREMVEEWKKCRDDIVYFAETYCAITHIDYGVIKVQLRDYQRDMLKIMSSKRMTVCNLSRQLGKTTVVAIFLAHFVCFNKDKAVGILAHKGSMSAEVLDRTKQAIELLPDFLQPGIVEWNKGSIELDNGSSIGAYASSPDAVRGNSFAMIYIDECAFIPNFHDSWLAIQPVISSGRRSKIIITTTPNGLNHFYDIWTAAVEGKSGFEPYTAIWNSVKERLYNDEDIFDDGWQWSIQTINGSTLAQFRQEHTAAFEGTSGTLISGMKLAVMDFIEVTPDDHGFHRFKGPEPDRKYIATLDCSEGRGQDYHALHIIDVTDDVWEQVGVLHSNTISHLILPDIVMRYLVEYNECPVYIELNSTGVSVAKSLYMDLEYEGVICDSYTDLGMKQTKRTKAVGCSTLKDLIEKDKLIIHHRATIQEFRTFSEKGVSWAAEEGYHDDLVMSLVIFGWLSTQSKFIDYADKDDMRLASEVFSKELQDMGDEYAPVIFVDSVHSAEYVPVSHGMSMV

SEQ ID NO: 234 - protein, 164 aa, Unknown
  Description of Unknown: Bacteriophage F488/08
MEGLDINKLLDISDLPGIDGEEIKVYEPLQLVEVKSNPQNRTPDLEDDYGVVRRNMHFQQQMLMDAAKIFLETAKNADSPRHMEVFATLMGQMTTTNREILKLHKDMKDITSEQVGTKGAVPTGQMNIQNATVFMGSPTELMDEIGDAYEAQEAREKVINGTTD

SEQ ID NO: 235 - protein, 272 aa, Unknown
  Description of Unknown: Bacteriophage F488/08
MFGYFYNSSFRRYATLMGDLFSNIQIKRQLESGDKFIRVPITYASKEHFMMKLNKWTSINSQEDVAKVETILPRINLHLVDFSYNAPFKTNILNQNLLQKGTTSVVSQYNPSPIKMIYELSIFTRYEDDMFQIVEQILPYFQPHFNTTMYEQFGNDIPFKRDIKIVLMSAAIDEAIDGDNLSRRRIEWSLTFEVNGWMYPPVDDAEGLIRTTYTDFHANTRDLPDGEGVFESVDSEVVPRDINPEDWDGTVKQTFTSNVNRPTPPEPPGPRT

SEQ ID NO: 236 - protein, 256 aa, Unknown
  Description of Unknown: Bacteriophage F488/08
MATYDKNLFAKLENRTGYSQTNETEILNPYVNFNHYKNSQILADVLVAESIQMRGVECYYVPREYVSPDLIFGEDLKNKFTKAWKFAAYLNSFEGYEGAKSFFSNFGMQVQDEVTLSINPNLFKHQVNGKEPKEGDLIYFPMDNSLFEINWVEPYDPFYQLGQNAIRKITAGKFIYSGEEINPVLQKNEGINIPEFSELELNPVRNLNGIHDINIDQYAEVDQINSEAKEYVEPYVVVNNRGKSFESSPFDNDFMD

SEQ ID NO: 237 - protein, 309 aa, Unknown
  Description of Unknown: Bacteriophage F488/08
MSGYNSQNPKELKDVILRRLGAPIINVELTPDQIYDCIQRALELYGEYHFDGLNKGFHVFYVGDDEEKYKTGVFDLRGSNVFAVTRILRTNIGSITSMDGNATYPWFTDFLLGMAGINGGMGTSCNRFYGPNAFGADLGYFTQLTSYMGMMQDMLSPIPDFWFNSANEQLKVMGNFQKYDLIIVESWTKSYIDTNKMVGNTVGYGTVGPQDSWSLSERYNNPDHNLVGRVVGQDPNVKQGAYNNRWVKDYATALAKELNGQILARHQGMMLPGGVTIDGQRLIEEARLEKEALREELYLLDPPFGILVG

SEQ ID NO: 238 - protein, 485 aa, Unknown
  Description of Unknown: Bacteriophage F488/08
MIELKDLPFVDSVPDEGQERISWIKNGEEILGASTKYGNDGSMNRPIVSVFKNVEVLDENIGILKTAIETSQKDIKTIQGVLDVSGDIEALSQISVNKNDISNLKTLTNEHTDILTGTNNTVDKIIADIGPFNDEENSVYRTIRNDLLWIKQELGQYSGQDINGLPVVGNASTGMKHRIITNSTLLSSQGIRLSELENKFTESDVGSLTVEVGKLRDELGNKPVDFGPNIYNRLNTIDDKQTLINSDIAEIKSSIGYPENVSIITEINNNKSSIESINNELNQSEGVKQRLTAIETSIGSDDIPSSIKGKIKNHTTSIESLNGIVGENTSSGLRANVSWLNQIVGTDSSGGQPSPSGSLLNKVSVLEGEVSVLNNNVQNIQVEIGNNRTGIKGQVIELTSLINGNNPDGSTVEERGLTNSIKTNETNIAAVTHEVNTAKDNISSLQSSVQALQEAGYIPEAPKDGQAYVRKDGEWVLLSTFLSPA

SEQ ID NO: 239 - protein, 516 aa, Unknown
  Description of Unknown: Bacteriophage F488/08
MSNNTYQHVSNESKYVKFDPVGSNFPGTVTTVQSALSKISNIGVNGIPDATMEVKGIAMIASEQEVLDGTNNSKIVTPATLATRLLYPNATETKYGLTRYSTNEETLEGSDNNSSITPQKLKYHTDDVFRNRYSSESSNGVIKISSTPAALAGVDDTTAMTPLKTQKLAIKLISQIAPSEDTASESVRGVVQLSTVAQTRQGTLREGYAISPYTFMNSVATQEYKGVIRLGTQSEINSNLGDVAVTGETLNGRGATGSMRGVVKLTTQAGIAPEGDSSGALAWNADVINTRGGQTINGSLNLDHLTANGIWSRGGMWKNGDQPVATERYASERVPVGTIMMFAGDSAPPGWIMCHGGTVSGDQFPDYRNVVGTRFGGDWNNPGVPDMRGLFVRGAGTGGHILNQRGQDGYGKDRLGVGCDGMHVGGVQAQQMSYHKHAGGWGEYNRSEGPFGASVYQGYLGTRKYADWDNASYFTNDGFELGGPRDALGTLNREGLIGYETRPWNISLNYIIKVHY

SEQ ID NO: 240 - protein, 219 aa, Unknown
  Description of Unknown: Bacteriophage F488/08
MSLLNNKAGVISRLADFLGFRTKKNDISVMNNQPVGAVTISQIAKGFYDSNVESAINDVRNMAEQQVGAVLINISGVSPTGVQQTDYWSFEGTVTDTSAKPGDPVIVNMFGIPVKATNGMTSIEFTSAVRTALQEMVVKFIAIDSFEDHPTIGNKIQVKYLDNQEHILEQYSDKGITFKQEIISPSKPGYGTWQLLGAQTVTLDSHTQPTVFYYFERIA

SEQ ID NO: 241 - protein, 601 aa, Unknown
  Description of Unknown: Bacteriophage F488/08
MKQNINIGNVVDDGTGDYLRKGGIKINENFDELYYELGDGDVPYSAGAWKTYNASSGQTLTAEWGKSYAINTSSGRVTLQLPKGTVNDYNKVIKARDVFATWNVNPVTLVAASGDTIKGSSSSVEINVQFSDLELVYCAPGRWEYVKNKQIDKIISSDISNVARKEFLVEVQGQTDFLDVFHGTSYNVNNIRVKHRGNELYYGDVFSENSDFGSPGENEGELIPLDGFNIRLRQPCNIGDTVQIETFMDGVSQWRSSYTRRQIKVLDSKLTSKTSLEGSIYVTDLSAMKSIPFSAFGLIPGEPINPNSLEVRFNGILQQQAGTAGYPLFLCEGANSDTQEGCISLGGEWKESNTDYSIEYEDGKPVSLLFDRKFESGDIIVITWFNNDLGTLLEKDDIIELTDDRYVSKGSSTEVTGDVALTDFDKIGWPNVEKVDSYTRTYNSISSIFDSIYPVGSIYENAINPNNPVTYMGFGSWKLFGKGQVLVGWNDDVTDPNFALNNNDLDSSGNPSHTAGGTVGTTSVTLENANLPATKTDERVLIEDENGSVIIGGCQYDPDETGPIYTKYREDYATTNSSHTPPTNISNIQPSITVYRWIRIA

SEQ ID NO: 242 - protein, 288 aa, Unknown
  Description of Unknown: Bacteriophage F488/08
MFIQEPKKLIDTGEIGNASTGDILFDGGNKINSDFNAIYNAFGDQRKMAVANGTGADGQIIHATGYYQKHSITEYATPVKVGTRHDIDTSTVGVKVIIERGELGDCVEFINSNGSISVTNPLTIQAIDSIKGVSGNLVVTSPYSKVTLRCISSDNSTSVWNYSIESMFGQKESPAEGTWNISTSGSVDIPLFHRTEYNMAKLLVTCQSVDGRKIKTAEINILVDAVNSEVISSEYAVMRVGNETEEDEIANIAFSIKTNYVTATISSSTVGMRAAVKVIATQKIGVAQ

SEQ ID NO: 243 - protein, 334 aa, Unknown
  Description of Unknown: Bacteriophage F488/08
MNDSSVIYRAIVTSKFRTEKMLNFYNSIGSGPDKNTIFITFGRSEPWSSNENEVGFAPPYPTDSVLGVTDMWTHMMGTVKVLPSMLDAVIPRRDWGDTRYPDPYTFRINDIVVCNSAPYNATESGAGWLVYRCLDVPDTGMCSIASLTDKDECLKLGGKWTPSVRSMTPPEGRGDAEGTIEPGDGYVWEYLFEIPPDVSINRCTNEYIVVPWPEELKEDPTRWGYEDNLTWQQDDFGLIYRVKANTIRFKAYLDSVYFPDAALPGNKGFRQISIITNPLEAKAHPNDPNVKAEKDYYDPEDLMRHSGEMIYMENRPPIIMAMDQTEEINILFTF

SEQ ID NO: 244 - protein, 1032 aa, Unknown
  Description of Unknown: Bacteriophage F488/08
MTVKAPSVTSLRISKLSANQVQVRWDDVGANFYYFVEIAETKTDSGENLPSDQYRWINLGYTANNSFFFDDADPLTSYIIRVATAAQDFEQSDWVYTEEFETFATNAYTFQNMIEMQLANKFIQEKFTLNNSNYVNFNNDTIMAALMNESFQFSPSYVDVSSISNFIIGENEYHEIQGSIQQVCKDINRVYLMESEGILYLFERYQPVVKVSNDKGQTWKAVKLFNDRVGYPLSKTVYYQSANTTYVLGYDKIFYGRKSTDVRWSADDVRFSSQDITFAKLGDQLHLGFDVEIFGTYATLPANVYRIAEAITCTDDYIYVVARDKVRYIKTSNAPIDSDPLSPTYSERLFEPDTMTITGNPKAVCYKMDSIGDKVFALIIGEVETLNANPRTSKIIDSADKGIYVLNHDEKTWKRVFGNTEEERRRIQPGYANMSTDGKLVSLSSSNFKFLSDNVVNDPETMVKYQLIGAVKYEFPREWLADKHYHMMAFIADEKSDWETFTPQPMKYYAEPFFNWSKKSNTRCWINNSNRAVVVYADLKYTKVIENIPETSPDRLVHEYWDDGDCTIVMPNVKFTGFKKYASGMLFYKSSGEIISYYDFNYRVRDTVEIIWKPTGVFLKAFLQNQEHETPWSPEEEHGLADPDLRPLIGTMMPDSYLLQDSNFEAFCEAYIQYLSDGYGTQYNNLRNLIRNQYPREEHAWEYLWSEIYKRNIYLNADKRDAVARFFESRSYDFYSTKGIEASYKFLFKVLYNEEVEIEIESGAGTEYDIIVQSDSLTEDLVGQTIYTATGRCNVTYIERSYSNGKLQWTVTIHNLLGRLIAGQEVKAERLPSFEGEIIRGVKGKDLLQNNIDYINRSRSYYVMKIKSNLPSSRWKSDVIRFVHPVGFGFIAITLLTMFINVGLTLKHTETIINKYKNYKWDSGLPTEYADRVAKLTPTGEIEHDSVTGEAIYEPGPMAGVEYPLPDDYNAENNNSIFQGQLPSERRKLMSPLFDASGTTFAQFRDLVNKRLKDNIGNPRDPENPTQVKIDE

SEQ ID NO: 245 - protein, 660 aa, Unknown
  Description of Unknown: Bacteriophage F488/08
MANTPVNYQLTRTANAIPEIFVGGTFAEIKQNLIEWLNGQNEFLDYDFEGSRLNVLCDLLAYNTLYIQQFGNAAVYESFMRTANLRSSVVQAAQDNGYLPTSKSAAQTEIMLTCTDALNRNYITIPRGTRFLAYAKDTSVNPYNFVSTEDVIAIRDKNNQYFPRLKLAQGRIVRTEIIYDKLTPIIIYDKNIDRNQVKLYVDGAEWINWTRKSMVHAGSTSTIYYMRETIDGNTEFYFGEGEISVNASEGALTANYIGGLKPTQNSTIVIEYISTNGADANGAVGFSYADTLTNITIININENPNGDPDFVGADGGGDPEDIERIRELGTIKRETQQRCVTATDYDTFVSERFGSIIQAVQTFTDSTKPGYAFIAAKPKSGLYLTTVQREDIKNYLKDYNLAPITPSIISPNYLFIKTNLKVTYALNKLQESEQWLEGQIIDKIDRYYTEDVEIFNSSFAKSKMLTYVDDADHSVIGSSATIQMVREVQNFYKTPEAGIKYNNQIKDRSMESNTFSFNSGRKVVNPDTGLEEDVLYDVRIVSTDRDSKGIGKVIIGPFASGDVTENENIQPYTGNDFNKLANSDGRDKYYVIGEINYPADMIYWNIAKINLTSEKFEVQTIELYSDPTDDVIFTRDGSLIVFENDLRPQYLTIDLEPISQ

SEQ ID NO: 246 - protein, 97 aa, Unknown
  Description of Unknown: Bacteriophage F488/08
MSGLSYDKCVTAGHEAWPPTVVNATQSKVFTGGIAVLVAGDPITEHTEIKKPYETHGGVTQPRTSKVYVTGKKAVQMADPISCGDTVAQASSKVFIK

SEQ ID NO: 247 - protein, 164 aa, Unknown
  Description of Unknown: Bacteriophage F488/08
MEGSSIDVTFTAQLETGETLVSINITSYEETPGVLVEENRLYGTYESVFGFGNDALKYRLGDEFKTAASWEELPTDSDTQLYLWKAPQNLQKTFTYEVTLIYDYQEQSESGGSGSNSRSSSDTTEPTDPPAPVRKTLVKNYTKTIVGNWSRWANKLRSYVYERS

SEQ ID NO: 248 - protein, 575 aa, Unknown
  Description of Unknown: Bacteriophage F488/08
MEMISNNLNWFVGVVEDRMDPLKLGRVRVRVVGLHPPQRAQGDVMGIPTEKLPWMSVIQPITSAAMSGIGGSVTGPVEGTRVYGHFLDKWKTNGIVLGTYGGIVREKPNRLEGFSDPTGQYPRRLGNDTNVLNQGGEVGYDSSSNIIQDSNLDTAINPDDRPLSEIPTDDNPNMSMADMLRRDEGLRLKVYWDTEGYPTIGIGHLIMKQPVRDMAQINKVLSKQVGREITGNPGSITMEEATTLFERDLADMQRDIKSHSKVGPVWQAVNRSRQMALENMAFQMGVGGVAKFNTMLTAMLAGDWEKAYKAGRDSLWYQQTKGRASRVTMIILTGNLESYGVEVKTPARSLSAMAATVAKSSDPADPPIPNDSRILFKEPVSSYKGEYPYVHTMETESGHIQEFDDTPGQERYRLVHPTGTYEEVSPSGRRTRKTVDNLYDITNADGNFLVAGDKKTNVGGSEIYYNMDNRLHQIDGSNTIFVRGDETKTVEGNGTILVKGNVTIVVEGNADITVKGDATTLVEGNQTNTVNGNLSWKVAGTVDWDVGGDWTEKMASMSSISSGQYTIDGSRIDIG

SEQ ID NO: 249 - protein, 196 aa, Unknown
  Description of Unknown: Bacteriophage F488/08
MLFTFFDPIEYAAKTVNKNAPTIPMTDIFRNYKDYFKRALAGYRLRTYYIKGSPRPEELANTIYGNPQLYWVLLMCNDNYDPYYGWITSQEAAYQASIQKYKNVGGDQIVYHVNENGEKFYNLISYDDNPYVWYDKGDKARKYPQYEGALAAVNTYEDAVLENEKLRQIKIIAKSDINSFMNDLIRIMEKSYGNDK

SEQ ID NO: 250 - protein, 150 aa, Unknown
  Description of Unknown: Bacteriophage F488/08
MAYSGKWVPKNISKYRGDPKKITYRSNWEKFFFEWLDKNPEIIAWGSETAVIPYFCNAEGKKRRYFMDIWMKDSSGQEFFIEIKPKKETQPPVKPAHLTTAAKKRFMNEIYTYSVNTDKWKAAQALAEKRGIKFRILTEDGLRALGFKGA

SEQ ID NO: 251 - protein, 274 aa, Unknown
  Description of Unknown: Bacteriophage F488/08
MAIFQIINESTPQVPKVKQSLNEKKWIQIGLEYKKAKAKGMTGKQFAEERGIKYSTFTSAMSKYASGIKTAEKIQKLESKPMNKLNKQERQLLMINSFRQTLRDKIRNEGAAINNKTRKWFAETIKQVKGHKVVRPQPGRIYAFAYDAKHKETLPYWDKFPLIIYLGLGKHNLMYGLNLHYIPPKARQQFLEELLKQYANTPTITNKTKLKIDWSQVKGFRGADQMIKAYIPGNIMGSLVEIAPKDWANVVLMPLQQFVSKGKRFSANKVWSNI

SEQ ID NO: 252 - protein, 176 aa, Unknown
  Description of Unknown: Bacteriophage F488/08
MSQALQQIFNQANTTNFVVSIPHSNTTSAFTLNAQSVPIPGIRIPVTDTVTGPFGLGRAQRPGATFEYDPLIVRFIVDEELKSWIGMYEWMLGTSNYLTGENTAQKTGPEYITLYILDNSKTEIVMSINFYKPWVSDLSEVEFSYTEDSDPALVCTATIPYTYFQVEKDGKIIAEV

SEQ ID NO: 253 - protein, 241 aa, Unknown
  Description of Unknown: Bacteriophage F488/08
MKLIFLSGVKRSGKDTTADFIMSNYSAVKYQLAGPIKDALAYAWGVFAANTDYPCLTRKEFEGIDYDRETNLNLTKLEVITIMEQAFCYLNGKSPIKGVFVFDDEGQESVNSVAFNKIIDVINNIEDQWSVRRLMQALGTDLIVNNFDRMYWVKLFALDYLDKFNSGYDYYIVPDTRQDHEMDAARAMGATVIHVVRPGQKSNDTHITEAGLPIRDGDLVITNDGSLEELFSKIKNTLKVL

SEQ ID NO: 254 - protein, 76 aa, Unknown
  Description of Unknown: Bacteriophage F488/08
MSEQTIEQKLSAEIVTLKSRILDTQDQAARLMEESKILQGTLAEIAHAVGITGDTIKVEEIVEAVKNLTAESADEE

SEQ ID NO: 255 - protein, 151 aa, Unknown
  Description of Unknown: Bacteriophage F488/08
MEFKDFSTGLYVAAKFSELTLDALEELQRSLRVPNPVPREKIHSTICYSRVNVPYVPSSGSFEVASSGHLEVWKTQDGSTLVLVLDSEYLRCRHMYARALGATHDFDDYTPHITLSYNVGPLSFSGDVQIPVVLDREYKEPLKLDWADDLK

SEQ ID NO: 256 - protein, 85 aa, Unknown
  Description of Unknown: Bacteriophage F488/08
MKTFKEFATKTTITESSHGMEVKLGMALAEAERLFSRIKELAAAVDPSSFKGDQTKVKALLALCSDAGEIAKNGSKMKKRLEDLK

SEQ ID NO: 257 - protein, 81 aa, Unknown
  Description of Unknown: Bacteriophage F488/08
MEIKMKTYQEFIAETADVKVEFIYTGKKDKMGEMPHGVLRDALDNFGQLAAEDYGDKIVVTGPAAVIEKWAAENKSIFRKK

SEQ ID NO: 258 - protein, 61 aa, Unknown
  Description of Unknown: Bacteriophage F488/08
MKRCELIRNVAIAISASAFSFSMFVGFICGLLTTAENVFSLVVAFLIGLIAIVMDKISKGE

SEQ ID NO: 259 - protein, 132 aa, Unknown
  Description of Unknown: Bacteriophage F488/08
MNVEYYVYADYENNPSKDEDNRLGVDAFDSPAAAWQWVERTDIPYRYIEVVDHAGNKYPKEAYVASGKVNFLLFAGDNYYPRGGYTDLIAKAFSEDELRDIIKENENKPMDSNRFDWWQIVNANTHTIVDEG

SEQ ID NO: 260 - protein, 95 aa, Unknown
  Description of Unknown: Bacteriophage F488/08
MILYAKVSSIENGYKYDQDAAKALIDDYGILTCFEVEKVYIDRSSSQVKLVKEERKFNTVNFDFFIETEKGPLEYDIFKNPLGLECIVNMYYYKW

SEQ ID NO: 261 - RNA, 73 nt, Unknown
  Description of Unknown: Bacteriophage F488/08
ugggaauuagccaaguugguaaggcacuggauuuugauuccaggaugcaaagguucgaguccuuuauucccag

SEQ ID NO: 262 - RNA, 84 nt, Unknown
  Description of Unknown: Bacteriophage F488/08
gcgagaauggccaaauugguaaaggcacagcacuuaaaaugcugcggaaugauuuccuuguggguucgagucccacuucucgca

SEQ ID NO: 263 - RNA, 71 nt, Unknown
  Description of Unknown: Bacteriophage F488/08
gcggauaucguauaaugguauuaccucagacuuccaaucugaugaugugaguucgauucucauuauccgcu

SEQ ID NO: 264 - RNA, 74 nt, Unknown
  Description of Unknown: Bacteriophage F488/08
cuccguguagcucaguuugguagagcgucugcuuugggagcagaaugucguagguucaaauccugccacggaga

SEQ ID NO: 265 - RNA, 87 nt, Unknown
  Description of Unknown: Bacteriophage F488/08
ggaggcguggcagagugguuuaaugcaccggucuugaaaaccggcagucgcuccggcgacucauagguucaaauccuaucgccuccg

SEQ ID NO: 266 - RNA, 73 nt, Unknown
  Description of Unknown: Bacteriophage F488/08
gcugauuuagcucaguagguagagcaacucacuuguaaugagaaggucggcgguucgauuccgucaaucagca

SEQ ID NO: 267 - RNA, 72 nt, Unknown
  Description of Unknown: Bacteriophage F488/08
ggcccuguagcuggaagguucaagcaagcgacucauaaucgccagauggugguucaauuccacccagggcca

SEQ ID NO: 268 - RNA, 84 nt, Unknown
  Description of Unknown: Bacteriophage F488/08
ggggaguuaucccguagagguagcgguguggacuguaaauccauugucauugcgacucgggugguucgacuccaccacucccca

SEQ ID NO: 269 - RNA, 72 nt, Unknown
  Description of Unknown: Bacteriophage F488/08
ggauguguagcucaauggcagagcgaucgccuguuaagcgauugguuauagguucgaauccuaucacguccg

SEQ ID NO: 270 - RNA, 73 nt, Unknown
  Description of Unknown: Bacteriophage F488/08
guggccguaguucaguugguagaacucgagauugugauucucguagucauggguucgacucccaucggucacc

SEQ ID NO: 271 - RNA, 73 nt, Unknown
  Description of Unknown: Bacteriophage F488/08
cggggcauagcucagaaggaagagcaaggaccuucuaaguccuaggucguagguucgaucccuacugccucga

SEQ ID NO: 272 - protein, 116 aa, Unknown
  Description of Unknown: Bacteriophage F488/08
MKGNVYLVVHDLTFYFNHNDTVISERVINLLYQHADYVYVENEYGHWQFLKNRSFGLDGYEYFDRKDLLDTIPLSTQYQNHKSLHKCRLIRNAESAYEAIDLWRKRREYIDSLKEY

SEQ ID NO: 273 - protein, 157 aa, Unknown
  Description of Unknown: Bacteriophage F488/08
MKSYTQFLNEAVLNEASSTEIQAVAKAAIAAGKYSYKDASDESRFQFARDMKAEGFTGNAVSMAWKSLVATGAAFAKASGKPAPKADPKAAQEKNIVKGIIAKYEAILKELLVIKTEGQKLARAYSFKDNPHVHSLEYVEDIQKIIKDRIWSAKQIK

SEQ ID NO: 274 - protein, 187 aa, Unknown
  Description of Unknown: Bacteriophage F488/08
MKTYAEFLTEAAKLPSEADLTKVFFQLDPKDRGDFLKWKAKAIEMYNIDNSSFTMSQENKFNKAFFKISKKLASGAQVPKSVLATPERAPVKISKNMFDTKKYVNALNKALDALDDAKKAARDLQDVYTDFDRKTKGSISNSERNSVSVYSDSLDVLGDAYTEIKNRINTASKLKAAAEAIISKLGK

SEQ ID NO: 275 - protein, 87 aa, Unknown
  Description of Unknown: Bacteriophage F488/08
MDNYGELFNFFMKCVSEDFGRTVNDIKVIGPDHPMFETYAVMGNEDGQWYTVKVVINMFTAEGYVKLSSKVYHDNDEIAEEYFNNMK

SEQ ID NO: 276 - protein, 197 aa, Unknown
  Description of Unknown: Bacteriophage F488/08
MNTLKKIVEFIRTKLGSAMAKNLSVEEQYTAAAAKLLDKIKDLKTASVKSINEEKRIRELVIEKNRQAESKEREIRKLLSEGQDVTMHAKLGLLYRRTAEQLTTKADGYAEMRIEIAKKVVELDDARQELAVKLEYIRETRAANALGISTADDVVEIAALTKVDIEDTLARVETFNGNISGVETTSADVQEYINSLK

SEQ ID NO: 277 - protein, 202 aa, Unknown
  Description of Unknown: Bacteriophage F488/08
MKMQSDFNSMFEEFQRQVDVPDQLLNALKRMAEGRNYYWGSSYETDESLSGRFSRGKKSLIRPGILINSIESIHSLTCDFDVEFTDFISPEWTVCYLNDDFDYLGVYSLSDAWFKRNLQKSNLFYIDTTVKFQGKKYFFTLIVDSETKHENKRILSKKNILTIVDDLFDKFVENPNFESDLLLEKFVKECREYVKTITIPSK

SEQ ID NO: 278 - protein, 130 aa, Unknown
  Description of Unknown: Bacteriophage F488/08
MSKPSLYLPSKPVKYEPKRQIISTDVLIGPVILISFVILLIIGGVLDVMTDIDSGEILVLMLILPLIVPLLLVPVNWVGYWYQGRHYRKRVRDWKAQCKKIKKEHQLKLDMYEFDEIMKFVKESRCKSQN

SEQ ID NO: 279 - protein, 120 aa, Unknown
  Description of Unknown: Bacteriophage F488/08
MQKPKLNKVKYSFPEALLILAVSVFTALAGSLIGLLIDCFILNIDGTVIITEVWSELRFTIAISLFSFFGTMLYFHYDNFKINWQRKKDYKIQLKEYNSYMSYIEKESMEEFVSDCRKIK

SEQ ID NO: 280 - protein, 162 aa, Unknown
  Description of Unknown: Bacteriophage F488/08
MILKTRWYDLDDGDDGISVDRVDWSGCSEDTKKRLIREFRMGYQAVKPSTVTDDKFVCIHNGRAKLTNAEWFTDKIMILWYIISLPVSSFVFYFFIKNPMDRIGDWILLTILVNIFTASILSGIWYTFIEMPWRLRRQQKIFDEKKYTQNLNNFITECRKLK

SEQ ID NO: 281 - protein, 146 aa, Unknown
  Description of Unknown: Bacteriophage F488/08
MKTLSAGIIFMTEDKDLFMGRVTGSRKPGMMAHRWDIPKGRVESSDLNALEAAKRECLEETGFSNYNPDLLEDLGVFKYSSNKDLQLFYYTIPVEHEMFRNCHCESYFENKDGVMIPEMDAFALIPRTQWQYVMGPSLYRIMNSLF

SEQ ID NO: 282 - protein, 164 aa, Unknown
  Description of Unknown: Bacteriophage F488/08
MNIFEMLRIDEGLRLKIYKDTEGYYTIGIGHLLTKSPSLSVAKSELDKAIGRNCNGVITKDEAEKLFNQDVDAAVRGILRNAKLKPVYDSLDAVRRCALINMVFQMGETGVAGFTNSLRMLQQKRWDEAAVNLAKSRWYNQTPNRAKRVIATFRTGTWDAYKNL

SEQ ID NO: 283 - protein, 138 aa, Unknown
  Description of Unknown: Bacteriophage F488/08
MTRINLTLVSELADQHLIAEYRELPRVFGIVRKHVANGKRVKDFKISSKFILGSGHVTFFYDKLEFLRKRQSDIITECLKRGFSIKDTEVPDISDIPVEWKNDYNPCKSAIKLSQQRLDEKILMKPHWYKYYGKNIYI

SEQ ID NO: 284 - protein, 179 aa, Unknown
  Description of Unknown: Bacteriophage F488/08
MRTFLTGPYLSLMNAFTHHSDARVEEICKNEYIPPFEDLLKQYCTLRLDGGRQSGKSTAVTNFAANWLYDGGTVIVLSNTSAYAKISADNIKKEFSRYSNDDIRFRLFTDSVRSFIGNKGSKFRGLSLSRILYIIDEPVKSPDMDKIYSVHIDTVHCCCNIKCCIGGITRPQFFVIGMQ

SEQ ID NO: 285 - protein, 109 aa, Unknown
  Description of Unknown: Bacteriophage F488/08
MMTDTQLFEYLYFSPKTIKNKLVNHFEILAKNNILSEFYPKQYKLQKGVFKGCRVLCTAPNARLMNKIPYFTMEFIDGPFKGLITQSLMAYDSEPFLIKEQSWINLFFN

SEQ ID NO: 286 - protein, 120 aa, Unknown
  Description of Unknown: Bacteriophage F488/08
MKAYQILEGTHKGTIYFEDGIQARIIVSKTFKEDSFVDPEIFYGLHAREIEIEQQPTVKIEGGQHLNVNVLRRETLEDAVKHPEKYPQLTIRVSGYAVRFNSLTPEQQRDVIARTFTESL

SEQ ID NO: 287 - protein, 73 aa, Unknown
  Description of Unknown: Bacteriophage F488/08
MAKIIIEGSEDVLNAFAEWFSNSGEQQFNEAWNMGDINGIYPTTEISVQGYGIHEPIRLVEYDLGTGEEVKYD

SEQ ID NO: 288 - protein, 88 aa, Unknown
  Description of Unknown: Bacteriophage F488/08
MIEDIKGYKPHTDDKISKVNAIKDAEVRLGLIFDALYDEFWEAFDSCEDDELAKNYAESLDQLTIAKMKLKEASMWACRAVFQPEEKY

SEQ ID NO: 289 - protein, 92 aa, Unknown
  Description of Unknown: Bacteriophage F488/08
MAQLSAGFGYEYYTAPRRVSVAPKKIQSLDDFQEVVRNAFQDYARYLKEDSQDCLEEDEIAYYEQRLEQLKNLHEVRAEVSKSMNKLIRFKE

SEQ ID NO: 290 - protein, 153 aa, Unknown
  Description of Unknown: Bacteriophage F488/08
MTINTEVFIRRNKLRRHFESEFRQINNEIREASKAAGVSSFHLKYSQHLLDRAIQREIDETYVFELFHKIKDHVLEVNEFLSMPPRPDIDEDFIDGVEYRPGRLEITDGNLWLGFTVCKPNAKFKDPSLQCRMAIINSRRLPGKASKAVIKTQ

SEQ ID NO: 291 - protein, 181 aa, Unknown
  Description of Unknown: Bacteriophage F488/08
MRKALLAGLLAISMMAHSSEHTFSNVQLDNMRYAYQFGEQFSKDGKYKTHKNIHKSGLGHIMAAILWQESSAGVNLKSKPKHHAYGMFQNYLPTMRARVKELGYNMTDAEIKRMLNKRSNSASWAYIELSYWLNIHKGDIRKAISSYNSGWNVKAGSKYASEVLEKANYLKNNKLLEIVND

SEQ ID NO: 292 - protein, 113 aa, Unknown
  Description of Unknown: Bacteriophage F488/08
MTKILVLCIGLISFSVLADTSYTEIREYVNRTAADYCGKNKACQAEFAQKLIYAYKDGERDKSSRYKNDTLLKRYAKKWNTLECSVAEEKDKAACHSMVDRLVDSYNRGLSTR

SEQ ID NO: 293 - protein, 159 aa, Unknown
  Description of Unknown: Bacteriophage F488/08
MIVKYIKGDIVALFLQGNIIAHGCNCFHTMGSGVAGQLARAYPKILEIDKTTTEYGSRDKLGDMSIVFKHSPTGFGICYNLYTQYEPGPNLDYGALVNCMIELNLQAETLLFKPVIYIPRIGCGIAGGDWDKVSKLIDMFTPDIDLIVVDYESTLPASV

SEQ ID NO: 294 - protein, 70 aa, Unknown
  Description of Unknown: Bacteriophage F488/08
MKVHYPHPFDPKNKVEIIRQWERICRTKCPINSPHDVDKDYIGTFVEYTFIDRKGRKQHVEEYCLKVTWL

SEQ ID NO: 295 - protein, 68 aa, Unknown
  Description of Unknown: Bacteriophage F488/08
MSQTSILKNAHCEKCEWPVVFALCNDEMACDFDYWCYCSNKGCINHKGEGFYSGFYPYPDFVKEGKPK

SEQ ID NO: 296 - protein, 57 aa, Unknown
  Description of Unknown: Bacteriophage F488/08
MNSFELQYEVLRELDNLIELAVNKGFAIGIGQKDTGHLTMEIFKQKRIILKLLEINI

SEQ ID NO: 297 - protein, 61 aa, Unknown
  Description of Unknown: Bacteriophage F488/08
MSLSKEQKDKLFELIHELLDEHTEANTFYDEYGPLSPEQQEEFADRFDKKENELIAYVNML

SEQ ID NO: 298 - protein, 193 aa, Unknown
  Description of Unknown: Bacteriophage F488/08
MASLIFTYAAMNAGKSASLLTAAHNYKERGMGVLVLKPAIDTRDSVCEVVSRIGIKQEANIITDDMDIFEFYKWAEAQKDIHCVFVDEAQFLKTEQVHQLSRIVDTYNVPVMAYGLRTDFAGKLFEGSKELLAIADKLIELKAVCHCGKKAIMTARLMEDGTPVKEGNQICIGDEIYVSLCRKHWNELTKKLG

SEQ ID NO: 299 - protein, 70 aa, Unknown
  Description of Unknown: Bacteriophage F488/08
MLQLTEKQLRNLTVLQLDEIRREVGNIISALRREVSLNQSPADYTRLRNFEKYLDKVKAVHRHKVNTGQK

SEQ ID NO: 300 - protein, 97 aa, Unknown
  Description of Unknown: Bacteriophage F488/08
MALKATALFAMLGLAFALSPPIEANVDPHFDKFMESGIRHVYMLFENKSVESSEQFYSFMRTTYKNDPCSSDFECIERGAEMAQSYARIMNIKLETE

SEQ ID NO: 301 - protein, 128 aa, Unknown
  Description of Unknown: Bacteriophage F488/08
MKFSDFSQSGKPSKADEYLGLLMAAQAYFHSAHFETKSYARHKAYDFIFSELPDLIDKFGEQYLGYSGRKYTPSIPDASKLPTDTIKMIDRILDQSNSIYKEMPPAIQSTIDDITGMFYQSKYLLSLE

SEQ ID NO: 302 - protein, 62 aa, Unknown
  Description of Unknown: Bacteriophage F488/08
MKIEALNQEGNIYVIINGDFFVDMDEVTSEELVELLKKRYDMCDEAATHMACAIFSLSYVVE

SEQ ID NO: 303 - protein, 67 aa, Unknown
  Description of Unknown: Bacteriophage F488/08
MTRIEQADKIKELVALIRKADEELSDFAWFSAGIANKGIEKFEAKVDNALEALDMFLDEIIDHNTRV

SEQ ID NO: 304 - protein, 64 aa, Unknown
  Description of Unknown: Bacteriophage F488/08
MLTREQFEKIIKLARDIEIDSYQLAVEHCEGYSYDGIEAAKKDLDKSKAKLVQYLEMIRWNNEN

SEQ ID NO: 305 - protein, 57 aa, Unknown
  Description of Unknown: Bacteriophage F488/08
MKTEKQMFLMKLIEEYANAVSDYECSSRERGTAFAKEELKIMVDAHTKLQNFIENVI

SEQ ID NO: 306 - protein, 61 aa, Unknown
  Description of Unknown: Bacteriophage F488/08
MTSEQAFKLKELIETYSKAVHTATVIDESAFSGHANKIKYKTLMEEAKVNLDSYIETLIGE

SEQ ID NO: 307 - protein, 88 aa, Unknown
  Description of Unknown: Bacteriophage F488/08
MGFPKLEVGDLVLTKLWNGVQSVEICQYRGATGNLMYTIYNPEILLECHLERFIKDTDSMPYSVSIVRKSDTKEYSKILEQIRANKKD

SEQ ID NO: 308 - protein, 177 aa, Unknown
  Description of Unknown: Bacteriophage F488/08
MKRLVLEVSPLFGELAIEKVNNMYRLTQEDDMLYFTPSEIIHLTQIEYPYTDKIVSINDEHKIHFYSSCPGFNIKSESMCLSVIHWDSFIDKIKYFYYSNERKHSLKWLKNCNAIITNACNQNDETLLNVSKCYEEGDVLTIRQIDDFRSHIVTFTKDEAIALKTYLDSVIPTMISK

SEQ ID NO: 309 - protein, 173 aa, Unknown
  Description of Unknown: Bacteriophage F488/08
MFISSGSGLIRVEFKNDIFLSQGDDIIKMSYDEIKKICHALESHGKENATIDIGDLWVTLYEVSEGFNIEDENNILAIDKRSDLFDVLKVYEQSNGGRKAVLVYQKPHSCGTASIISNIEDETDTYMCVLKAGGDRHPDFISIRQNNGEISLSKSEAEAMIKYLTTVTPSMKG

SEQ ID NO: 310 - protein, 153 aa, Unknown
  Description of Unknown: Bacteriophage F488/08
MIINENSWHYKLFKMFNDEWKRPKTLCAYFWSIVIPTFFVSFFGCTILAGLTIICAEIIQKWLIFGSLWTLIPSAFILAILLVLLIIGSFVIPAQLHEKYKDYKWKKDYALHVENIDRAYKGLPPIQPKKSIIVEFLKARKAKVCPVIEYKAE

SEQ ID NO: 311 - protein, 336 aa, Unknown
  Description of Unknown: Bacteriophage F488/08
MKTVMKSYFGSHLYGTSTPESDVDFKEIFVPPARDILIGNVKEHMSKNTNNTSSKNTKDDIDHELYSLKYFFKLAADGETVALDMLHTPPELVVKSDLPDVWKFIQDNRSRFYTTNMKSYLGYVRKQASKYGVKGSRLAALRDVLKVVNQIPEQWVDYQEDGSIKQRRTKVEDIKHRLPENEFCEWVFHNHEKTGPQTFYTVLGRKYQTTLSLIELKQSLNKLDAEYGERARKAEANEGIDWKALSHACRGGLQLLEIYKTGDLVYPLQDAPFILDVKLGKHPFKTVQEFLEDVVDQVEAASTEASKNGMQQKVDMSFWDDFLEKVYLENHRSYYK

SEQ ID NO: 312 - protein, 49 aa, Unknown
  Description of Unknown: Bacteriophage F488/08
MKITPIEVKKLIDTEEISECFESFLEDATEDNAVYLAQKIIETYLEKNQ

SEQ ID NO: 313 - protein, 87 aa, Unknown
  Description of Unknown: Bacteriophage F488/08
MTVYVDVLMNHGWKLRGHPTKNCHMFTDGDIEELHEMAEAIGMKRSWFQDKRIKHYDLHARRRQKAVELGAVEVSRREAVKIWRTLK

SEQ ID NO: 314 - protein, 322 aa, Unknown
  Description of Unknown: Bacteriophage F488/08
MKTVTINKGIYFGKEISGTFELLGEWFPDNAPVDAQGDGKVFVEIDGKRRGVWVYKSDISYDGVKVEEVKESYEDMKTRINKRFNVMGMMTNGIINGNIRSLIISGAAGIGKTYSLDKALNKANDNGYIEYKSINGKISGIGLYEQLWNNREENSVLLIDDVDVFSDMDILNLLKAALDTGETRKVCWSTASSYLEEKGIEREFEFKGTIVFITNVDIDRELDRGTKLAPHLQALVSRSVYLDLGVHTNEEIMVRVEDVILSTDMMQKRGLSDEETYKALSWMKVNVNRLRNVSLRTALYLADFIMTDKNGWEEIAEVTLLK

SEQ ID NO: 315 - protein, 100 aa, Unknown
  Description of Unknown: Bacteriophage F488/08
MLYSKAREIYETKIKEAVFKFATTMRWTNDWEYSKNHKKPMVTRKAHMLVLIDREQIKAREALQNHKKAAFEWFMDNTAPETKKAVSAWFSGKNCERSFF

SEQ ID NO: 316 - protein, 175 aa, Unknown
  Description of Unknown: Bacteriophage F488/08
MNAKDIFNLVNYNDGKFKSEAQSKFFNDISIGGEITVDGGQIYKSRWNWIVIIDEIGIVEIYKNTNKNRTLHWSRDTNEQYKKDKASKLSRVTQEDIEFIKKDILMYDNLIAEEQAVIDKFDEIKASREIPDFMKESVNERYTLISERIETYKKQRAERQNTLRKFEERLKTVLA

SEQ ID NO: 317 - protein, 135 aa, Unknown
  Description of Unknown: Bacteriophage F488/08
MKQLIIKRLNLLICCLCIAIAYGYYAINDYMHYKDYDVTVVNTITGTQGKGSSLSFIAVYELKDGYRFSEYISPEMYSSIEKGDNITVSLRPFDVKQTLFDNIVWFFGMVLVQSVCGAYIVCSILFCIFSKIEIE

SEQ ID NO: 318 - protein, 295 aa, Unknown
  Description of Unknown: Bacteriophage F488/08
MSVVINNVNAVIKSLVNKKLNEWTVLRRGEPDKFFHRFNPTLDLNVIDRDVHAEILDKFKVDIGFGLDKHLQRTNGSGMGLSNRIMKALNKIGALSRINASEILRNYNKGYDLYGRLMPKLSFDQMIADLWENQRRLLALGARLAKGLDKQMIFKTNNTEDLKCFKFSTRGDDYYIRARSTDYVNMGHHLCLAFEVLKEAGTLEYVSGAKCPIGSNCILIYRPDESSSTKLPTKPVPVRSNEKHSEQIAYFNKQIEELNISIQQYDDEIFRLSGLSSKAKSEREKLIKIVDLLKS

SEQ ID NO: 319 - protein, 342 aa, Unknown
  Description of Unknown: Bacteriophage F488/08
MKTRSQIEDMVRNASYTRDVMTFLCENNLDPDKVNRVIHHFKYTNSSEWVRNFSKAGYITQMTAREQLTDFCKTIDYKNPLIVQGVGQSKVDLSSGFFNPNHYRIEWRFIALFRKQLKQILSTASRLKGSDINLKNLKFDGYTLQMEVRPLKENNRTARISFKPNTKNSLSICECLKSQLTEAFKYMDVVAAVQSKILPRFERNWEHTTTYELDMIVSFKYEFLRKDEIVQEKKQEVQDTLNLNLSNYLSNDPKFWMYSSSNIDACKLNKVSFLPTENSNFKPVEKWHADAIEKSLKAVDDELVKATNEVLEAEKALEQAQSRVQNLTKQRSKLNNALNALN

SEQ ID NO: 320 - protein, 333 aa, Unknown
  Description of Unknown: Bacteriophage F488/08
MTRNEYIKSFNSVIDDKAIPMFGQNSVLSIINQWLNSVDASIVSSTKFIHEIRKISSRVDKDVIKKTFKESRLLSYLVNRDILGNFGKEIKRTKDVVGYNWFGDVNSYHLNIKEDPENIFTRRWISNFRLFKKQILKSASKLCYGDYRQIHPLASDMIIIKEYELDKNKVSIFVNYGFFTPETNQKNINKFFSIASTITRQLETALLCMETVENIHTYPFKNICGWEGYKLVISLREVKCAYSPTDKEIYQQKCDEIVNTPKEETTLEELMECLDDSPEPIEIRPEVIALEKAYKEVLEISNKAQKEYEQAKRIWEESVNRLDRLEQALQLIK

SEQ ID NO: 321 - protein, 308 aa, Unknown
  Description of Unknown: Bacteriophage F488/08
MKTRKHYIDYFDSLITKHRNYQIGHRAVINNILRDFLDYIGWENHICKDTQNAYSHSLGSLLEWFKRSRLLSSVIAVNNVKKFMYPSYIETNVSNASVVTFNIINDVKRTYLEEWFSKDSKEKFASEFSHEFNNNVNMLFKHSRRLFCHGDNRTINVNVKDWVTAKFTPSSQNGQFELSIIICAPHEIYKNLPYMKPREANKHNETISSLAYNLRVLLSDMDVVKSFDDNTNYGLSLFETKFVIKLKDPSEFKPTPKSNHGNDTMKEEREYLSARLIEVEKQIEEHTKVLKALTAKANGLRNAIEVLK

SEQ ID NO: 322 - protein, 129 aa, Unknown
  Description of Unknown: Bacteriophage F488/08
MKKRLLEDIAASSNSSLIKIIMAGEEDDMEMRGKIHGCDDLDFKPPAWDAIMAMVERRERASKNVPNCPECGTEQVQLINWRKPELEYKCRQCKHKFSKHAPEMVKLPDSTEFFKELVSVQPMPNNILD

SEQ ID NO: 323 - protein, 80 aa, Unknown
  Description of Unknown: Bacteriophage F488/08
MTKRKEYMEAAEKAVRELAIAYYNEHGKFPDRYSVLKSALTRSYKNMLSEVSDIIYKHKEQTGQSLDYDETFKQVLGIKE

SEQ ID NO: 324 - protein, 87 aa, Unknown
  Description of Unknown: Bacteriophage F488/08
MFKVYGYDSNIHKCVYCDNAKRLLTVKKQPFEFINIMPEKGVFDDEKIAELLTKLGRDTQIGLTMPQVFAPDGSHIGGFDQLREYFK

SEQ ID NO: 325 - protein, 71 aa, Unknown
  Description of Unknown: Bacteriophage F488/08
MMLEGTDYIHDYRGSAVYVGDEVAVYYGYGTLMTAKVIQIKNNRAKLEVYYSNGEKSISKWKYGDCMVKLG

SEQ ID NO: 326 - protein, 56 aa, Unknown
  Description of Unknown: Bacteriophage F488/08
MIYDINVSRTPSMVTIPAEELDRLQKIEELLWEIESDLPSGLESWIDYEELNKLRG

SEQ ID NO: 327 - protein, 57 aa, Unknown
  Description of Unknown: Bacteriophage F488/08
LIMKNLISFGVKPWWAARWETVEPEPEEPVYIDEETVYNEPTINDLIDMEMGHDYSR

SEQ ID NO: 328 - protein, 161 aa, Unknown
  Description of Unknown: Bacteriophage F488/08
MITVDKWFRINRVDTGLCNYWPELSAGTVFKVRELAKECEDDIEPDTGIIEIELSDGKIINIYDKPITYWCLWNTESVENGEIEEVVERTSQDVQKPKAAFQGERISYALAKLAAQENNDGYEGNLMQAAAEYIEWLETQISFSDQKIRQYKRLHQMFYNT

SEQ ID NO: 329 - protein, 58 aa, Unknown
  Description of Unknown: Bacteriophage F488/08
MKTELVYTEKLNGGKVWKLFIKGHSTDPHMTTCVGTYSRPTKKMIRQYKRLHRMFYNT

SEQ ID NO: 330 - protein, 157 aa, Unknown
  Description of Unknown: Bacteriophage F488/08
MLLTGKLYKEEKQKFYDAQNGKCLICQRELNPDVQANHLDHDHELNGPKAGKVRGLLCNLCNAAEGQMKHKFNRSGLKGQGVDYLEWLENLLTYLKSDYTQNNIHPNFVGDKSKEFSRLGKEEMMAEMLQRGFEYNESDTKTQLIASFKKQLRKSLK

SEQ ID NO: 331 - protein, 605 aa, Unknown
  Description of Unknown: Bacteriophage F488/08
MTIEKEIEGLIHKTNKDLLNENANKDSRVFPTQRDLMAGIVSKHIAKNMVPSFIMKAHESGIIHFHDIDYSPALPFTNCCLVDLKGMLENGFKLGNAQIETPKSIGVATAIMAQITAQVASHQYGGTTFANVDKVLSPYVKRTYAKHIEDAEKWQIADALNYAQSKTEKDVYDAFQAYEYEVNTLFSSNGQTPFVTITFGTGTDWTERMIQKAILKNRIKGLGRDGITPIFPKLVMFVEEGVNLYKDDPNYDIKQLALECASKRMYPDIISAKNNKAITGSSIPVSPMGCRSFLSAWKDSTGNEILDGRNNLGVVTLNLPRIALDSYIGTQFNEQKFTELFNERMDLCFEALMCRISSLKGVKATVAPILYQEGAFGVRLKPDDDIIELFKNGRSSVSLGYIGIHELNILVGRDIGQEILTKMNARLKQWAERTGFAFSLYSTPAENLCYRFCKLDTEKYGSVKDVTDKGWYTNSFHVSVEENITPFEKISREAPYHFIATGGHISYVELPDMKNNLKGLEAVWDYAAQHLDYFGVNMPVDKCFTCGSTHEMTPTENGFVCSICGETDPKKMNTIRRTCGYLGNPNERGFNLGKNKEIMHRVKHQ

SEQ ID NO: 332 - protein, 156 aa, Unknown
  Description of Unknown: Bacteriophage F488/08
MNYDRFYPCDFVNGPGCRTVLFVTGCLHKCEGCYNKSTWNARNGIPFTGETLEQLIECLNNDYIEGLTITGGDPLYPDNRDVIHCIVQTVKNLYPNKSIWLWTGYKFEDIKQLEMLKYVDVIIDGKYEKNLPTKKLWRGSDNQRLWSNTDGVWKHD

SEQ ID NO: 333 - protein, 37 aa, Unknown
  Description of Unknown: Bacteriophage F488/08
MIKLNYIMDTINDMIFHFGPEFYSQYSLVLINAWLIN

SEQ ID NO: 334 - protein, 71 aa, Unknown
  Description of Unknown: Bacteriophage F488/08
MYKFRKGLADFLTTVTFFLFMAVGAIFLIPFIAIFFVISLISPEKGLSSSEFNERLDKITNKLNAVLDKKA

SEQ ID NO: 335 - protein, 103 aa, Unknown
  Description of Unknown: Bacteriophage F488/08
MISFERYVVESWNGFDMFGNDYYFYECSLNPSFWAGREQDLEEINARADLLGELPTTYFTFDESGFVIQVYFPEENSGEDSVNPPYWAYQGIISRGTKLELKE

SEQ ID NO: 336 - protein, 107 aa, Unknown
  Description of Unknown: Bacteriophage F488/08
VEQNSNLKNKIEVYGIPDEVGRCPGCQSVTKLLKELNAPFTFYKVLTNNGKIEYDRPLIVSLAKRAGFTSLNIRYPVIFINDSRQKNIKHFKETLISLGYDRDIIED

SEQ ID NO: 337 - protein, 60 aa, Unknown
  Description of Unknown: Bacteriophage F488/08
MVVVDKEIKKGQYYFINGNVVRVTYVNGFEVYYLILKLHKQMICDRAVFSSVAKEIKLHG

SEQ ID NO: 338 - protein, 97 aa, Unknown
  Description of Unknown: Bacteriophage F488/08
MGKTYRRKDLKVRDYDYFGKRKAPDGVSHKDMVENIFRSDKWRRMKGIDSEVKDELNRQLRSEVRKLKKSVYIDDDFDYNTSQRVAKRKSNECYRYS

SEQ ID NO: 339 - protein, 43 aa, Unknown
  Description of Unknown: Bacteriophage F488/08
MNIKRMLFKQGLYTLNATPKGDTTKWSVNDWIKFIDENGNWEI

SEQ ID NO: 340 - protein, 66 aa, Unknown
  Description of Unknown: Bacteriophage F488/08
MNPESKLSQRIAEERAKFFQNMKHNGIEDEVFLNWFWNNKYAACEGALSLSVAMMYEGWKGAKKFS

SEQ ID NO: 341 - protein, 108 aa, Unknown
  Description of Unknown: Bacteriophage F488/08
MTIQIKNAINSYAYDKVVSLLEKGDIVTPQILDKWEKELHQTMKQNDQKIGRNTVRELLVQYILSEFDVKAFGVESKAYQKHEISDKTIRRMKNQRKKKFADLKITKV

SEQ ID NO: 342 - protein, 71 aa, Unknown
  Description of Unknown: Bacteriophage F488/08
MNEALINDLRLAGYEVNTNGIGLTQIEGNGFILEYEFSQWWLYANYGELIEYVDQFDSLDAALEAAKLMNV

SEQ ID NO: 343 - protein, 89 aa, Unknown
  Description of Unknown: Bacteriophage F488/08
MKLINISIAIENFGIFYVDQYMKISFFPNKTGVGYWESHVSELNESEYVSTHKKFLDFLYRADINDHYIDIHEFKKMMEKVFQAYCLLR

SEQ ID NO: 344 - protein, 185 aa, Unknown
  Description of Unknown: Bacteriophage F488/08
MSETKPKYNYVNNKELLQAIIDWKTELANNKDPNKVVRQNDTIGLAIMLIAEGLSKRFNFSGYTQSWKQEMIADGIEASIKGLHNFDETKYKNPHAYITQACFNAFVQRIKKERKEVAKKYSYFVHNVYDSRDDDMVALVDETFIQDIYDKMTHYEESTYRTPGAEKKSVVDDSPSLDFLYEAND

SEQ ID NO: 345 - protein, 72 aa, Unknown
  Description of Unknown: Bacteriophage F488/08
MRLTINLSGFLEEIPEVEAIPYLLKMYLREVLALDIDIDPENPYDTAFKSNGVELNYRYHLTDDDFYFILEK

SEQ ID NO: 346 - protein, 105 aa, Unknown
  Description of Unknown: Bacteriophage F488/08
MTDKPEINDEVEKLISSIEEKNRLEAERKANKLLSKNKRELNRLYKHAQIAAENNNFAQYEYAIKKSRDILKQPYNDELISILWKTTRSQIEDMIDAYTRKIQAS

SEQ ID NO: 347 - protein, 67 aa, Unknown
  Description of Unknown: Bacteriophage F488/08
MLTHVKFKRLKINAGFTESLNGHLCVKISEKEYHDSSIKEVNPPIVRADPNMKVWVDSYQVKKWWQL

SEQ ID NO: 348 - protein, 57 aa, Unknown
  Description of Unknown: Bacteriophage F488/08
MNTQTSEIDYNKIRSSKEEMMRRFKESHDKAKAEGTIKYKRIKFKSSNEPLYGVLCG

SEQ ID NO: 349 - protein, 400 aa, Unknown
  Description of Unknown: Bacteriophage F488/08
MKVCIFMARGLEGCGVTKFSLEQRDWFIKNGHEVTLVYAKDKSFTRNCAHDYKSFSIPVLLAKEYDKTLKLVNDCDILIINSVPATSVEEDTINNYKKIIDNIKPSVRVVVYQHDHSSLSLRRNLGLEETIRRADVIFSHSDNGDFNKVLMKEWYPETVSLFDDIEEAPTVYNFQPPMDIAKVRSTYWKDVSEINMNINRWIGRTTTWKGFYQMFDFHEKHLKPAGLSTIMEGLERSPAFIPIKEKGIPYEYYRLHQVDQIKIAPNLPTQILDRYVNSEMLERMSKSGFGYQLSKLDKKYLQRSLEYTHLELGACGTIPVFWKSTGENLKFRVDNTPLTSHDSGIIWFDENDMESTFERIKELSSDRTLYDREREKAYEFLYQHQDSSFCFKEQFDIITK

SEQ ID NO: 350 - protein, 339 aa, Unknown
  Description of Unknown: Bacteriophage F488/08
MKILNLGDWHLGVKADDEWVQSIQLDGIKQAIEYSKKNGITTWIQYGDIFDVRKAITHKTMEFAREIVQMLDDAGITLHTIVGNHDMHFKNTLTPNASTELLAKYPNVKVYDKPTTVDFDGCLIDLIPWMCEENTGEILEHIKTSSASFCVGHWELNGFYFYKGMKSHGLEPDFLKTYKEVWSGHFHTISEAANVRYIGTPWTLTAGDENDPRGFWMFDTETERMEFIPNNTTWHRRIHYPFKGKIDYKDFTNLSVRVIVTEVDKNLTKFESELEKVVHSLRVVSKIDNSVESDDSEEVEVQSLQTLMEEYINAIPDITDSDREALIQYANQLYVEATQ

SEQ ID NO: 351 - protein, 87 aa, Unknown
  Description of Unknown: Bacteriophage F488/08
MTFDEFKNVMMSQHFECEVKDDIGHKEIIEYWFEPLEVEDNCIKKVTVCTDWAVSFNFNILDNDTPKSLRDMAVSCIKDAYCEVFDI

SEQ ID NO: 352 - protein, 68 aa, Unknown
  Description of Unknown: Bacteriophage F488/08
VKFSTFDINDEFIANIDYTEEDSRYVGIIYITSKTAQGVVCMAEFDEYFLDYDDMIEWSKRYIKRNLL

SEQ ID NO: 353 - protein, 546 aa, Unknown
  Description of Unknown: Bacteriophage F488/08
MSVGGNPIDIQLDKVQKTLITGRNGGGKSTMLEAITFGLFGKPFRDVKKGQLINSTNKKELLVELWMEYDEKKYYIKRGQKPNVFEITVNGTRLNESASSKDFQAEFEQLIGMSYASFKQIVVLGTAGYTPFMGLSTPARRKLVEDLLEVGTLAEMDKLNKALIRELNSQNQVLDVKKDSIIQQIKIYNDNVERQKKLTGDNLTRLQNMYDDLAKEARTLKSEIEEANERLVNIVLDEDPTDAFNKIGQEAVLIKSKIDSYNKVINMYHEGGLCPTCLSQLSSGDKVVSKIKDKVSECTHSFEQLSTHRDNLKVLVDEYRDNIKTQQSLANDIRNKKQSLITTVDKAKKVKAAIEKASSEFIDHADEIALLQEELDKIVKTKTNLVMEKYHRGILTDMLKDSGIKGAIIKKYIPLFNKQINHYLKIMEADYVFTLDEEFNETIKSRGREDFSYASFSQGEKARIDIALLFTWRDIAEKVSGVKINTLILDEVFDSATDVEGVKAISTILDSLKNTNVFVISHRDHDPQAYGQHLQMKKVGRFTVMV

SEQ ID NO: 354 - protein, 62 aa, Unknown
  Description of Unknown: Bacteriophage F488/08
MEYSTGQHLLTIPEIKRYILRNNFSNEEHIVTESMLRNAFKAEYTKIMSNRNEAWTVTDYYD

SEQ ID NO: 355 - protein, 129 aa, Unknown
  Description of Unknown: Bacteriophage F488/08
MTKITVNYTVDVKDIQPKHVRSESNPQNQNKIRRAWVLSLSDNAMEVIQNKIKSAPARHAYYEAIDREVSNKWIELMRKHTTESLNAGAKFIMTSCGERLEDEYCGNADERLIVAAQIVAETIAADFNR

SEQ ID NO: 356 - protein, 228 aa, Unknown
  Description of Unknown: Bacteriophage F488/08
MKLSKDTTALLKNFATINSGIMLKSGQFIMTRAVNGTTYAEANISDVIDFDVAIYDLNGFLGILSLVNDDAEISQSEDGNIKIADARSTIFWPAADPSTVVAPNKPIPFPVASVVTEIKAEDLQQLLRVSRGLQIDTIAITVKEGKIVINGFNKVEDSALTRVKYSLTLGDYDGENTFNFIINMANMKMQPGNYKLLLWAKGKQGAAKFEGEHANYVVALEADSTHDF

SEQ ID NO: 357 - protein, 319 aa, Unknown
  Description of Unknown: Bacteriophage F488/08
MITVNEKEHILEQKYRPSTIDECILPAFDKETFKSITSKGKIPHIILHSPSPGTGKTTVAKALCHDVNADMMFVNGSDCKIDFVRGPLTNFASAASFDGRQKVIVIDEFDRSGLAESQRHLRSFMEAYSSNCSIIITANNIDGIIKPLQSRCRVITFGQPTDEDKIEMMKQMIRRLTEICKHEGIAIADMKVVAALVKKNFPDFRKTIGELDSYSSKGVLDAGILSLVTNDRGAIDDVLESLKNKDVKQLRALAPKYAADYSWFVGKLAEEIYSRVTPQSIIRMYEIVGENNQYHGIAANTELHLAYLFIQLACEMQWK

SEQ ID NO: 358 - protein, 187 aa, Unknown
  Description of Unknown: Bacteriophage F488/08
MSLFEDDIQLNEHQVAWYSKDWTAVQSAADSFKEKAENEFFEIIGAINNKTKCSIAQKDYSKFMVENALSQFPECMPAVYAMNLIGSGLSDEAHFNYLMAAVPRGKRYGKWAKLVEDSTEVLIIKLLAKRYQVNTNDAINYKSILTKNGKLPLVLKELKGLVTDDFLKEVTKNVKEQKQLKKLALEW

SEQ ID NO: 359 - protein, 122 aa, Unknown
  Description of Unknown: Bacteriophage F488/08
MIEITLKKPEDFLKVKETLTRMGIANNKDKVLYQSCHILQKKGLYYIVHFKEMLRMDGRQVEMTEEDEVRRDSIAWLLEDWGLIEIVPGQRTFMKDLTNNFRVISFKQKHEWKLVPKYTIGN

SEQ ID NO: 360 - protein, 73 aa, Unknown
  Description of Unknown: Bacteriophage F488/08
MTAITPQEYMASLKEKYNLSATETLFDLPENLQLKFQVEFQKLVHPEQKHFTAVVKSINADGMIIFTRQIVLI

SEQ ID NO: 361 - protein, 898 aa, Unknown
  Description of Unknown: Bacteriophage F488/08
MKEFYISIETVGNNIVERYIDENGKERTREVEYLPTMFRHCKEESKYKDIYGKNCAPQKFPSMKDARDWMKRMEDIGLEALGMNDFKLAYISDTYGSEIVYDRKFVRVANCDIEVTGDKFPDPMKAEYEIDAITHYDSIDDRFYVFDLLNSMYGSVSKWDAKLAAKLDCEGGDEVPQEILDRVIYMPFDNERDMLMEYINLWEQKRPAIFTGWNIEGFDVPYIMNRVKMVLGERSMKRFSPIGRVKSKLIQNMYGSKEIYSIDGVSILDYLDLYKKFAFTNLPSFSLESVAQHETKKGKLPYDGPINKLRETNHQRYISYNIIDVESVQAIDKIRGFIDLVLSMSYYAKMPFSGVMSPIKTWDAIIFNSLKGEHKVIPQQGSHVKQSFPGAFVFEPKPIARRYIMSFDLTSLYPSIIRQVNISPETIRGQFKVHPIHEYIAGTAPKPSEEYSCSPNGWMYDKHQEGIIPKEIAKVFFQRKDWKKKMFAEEMNAEAIKKIIMKGAGSCSTKPEVERYVKFSDDFLNELSNYTESVLNSLIEECEKAATLANTNQLNRKILINSLYGALGNIHFRYYDLRNATAITIFGQVGIQWIARKINEYLNKVCGTNGEDFIAAGDTDSVYVCVDKVIEKVGLDRFKEQNDLVEFMNQFGKKKMEPMIDVAYRELCDYMNNREHLMHMDREAISCPPLGSKGVGGFWKAKKRYALNVYDMEDKRFAEPHLKIMGMETQQSSTPKAVQEALEESIRRILQEGEESVQEYYKNFEKEYRQLDYKVIAEVKTANDIAKYDDKGWPGFKCPFHIRGVLTYRRAVSGLGVAPILDGNKVMVLPLREGNPFGDKCIAWPSGTELPKEIRSDVLSWIDYSTLFQKSFVKPLAGMCESAGMDYEEKASLDFLFG

SEQ ID NO: 362 - protein, 126 aa, Unknown
  Description of Unknown: Bacteriophage F488/08
MKIAILVIALGLTGCVAQGPVVNQSDVGKIVNCSSKFYNPNVKCYKEAPKQTVEQMQANFDEAIRPDESAQAYRNSDVITREEKIENYCAELWANWANNYQWRTGKNAPMEYVVNSYNSCVKNLTK

SEQ ID NO: 363 - protein, 83 aa, Unknown
  Description of Unknown: Bacteriophage F488/08
METLVAGSIFMVLVSGVLAIIIYMLPWFIALMRGSKSTVGIFFTSLLFNWSIIGWFITFIWSIAGETKKSAQPNQVIIIREKE

SEQ ID NO: 364 - protein, 246 aa, Unknown
  Description of Unknown: Bacteriophage F488/08
MISDSMTVEEIRLHLGLALKEKDFVVDKTGVKTIEIIGASFVADEPFIFGALNDEYIQRELEWYKSKSLFVKDIPGETPKIWQQVASSKGEINSNYGWAIWSEDNYAQYDMCLAELGQNPDSRRGIMIYTRPSMQFDYNKDGMSDFMCTNTVQYLIRDKKVNAVVSMRSNDCWAGYRNDYAWQKYVLDKLVSDLNAGDPSRQYKAGSIIWNVGSLHVYENQFYLVDHWWNTGETHIAKKDYTGKWK

SEQ ID NO: 365 - protein, 213 aa, Unknown
  Description of Unknown: Bacteriophage F488/08
MEVNVPHVYKYKHPKTKKWYIGSHDGHNPNYDGSGVVWQHVKKKYGIKSFNKEILYEGPMFRQVEEIILTCLDAANCPDSYNLKNEAWGGSFPGKLNGMYGKKLSPEERYKCGNAFRGIKRPDHSKRMKGEGNPMYGKNEQAYGIINRAKENSGKTYEEIFGVEKAKIIKETMSKNRKGKPHNLIEKICPHCGLKGRGPNMTRYHFDKCKALK

SEQ ID NO: 366 - protein, 280 aa, Unknown
  Description of Unknown: Bacteriophage F488/08
MIQFVIPSYQRVGAVSALDMFPTDYEPHIVVREHEEKAYYDAYGSKAKIVTIPDDVNGIAGTRKAITDMYAGQRIWMIDDDTTIRMSSMRKRDDRRCVDKVNQLTREQFYELIQYVEDAMDCGYYHGHARLPIFKITSSWGNYRENSYGFTNTWYDLGKLTTEQIGYGKIDLCEDMYAFLNLINQGYPHLALFKYLVVSGKAQAPGGCSSIRSNSKHNRALEQINREFPEQARWKTSNIEKRKSLGEEDEPLKVLRMCVSRKEKSEAFHKFNAIHPIAVD

SEQ ID NO: 367 - protein, 393 aa, Unknown
  Description of Unknown: Bacteriophage F488/08
MSIADLKSRLIKASTSKMTAELTTSKFFNEKDVIRTKIPMLNIAISGAIDGGMQSGLTIFAGPSKHFKSNMSLTMVAAYLNKYPDAVCLFYDSEFGITPAYLRSMGVDPERVIHTPIQSVEQLKIDMVNQLEAIERGEKVIVFIDSIGNMASKKETEDALNEKSVADMTRAKSLKSLFRIVTPYFSIKNIPCVAVNHTIETIEMFSKTVMTGGTGVMYSADTVFIIGKRQIKDGSDLQGYQFVLNVEKSRTVKEKSKFFIDVKFDGGIDPYSGLLDMALELGFVVKPKNGWYAREFLDEETGEMIREEKSWRAKDTNCTTFWGPLFKHQPFRDAIKRAYQLGAIDSNEIVEAEVDELINSKVEKFKSPESKSKSAADLETDLEQLSDMEEFNE

SEQ ID NO: 368 - protein, 112 aa, Unknown
  Description of Unknown: Bacteriophage F488/08
MSKDDLDLEIIDESPSSEGEEERKERLFNESLKIIKSAMENVIQEIVIKLEDGSTHIVYVTKLDWVDGKVVMDFAVLDQERKAELAPHVEKCITMQLQDAFNKRSKKKFKFF

SEQ ID NO: 369 - protein, 475 aa, Unknown
  Description of Unknown: Bacteriophage F488/08
VVEIILSHLIFDQAYFSKVWPYMDSEYFESGPAKNTFKLIKSHVNEYHSVPSINALNVALENSSFTETEYSGVKTLISKLADSPEDHSWLVKETEKYVQQRAMFNATSKIIEIQTNAELPPEKRNKKMPDVGAIPDIMRQALSISFDSYVGHDWMDDYEARWLSYMNKARKVPFKLKILNKITKGGAETGTLNVLMAGVNVGKSLGLCSLAADYLQLGHNVLYISMEMAEEVCAKRIDANMLDVSLDDIDDGHISYAEYKGKMEKWREKSTLGRLIVKQYPTGGADANTFRSLLNELKLKKNFVPTIIIVDYLGICKSCRIRVYSENSYTTVKAIAEELRALAVETETVLWTAAQVGKQAWDSSDVNMSDIAESAGLPATADFMLAVIETEELAAAEQQLIKQIKSRYGDKNKWNKFLMGVQKGNQKWVEIEQDSTPTEVNEVAGSQQIQAEQNRYQRNESTRAQLDALANELKF

SEQ ID NO: 370 - protein, 60 aa, Unknown
  Description of Unknown: Bacteriophage F488/08
MELVKVVFMGWFKNESMFTKEITMMKDDVQWATTQYAEVNKALVKAFIDDKKVCEVDCRG

SEQ ID NO: 371 - protein, 80 aa, Unknown
  Description of Unknown: Bacteriophage F488/08
MHIVLFKPTPYNVRKNTQFKALIADTWELVLDIPAEESPPFGRVEFIKFAVRPTKRQIRQCKRYFRKIVKLEKQLLMLVK

SEQ ID NO: 372 - protein, 84 aa, Unknown
  Description of Unknown: Bacteriophage F488/08
MMLVNREYQFKSEEDLEKFASGCELNRRTAKVIGLKPFTVLDCEVSKFRRGCSISGHALVDGNTFFFVFSVRELLLINELEEIK

SEQ ID NO: 373 - protein, 60 aa, Unknown
  Description of Unknown: Bacteriophage F488/08
MSKVSGYQLLTQEQRSEMDSLQERCQHRNNALDSFLLVEYENLCSRLEKEYVHQHEGGEE

SEQ ID NO: 374 - protein, 97 aa, Unknown
  Description of Unknown: Bacteriophage F488/08
MKKFIFAAIFALSSCAAQPAMAGYDKDLCEWSMTADQTEVETQIEADIMNIVERDRPEMKAEVQKQLKSGGVMQYNYVLYCDKNFNNKNIIAEVVGE

SEQ ID NO: 375 - protein, 33 aa, Unknown
  Description of Unknown: Bacteriophage F488/08
MLSDEINDLLNDAEKVAIPSIDDQIFNAFMNRG

SEQ ID NO: 376 - protein, 54 aa, Unknown
  Description of Unknown: Bacteriophage F488/08
MKTFKEFIKEDMVAGDSGGNPENISTGTTSGAVVNKGPEQIPKKKKEESKEKEE

SEQ ID NO: 377 - protein, 342 aa, Unknown
  Description of Unknown: Bacteriophage F488/08
MSSIPWIDNEFAYRALAHLPKFTQVNNSSTFKLRFRCPVCGDSKTDQNKARGWYYGDNNEGNIHCYNCNYHAPIGIYLKEFEPDLYREYIFEIRKEKGKSRPVEKPKELPKQPEKKIIKSLPSCIRLDKLAEDHPIIKYVKARCIPKDKWKYLWFTTEWPKLVNSIAPGTYKKEIPEPRLVIPIYNANGKAESFQGRALKKDAPQKYITIKAYPEATKIYGVERVKDGDVYVLEGPIDSLFIENGIAITGGQLDLEIVPFKDRRVWVLDNEPRHPDTIKRMTKLVDAGERVMFWDKSPWKSKDVNDMIRKEGATPEQIMEYMKNNIAQGLMAKMRLSKYAKI

SEQ ID NO: 378 - protein, 66 aa, Unknown
  Description of Unknown: Bacteriophage F488/08
MVQKLMALVNAIKGNKKRIAFTISAMIGILLWNFVLSPVAIAHGVSIPVITLDTFVDLAFALVGLI

SEQ ID NO: 379 - protein, 172 aa, Unknown
  Description of Unknown: Bacteriophage F488/08
MAYFNECAHLIEGVDKANRAYAENIMHNIDPLQVMLDMQRHLQIRLANDKPETNRHPDSLETAGEVLAWLRNQDDYIADETRELYTSLGGMSNGEKEASAVWKPWKKRYSEMQSKKIQDLSPEDQLEIKFELIDQFHFFMNKFIALGMSAEEIFKLYYLKNAENFARQDRGY

SEQ ID NO: 380 - protein, 66 aa, Unknown
  Description of Unknown: Bacteriophage F488/08
MARLNKRQLKKAHKKRIDQLFKNYDKELVCELLSNQLRAVDWVVEEGPDEIFVSEEALKLIIEHSK

SEQ ID NO: 381 - protein, 57 aa, Unknown
  Description of Unknown: Bacteriophage F488/08
MKISKEEFIRRQKALINLHEWYAYQLKVDSSNINAVMALYKQIQDEHEFLAQVFIED

SEQ ID NO: 382 - protein, 78 aa, Unknown
  Description of Unknown: Bacteriophage F488/08
MGGFVNIKTFTHPAGEGKEVKGMEVSVPFEIYSNEHRIADSHYQIFPSEKAAYSTVVSDAADWKTKNAAMFTPTQIGG

SEQ ID NO: 383 - protein, 68 aa, Unknown
  Description of Unknown: Bacteriophage F488/08
MLNRWIKPNEDLDIIISRHVMKKYELQPWSTEVVVHSFMMYADGSVEFNAEIRYDYGEKQVEFKRGFL

SEQ ID NO: 384 - protein, 113 aa, Unknown
  Description of Unknown: Bacteriophage F488/08
MFIFNWFKSFFTDFFSTTPGEGVVPISNDYLPLTVVEYVYMGDGTVEAVTMTYEEAQEYYKNPWRWSTPITSSNTQNTQSSSDSYDTNVPVHVWTGDSCGSSCDSSCSSTSCD

SEQ ID NO: 385 - protein, 161 aa, Unknown
  Description of Unknown: Bacteriophage F488/08
MEAILFEMYISSNSMSFAKDVPITVAVMIDKGYCDPMYLVENFVSMPVPEDAEIKLKKIGIIETVPNIPFRAIEAFTKSEYINVSAEQYNDKPISFYSYDSVYSWKIDKGNKFIIVSEDALSYFISSIWNSLHPNLLKIHEFDDAPTVVLGKTNESSEENV

SEQ ID NO: 386 - protein, 67 aa, Unknown
  Description of Unknown: Bacteriophage F488/08
MKVLKKMFEWFSRPNSMYIDDGWVEQANKEMQNESEEWMKSMISVEKEKKLERSALKLMRDIYGDKS

SEQ ID NO: 387 - protein, 54 aa, Unknown
  Description of Unknown: Bacteriophage F488/08
VNRDMTLEEAKAKANEALDLLLKIGSKMMEENEKYIQENKIPDGPLVGKRKSHD

SEQ ID NO: 388 - protein, 160 aa, Unknown
  Description of Unknown: Bacteriophage F488/08
MIEVAKHYSIEFMSKEGKSVNTLDKKCSLIIPLAENPDILIKDIKERKYPENVILIIKHTEDILQNTDSPFSSSEALTIKGYKRAHEYGLFDLFEDDKVKLALNLAGQSSKSKTFIIEDIKDINAFVKMVWAHFDVGLRWRMSEEERKIIEANRYFGFYR

SEQ ID NO: 389 - protein, 60 aa, Unknown
  Description of Unknown: Bacteriophage F488/08
MDLFEMLEDNHSTNIQNDSSDYKKEYRIVLQNYGIEAPDALLEELASYHLDPPPWAPWAK

SEQ ID NO: 390 - protein, 207 aa, Unknown
  Description of Unknown: Bacteriophage F488/08
MIINLADVEQLSIKAESVDFQYDMYKKVCEKFTDFEQSVLWQCMEAKKNKALHRQLNKIIKKHLTKSPYQLYRGISKSTKELIKDLQVGEVFSTNRVDSFTTSLHTACGFSYVEYFTEIIFRLKTDKAFNYSDHISDIILSSPNTEFKYTYEDTDGLDSERTDNLMMIVREQEWMIPIGKYKITSISKEKLHDSFGTFKVYDIEVVE

SEQ ID NO: 391 - protein, 200 aa, Unknown
  Description of Unknown: Bacteriophage F488/08
MKYSAMQLKDFKIKSMDASVRASIREELLSEGFNLSEIELLIHCITNKPDDHSWLNEIIKSRLVPNDKPLWRGVPVETKQVLNQGIDIITFDKVVSASYDKNVELHFASGLEYNTQVIFEFKAPMVFNFQEYAIKALRCKEYSPSFKFPDSHRYRNMELVSDEQEVMIPAGSVFRIADRYEYKKHSTYTIYTLDFEGFNL

SEQ ID NO: 392 - protein, 248 aa, Unknown
  Description of Unknown: Bacteriophage F488/08
MKLSKNQIRKITRRLEHTQASAKRRSKDFNLDFNYIKNILDQKVCAYSGEPFDNRIEGEKLSLERFDNNVGYIKGNVIAVKKKYNTFRSDYTLEELIEKRDLFALRIGRSSAKKVHKLNLDEKKWAKIKKTYNQIKAIQKKRENRIEHISQLSKSKQTSDVKLTIIALKARIDGSRIAEGAEVVKLNVLLKGSDWKTVKKLSEAEMQYDMCDKIIQGVERYQNLSFIDKLKLKRGYPLNCSIFKLIRG

SEQ ID NO: 393 - protein, 103 aa, Unknown
  Description of Unknown: Bacteriophage F488/08
MFYVYAIVYRDKDGFAVPVPLDEHRPAVFFEREIADKVFTTLKEQYQLALGMGIPRLVETPRKFWFNKIEVKHVKPDVDTQRLYRRILDTGRIVSIPIAGNLR

SEQ ID NO: 394 - protein, 439 aa, Unknown
  Description of Unknown: Bacteriophage F488/08
MTFDDLTEGQKNAFNIVMRAIKEKKHHVTINGPAGTGKTTLTKFIIEALISTGETGIILAAPTHAAKKILSKLSGKEASTIHSILKINPVTYEENVLFEQKEVPDLAKCRVLICDEVSMYDRKLFKILLSTIPPWCTIIGIGDNKQIRPVDPGENTAYISPFFTHKDFYQCELTEVKRSNAPIIDVATDVRNGKWIYDKVVDGHGVRGFTGDTALRDFMVNYFSIVKSLDDLFENRVMAFTNKSVDKLNSIIRKKIFETDKDFIVGEIIVMQEPLIKTYKIDGKPVSEIIFNNGQLVRIIEAEYTSTFVKARGVPGEYLIRHWDLTVETYGDDEYYREKIKIISSDEELYKFNLFLGKTAETYKNWNKGGKAPWSDFWDAKSQFSKVKALPASTFHKAQGMSVDRAFIYTPCIHYADAELAQQLLYVGVTRGRYDVFYV

SEQ ID NO: 395 - protein, 86 aa, Unknown
  Description of Unknown: Bacteriophage F488/08
MININSKYLNRLIDGIRKHTNKQDNLDVMVTGAELLHKLYLISDTILAIKRIEKQSYHSNTDTVITLDESVCKLLIKFEEAIRGNN

SEQ ID NO: 396 - protein, 81 aa, Unknown
  Description of Unknown: Bacteriophage F488/08
VEITKDQFYLLQDKVSEIYEIAYSKNRETVKIESSKLMLQLEEIERDLIALEFFCGEVKTVTISDYVLGEISYLYKAIIND

SEQ ID NO: 397 - protein, 80 aa, Unknown
  Description of Unknown: Bacteriophage F488/08
MIELSWCQFKSLMTNVKAVIEKNSGPENITIREKALKIIYSLEEMQKDIESMAKFIDEPINKVYIQDYTVGQIRDLARKI

SEQ ID NO: 398 - protein, 227 aa, Unknown
  Description of Unknown: Bacteriophage F488/08
MFDFIIDFETMGSGEKAAVIDLAVIAFDPNPEVVETFDELVSRGIKIKFDLKSQKGHRLFTKSTIEWWKNQSPEARKNIAPSDEDVSTIDGIAKFNDYINAHNIDPWKSQGWCRGMSFDFPILVDLIRDIQRLNGVSENELDTFKLEPCKFWNQRDIRTRIEALLLVRDMTTCPLPKGTLDGFVAHDSIHDCAKDILMMKYALRYAMGLEDAPSEEDCDPLSLPTKR

SEQ ID NO: 399 - protein, 166 aa, Unknown
  Description of Unknown: Bacteriophage F488/08
MKIYRVESSFSILDYEDAITIRRNLCVQITPYRSIIDSWSEEWLLHVGYDRPNFMHHSDNNKRIPLPHEDKLLVKNANIVINTKFKKDYVGVEYHIPGWFIALYHFAFASEYDMMRWFTREEREELASKGFYLAVYEVPDDQVIVGGHQVMFRKSHAELVDFIEMR

SEQ ID NO: 400 - protein, 181 aa, Unknown
  Description of Unknown: Bacteriophage F488/08
MKFNYNPEYTPNPAAKLIDFDVVSTYVCPVKPLEIKEPTMTTAIEIGKTYKLVEPKIKTNALISGHKTLTDVFGEGEFIVEEFAKSEWFDKSYVIHGRRLDNNKIKKNLVYEDEFILFQEVEEQDPTDLLCAAVSIRRPFDNPICGWVTDQWIEDGVELLNVVHAGDFSVVPRSAVVAILN

SEQ ID NO: 401 - protein, 162 aa, Unknown
  Description of Unknown: Bacteriophage F488/08
MIINIGEIARVSDKSRSKAAGKLVEVVSIQLKHGVKDEDSEVKVRIIAKDGMSKPQFGYVRWKFLEPAFLKAVPAKGIETIDTSHVGVDFKWKLGQAIKFIAPCEFKFIKDDGKAVYTRAMCGYITDQWVEDGVKLYNVVFLGTYKVIPESWIKHYSNALYA

SEQ ID NO: 402 - protein, 71 aa, Unknown
  Description of Unknown: Bacteriophage F488/08
MKRKIVQNCTNDEFEDVLFDPDLVVVQKEHTIKFTHLTSVYVYEKVGDKQPIYGVFREITEDGTTYWKEIY

SEQ ID NO: 403 - protein, 137 aa, Unknown
  Description of Unknown: Bacteriophage F488/08
MAIKFEVNKWYQFKNKQAQENFIKDHTDNGIYARRLGMHPFKILDVDALGRPIKIMSFAGNLVLSSGKDILDEDFIWLSSNEAEFFNEVENPYQAAEEQEESAPITDQSKFPVMKVTIENDEQAWSLYQMLKAHFKE

SEQ ID NO: 404 - protein, 58 aa, Unknown
  Description of Unknown: Bacteriophage F488/08
MPLYDYKCQSKDCAKEYEKIKKISERDTDVCPDCHRIAIRLVSAPKHVNGGFYDLLKG

SEQ ID NO: 405 - protein, 123 aa, Unknown
  Description of Unknown: Bacteriophage F488/08
MFKIGKKYRIREGEEKKYLFSAIYRNGSINAVISTSEFIVEDMKGNNVTMISTASGNDGKILHSFQSNVLIYDEEFDFFEEVPEGFAFECTITMKSGDPLSFTVKDEGSRLRIISLLQAIKFK

SEQ ID NO: 406 - protein, 86 aa, Unknown
  Description of Unknown: Bacteriophage F488/08
MKYINRSIAALVLAVSLVGCTDADNATKVLSSSGFTNIEITGYNWFGCSENDFQHTGFRAIGPTGQKVEGTVCSGLFFKDSTIRFK

SEQ ID NO: 407 - protein, 605 aa, Unknown
  Description of Unknown: Bacteriophage F488/08
MIKNEIKILSDIEHIKKRSGMYIGSSANEMHERFLFGKWESVQYVPGLVKLIDEIIDNSVDEGIRTKFKFANKINVTIKNNQVTVEDNGRGIPQAMVKTPTGEEIPGPVAAWTIPKAGGNFGDDKERVTGGMNGVGSSLTNIFSVMFVGETGDGQNNIVVRCSNGMENKSWETIPGKWKGTRVTFIPDFMSFETNELSQVYLDITLDRLQTLAVVYPDIQFTFNGKKVQGNFKKYARQYDEHAIVQEQENCSIAVGRSPDGFRQLTYVNNIHTKNGGHHIDCVMDDICEDLIPQIKRKFKIDVTKARVKECLTIVMFVRDMKNMRFDSQTKERLTSPFGEIRSHIQLDAKKISRAILNNEAILMPIIEAALARKLAAEKAAETKAAKKASKAKVHKHIKANLCGKDADTTLFLTEGDSAIGYLIDVRNKELHGGYPLRGKVLNSWGMSYADMLKNKELFDICAITGLVLGEKAENLNYHNIAIMTDADHDGLGSIYPSLLGFFSNWPELFEQGRIRFVKTPVIIAQVGKKQEWFYTVAEYESAKDALPKHSIRYIKGLGSLEKSEYREMIQNPVYDVVKLPENWKELFEMLMGDNADLRKEWMSQ

SEQ ID NO: 408 - protein, 67 aa, Unknown
  Description of Unknown: Bacteriophage F488/08
MKSYKVNLELFDKAVHREYRIIQRFFDMGEAEEFKNRFKDIRDKIQSDTATKDELLEVAEVIKRNMN

SEQ ID NO: 409 - protein, 725 aa, Unknown
  Description of Unknown: Bacteriophage F488/08
MIITTEKETILGNGSKSKAFSITASPKVFKILSSDLYTNKIRAVVRELITNMIDAHALNGNPEKFIIQVPGRLDPRFVCRDFGPGMSDFDIQGDDNSPGLYNSYFSSSKAESNDFIGGFGLGSKSPFSYTDTFSITSYHKGEIRGYVAYMDGDGPQIKPTFVKEMGPDDKTGIEIVVPVEEKDFRNFAYEVSYIMRPFKDLAIINGLDREIDYFPDFDDYYGINPERYWPDRGGLYAIYGGIVYPIDGVIKDRNWLSIRNEVNYIKFPMGSLDIAPSREALSLDDRTRKNIIERVKELSEKAFNEDVKRFKESTSPRHTYRELMKMGYSARDYMISNSVKFTTKNLSYKKMQSMFEPDNKLCNAGVVYEVNLDPRLKRIKQSHETSAVASSYRLFGINTTKINIVIDNIKNRVNIVRGLARALDDSEFNNTLNIHHNERLLFINPEVESQIDLLPDIMAMFESDEVNIHYLSEIEALVKSYIPKVVKSKAPRPKAATAFKFEIKDGRWEKEELFTLTSEADEITGYVAYMHRSDIFSMDGTTSLCHPSMNILIRMANLIGINEFYVIRPLLQKKVKELGQCQCIFETLRDLYVDAFDDVDYDKYVGYSSSAKRYIDKIIKYPELDFMMKYFSVDEVSEEYTRLANMVSSLQGVYFNGGKDTIGHDIWTVTNLFDELSRNASKNSDKMVAEFTKKFRIVSDFIGYRNSLSDDEVSQIAKTMKALAA

SEQ ID NO: 410 - protein, 312 aa, Unknown
  Description of Unknown: Bacteriophage F488/08
MYNIKCLTKNEQAEIVKLYSSGNYTQQELADWQGVSVDTIRRVLKNAEEAERSKVTISGDITVKVNSDAVIAPVAKSDIIWNASKKFISITVDGVTYNATPNTHSNFQEILNLLVADKLEEAAQKINVRRAVEKYISGDVRIEGGSLFYQNIELRSGLVDRILDSMEKGENFEFYFPFLENLLENPSQKAVSRLFDFLVANDIEITEDGYFYAWKVVRSNYFDCHSNTFDNSPGKVVKMPRTRVNDDDTQTCSRGLHVCSKSYIRHFGSSTSRVVKVKVHPRDVVSIPIDYNDAKMRTCQYEVVEDVTEQFK

SEQ ID NO: 411 - protein, 64 aa, Unknown
  Description of Unknown: Bacteriophage F488/08
MLGYQARVKEEYDQLMLKINALSNFLESTKFLTVSAVEQELLLSQFISMKSYADCLEKRIAQFK

SEQ ID NO: 412 - protein, 185 aa, Unknown
  Description of Unknown: Bacteriophage F488/08
MQKTNPGLQRLFQIPSFTLSNSDLTSEMKVKIADTARYSLKQNPNQDKAEVIERCRIAVYAEFFVADWLRGYVNKGQEDVNDPYTYAWDVLAHPKYCGLRVEVKTHQTDSRWISVTTGCSGEYPYGSGINLGPILNHQVADCIIIFNTKEIHPGVIQYTPKFIGDREDLRKVVRKSNYNGWYLSI

SEQ ID NO: 413 - protein, 87 aa, Unknown
  Description of Unknown: Bacteriophage F488/08
MKFKFYYAKHKITGEFIAFTTSTTDEGDIFTAVFLSKWESDQPYLSSREDLQRLVNGEYNDSWSYLVHDCVKKAIKQKHLEIVEIEL

SEQ ID NO: 414 - protein, 32 aa, Unknown
  Description of Unknown: Bacteriophage F488/08
MKILNSVLIACAWWVAQVSAVVVGIHIYYEYF

SEQ ID NO: 415 - protein, 37 aa, Unknown
  Description of Unknown: Bacteriophage F488/08
MKKIVKAIWNVVIILIVLSIFPIVLMIDVLNAYFGFM

SEQ ID NO: 416 - protein, 65 aa, Unknown
  Description of Unknown: Bacteriophage F488/08
MKRKRSAFTFIEWFFDNIFPALFIFMLIFALGSVVVGIYLMTVVGIDIHQNGLKSVVETIWNGVK

SEQ ID NO: 417 - protein, 36 aa, Unknown
  Description of Unknown: Bacteriophage F488/08
MMNLLSGWFYILMFYIGANFPYWMGWSTTAFGFYTP

SEQ ID NO: 418 - protein, 71 aa, Unknown
  Description of Unknown: Bacteriophage F488/08
MKIFKDVKVGEIFCLDNGDQLIRISPLKSTSEKPTVNATLANNSNERFCIENDTETYTVEEFWELSVDCDD

SEQ ID NO: 419 - protein, 152 aa, Unknown
  Description of Unknown: Bacteriophage F488/08
MKYMTVTDLNNAGATVIGTIKNGEWFLGVPHKDILSKPGFYFLVSKLDGRPFSNPCVSARFYVGNQRSKQGFSAVLSHIRQRRSQLARTIANNNVPYTVFYLPASKMKPLTTGFGKGQLALAFIRNHHSEYQTLEEMNRMLADNFKFVLQAY

SEQ ID NO: 420 - protein, 52 aa, Unknown
  Description of Unknown: Bacteriophage F488/08
MNIAKLLGVISFICWIVACVLTICIDVSSVFSQALAQGMCAYLTFVLLSTND

SEQ ID NO: 421 - protein, 442 aa, Unknown
  Description of Unknown: Bacteriophage F488/08
MQLNNRDLKSIIDNEALAYAMYTVENRAIPNMIDGFKPVQRFVIARALDLARGNKDKFHKLASIAGGVADLGYHHGENSAQDAGALMANTWNNNFPLLDGQGNFGSRTVQKAAASRYIFARVSKNFYNVYKDTEYAPVHQDKEHIPPAFYLPIIPTVLLNGVSGIATGYATYILPHSVSSVKKAVLQALQGKKVTKPKVEFPEFRGEVVEIDGQYEIRGTYKFTSRTQMHITEIPYKYDRETYVSKILDPLEDKGFITWDDACGEHGFGFKVKFRKEYSLSDNEEERHAKIMKDFGLIERRSQNITVINEKGKLQVYDNVVDLIKDFVEVRKTYVQKRIDNKIKETESAFRLAFAKAHFIKKVISGEIVVQGKTRKELTEELSKIDMYSSYVDKLVGMNIFHMTSDEAKKLAEEAKAKKEENEYWKTTDVVTEYTKDLEEIK

SEQ ID NO: 422 - protein, 49 aa, Unknown
  Description of Unknown: Bacteriophage F488/08
MSPFIGITSAALVSGGILLAGLGVVPAVAGGLLAFGIQRVIMTVITVMQ

SEQ ID NO: 423 - protein, 75 aa, Unknown
  Description of Unknown: Bacteriophage F488/08
MKFKIENEIVKAKNALTANKLVVDGIEYDICGVREEKPGVLTFFTMIFKFKGDTEFKQFDFAHEDEIEVRNLNIK

SEQ ID NO: 424 - protein, 211 aa, Unknown
  Description of Unknown: Bacteriophage F488/08
MSKVTYIIKASNDVLNEKTAAILITIAKKDFITAAEVREVHPDLGNAVVNSNIGVLIKKGLVEKSGDGLIITGEAQDIISNAATLYAQENAPELLKKRATRKAREITSDMEEDKDLMLKLLDENGFVLKKVETYRSNYLAILEKRTHGIRNFEINNNGNMRIFGYKMMEHHIQKFTDIGMSCKIAKNGNVYLDIKRSAENIEAVITVASEL

SEQ ID NO: 425 - protein, 109 aa, Unknown
  Description of Unknown: Bacteriophage F488/08
MNKLEIVNELRRCVEPTQEGWDIWYHGAYLGTIVKIKTGKYMIIRESKDAPVGIRNNFMAAISSFTDAAYEIYLADYKEFQESQPVIRSIGVNKAQQKTLWQRIKGWFK

SEQ ID NO: 426 - protein, 153 aa, Unknown
  Description of Unknown: Bacteriophage F488/08
MNPFINRLKMLNVPLSRETPESLVEKFKAHGYKCTEEDILKEVPEICWQTAYWDENQKYQRRIVCAANRFKLKDGRTLIIPGARHYSKDMAEVLDVVKPQLVTQQVCDDDQGFIDQYSNYWTREEAMIIATYAGQVRIERGGSEKELYSEDLY

SEQ ID NO: 427 - protein, 98 aa, Unknown
  Description of Unknown: Bacteriophage F488/08
MNIKKFQIDGITNQIKALEYANKMMSTNWGIYANEPAFKFCDMEFTKKLVGKDHVCPFSSPVNGMLKPALRDLYIAMNEEMIKELKRQLKVIQFGQGN

SEQ ID NO: 428 - protein, 72 aa, Unknown
  Description of Unknown: Bacteriophage F488/08
LAREINSKSDYFNSLNDKDKNLIRHFIVEMGYTDTHDLREHIFECGVAKKFSFTCKCLREVIQHYEQFSRKT

SEQ ID NO: 429 - protein, 92 aa, Unknown
  Description of Unknown: Bacteriophage F488/08
MIIDSQSVVQYTIKIDILEKLYKFLPNLYHSIVNELVEELHLGNNDFLIGTYKDLSKAGYFYIIPAPGKSIDDVLKTIMIYVHDYEIEDYFE

SEQ ID NO: 430 - protein, 50 aa, Unknown
  Description of Unknown: Bacteriophage F488/08
MSHNLEKVIEHNVAQERKSFKEFVEKIFEENTTDQFTNQASDDIITKSTN

SEQ ID NO: 431 - protein, 90 aa, Unknown
  Description of Unknown: Bacteriophage F488/08
MNKNIDTVREIITVASILIKFSREDIVENRANFIAFLNEIGVTHEGRKLNQNSFRKIVSELTQEDKKTLIDEFNEGFEGVYRYLEMYTNK

SEQ ID NO: 432 - protein, 218 aa, Unknown
  Description of Unknown: Bacteriophage F488/08
MAAPRISFSPSDILFGVLDRLFKDNATGKVLASRVAVVILLFMMAIVWYRGDSFFEYYKQSKYETYSEIIEKERNARFESVALEQLQIVHISSEADFSAVYSFRPKNLNYFVDIIAYEGKLPSTISEKSLGGYPVDKTMDEYTVHLNGRHYYSDSKFAFLPTKKPTPEINYMYSCPYFNLDNIYAGTITMYWYRNDHISNDRLESICAQAARILGRAK

SEQ ID NO: 433 - protein, 260 aa, Unknown
  Description of Unknown: Bacteriophage F488/08
MAVVGVPGWIGSSAANETGQRWMSQAAGQLRLGVPCWMSQFAGRSREIIHTVGANHNFNGQWFRDRCFEAGGAPIVFNIVGDIVSYSKDVPLFFMYGDTPNEYVQLNIHGVTMYGRGGNGGSNSPGSAGGHCIQNDIGGRLRINNGGAIAGGGGGGGGGYYSPFSQMRLTFGGGGGRPFGAPGGSIDMQSGATGGTISAPGSGSVNGIYNGGNGGEVGSAGGRCNIRGQGSEYNGGAAGYAVIGSAPTWQNVGAIYGPRV

SEQ ID NO: 434 - protein, 982 aa, Unknown
  Description of Unknown: Bacteriophage F488/08
MATLKQIQFKRSKTAGQRPAASVLAEGELAINLKDKTIFTKDDSGSVIELGLKYGGTINGSLEVTENITGTLIGNSSTATKLQTPRKINGISFDGSKDITLTPSDINVNSTTFIKNNGELPTDANLDTYGPIEEYLGVWSKSTSTNAQPANKFPEENAVGVLEVFVAGQFAGTQRYTVRSGNVYIRSLSAKWNGVDGPWGVWRNVQASTRPLSQTIDLDSLGELEHCGLWRNSSSAIASFDRHYPEEGSAAQGFLEIFEGGLYTRTQRYTTRMGMVYTRCLAAAWDASAPKWEEWKQVGHGTPATFYDGDLNDFKTPGLYNILGTDAVINCPTGEGLPTVIVGLLEVKQRASGGAIFQRFTTAGTGATTRDRIFERAYTGGAWGAWNEVYTSYSLPITLGMGGIKAQLAELDWQTFDFVPGSMFSVPLNKIKNMPANMDWGTIDGNLVMFSVGPSEHTGTGRTVQVWRGTVSQANYRYFVVRIAGNPGSRTNTCRRVVLEDGSHTWTAQQNFRGLLNITAAVNLGANQKISLAPGAYIQAPASGSGSNTYANQNTTIAPLYQAIDDSNKNQFAPIVKQKNTVTNITMASGMDIASSEYRIVAQGDLSATGTTATELATWRFLPSGRFMSQSRVYAGAAFLNTDGNIAGSIWKKYNDATNLDAALNTRLGKGGDTMTGRLTINAPNDSIVLSTTASNSLHIRGDIDGTGNWYIGKGGADNSLAFYSYASQAAVHITNNGEIALNPQNTAMVNVNRDRVHINGSGWIARQPGDWGNQWRVEAPLFVDHGYVGQDSYYPILKARSVITNQGYSTAVDFGMRRIPSQWGQAIIRVGSTEASPDAGHPQAVFEFHHDGFFYTPGNGSFSDVYIRSDSRLKINKEELEYGAVEKVCRLKVYIYDKVKSIKDRSVIKREVGIIAQDLEKELPEAVSKVEVDGSDVLTISNSAVNALLIKAIQEMSEEIKELKTPLFTKIARKISKYFKF

SEQ ID NO: 435 - protein, 216 aa, Unknown
  Description of Unknown: Bacteriophage F488/08
MADLKVGSTVGGSVIWHQGNFPLNSAGDDVLYKSFKIYSEYNKPQAADNDFVSKANGGTYAGPITINYGVNSYLQLSNNETPIRIRSGGGTGNTLVVGGSSGGISFRPAGSEITTGQITITPEGLTTFTRAVTAPSVTVTSTPSAASDVTRKDYVDGAINTVTANANSRVLRSGDTMTGNLTAPNLFSQNPASQPSHVPRFDQIVIKDSVQDFGYY

SEQ ID NO: 436 - protein, 371 aa, Unknown
  Description of Unknown: Bacteriophage F488/08
MEKFMAEFGQGYVQTPFLSESNSVRYKISIAGSCPLSTAGPYVKFQDNPVGNQTFSAGLHLRVFDPSTGALVDSKSYAFSASNNTTSAAFVSFMNSLSNNRLVAILTSGKVNFPPEVVSWLRGAGTSVFPSDSVLSRFDVSYAAFYTSSKRAIALEHVKLSNRKSTDDYQTILDVVFDSLEDVGATGFPKRTYESVEQFMSAVGGTNNEIARLPTSAAISKLSDYNLIPGDVLYLKAQLYADADLLDLGTTNISIRFYDASNGYISSTQAEFTGQAGSWELKEDYVVVPENAVGFTIYAQRTAQAGQGGMRNLSFSEVSRNGGISKPAEFGVNGIRVNYVCESASPPDIMVLPTQASSKTGKVFGQEFREV

SEQ ID NO: 437 - protein, 1289 aa, Unknown
  Description of Unknown: Bacteriophage F488/08
MAEIKRKFRAEDGLDAGGDKIINVALADRTVGTDGVNVDYLIQENTVQQYDPTRGYLKDFVIIYNNRFWAATDNIPKPAGNFNRIRWKALRTDAVYTTVSSGPYQLKSGEAISVDTSVGNDIEFTLPPSPLDGETVIIQDIGGKPGINQVKINSSNQSIVNFRGEQVRSVLMTHPKSQMIFIFNNRLWQMYVADYSREAAIVTPSTAYQAQSNDFIVRRFTSAAPINVKLPRFANHGDIINFVDLDKLNPLYHTIVTTYDETTSVQEVGTHSIEGRTSIDGFLMFDDNEKLWRLFDGDSKARLRIITTNSNIRPNEEVMVFGANNGTTQTIELQLPTDISVGDTVKISMNYMRKGQTVKIKAAGEDKIASSVQLLQFPKRSEYPPEAEWVTVQELVFNGETNYVPVLQLAYIEDSDGKYWVVQQNVPTVERVDSLNASTRARLGVIALATQAQANADLENSPQKELAITPETLANRTATETRRGIARIATTAQVNQNTTFSFADDLIITPKKLNERTATETRRGVAEIATQQETNTGTDDTTIITPKKLQARQGSESLSGIVTFVSTAGATPASSRELNGTNVYNKNTNNLVVSPKALDQYKATPTQQGAVILAVESEVIAGQSQEGWANAVVTPETLHKKTSTDGRIGLIEIATQSEVNTGTDYTRAVTPKTLNDRRATESLSGIAEIATQVEFDAGVDDTRISTPLKIKTRFNSTDRTSVVALSGLVESGTLWDHYTLNILEANETQRGTLRVATQVEAAAGTLDNVLITPKKLLGTKSTESQEGVIKVATQSETVTGTSANTAVSPKNLKWIVQSEPTWAATTLIRGFVKTSSGSLTFVGNDTVGSTQPLESYEKNGYAVSPYELNRVLANYLPLKAKAVDSNLLDGLDSLQFIRRDIAQTVNGSLTLTQQTNLGAPLVSSSTATFGGSVSANSTLTISNTGTATRLIFEKGPQTGTNPAQTMTVRVWGNQFSGESDTTRSTVFEVSDETSSHFYSQRNKAGNITFNINGTVTPINVNASGTLNANGVATFGNSVTATGEIISRSANAFRAINGNYGFIVRNDGSVTNFMLTASGDQTGGFNGLRPLAINNASGQVTIGESLIIAKGATINSGGLTVNSRIRSQGTKTSDLYTRAPTSDTVGFWSIDINDSATYNQFPGYFKMVEKTNEVTGLPYLERGEEVKSPGTLTQFGNTLDSLYQDWITYPTTPEARTTRWTRTWQKTKNSWSSFVQVFDGGNPPQPSDIGAIPSDNGIIGNLTIRDFLRIGNVRIIPDPVNKTVKFEWVE

SEQ ID NO: 438 - protein, 305 aa, Unknown
  Description of Unknown: Bacteriophage F488/08
MDLEMMLDEDYKEGICFIDFSQIALSTALVNFPDKEKINLSMVRHLILNSIKFNVKKAKTLGYTKIVLCIDNAKSGYWRRDFAYYYKKNRGKAREESTWDWEGYFESSHKVIDELKAYMPYIVMDIDKYEADDHIAVLVKKFSLEGHKILIISSDGDFTQLHKYPNVKQWSPMHKKWVKIKSGSAEIDCMTKILKGDKKDNVASVKVRSDFWFTRVEGERTPSMKTSIVEAIANDREQAKVLLTESEYNRYKENLVLIDFDYIPDNIASNIVNYYNSYKLPPRGKIYSYFVKAGLSKLTNSINEF

SEQ ID NO: 439 - protein, 89 aa, Unknown
  Description of Unknown: Bacteriophage F488/08
MAKKEMVEFDEAIHGEDLAKFIKEASDHKLKISGYNELIKDIRIRAKDELGVDGKMFNRLLALYHKDNRDVFEAETEEVVELYDTVFSK

SEQ ID NO: 440 - protein, 112 aa, Unknown
  Description of Unknown: Bacteriophage F488/08
MTQFSLNDIRPVDETGLSEKELSIKKEKDEIAKLLDRQENGFIIEKMVEEFGMSYLEATTAFLEENSIPETQFAKFIPSGIIEKIQSEAIDENLLRPSVVRCEKTNTLDFLL

SEQ ID NO: 441 - protein, 217 aa, Unknown
  Description of Unknown: Bacteriophage F488/08
MIKLRMPAGGERYIDGKSVYKLYLMIKQHMNGKYDVIKYNWCMRVSDAAYQKRRDKYFFQKLSEKYKLKELALIFISNLVANQDAWIGDISDADALVFYREYIGRLKQIKFKFEEDIRNIYYFSKKVEVSAFKEIFEYNPKVQSSYIFKLLQSNIISFETFILLDSFLNIIDKHDEQTDNLVWNNYSIKLKAYRKILNIDSQKAKNVFIETVKSCKY

SEQ ID NO: 442 - protein, 302 aa, Unknown
  Description of Unknown: Bacteriophage F488/08
MFKRKSTAELAAQMAKLAGNKGGFSSEDKGEWKLKLDNAGNGQAVIRFLPSKNDEQAPFALLVNHGFKKNGKWYIETCSSTYGDYDSCPVCQYISKNDLYNTDNKEYSLVKRKTSYWANILVVKDPAAPENEGKVFKYRFGKKIWDKINAMIAVDVEMGETPVDVTCPWEGANFVLKVKQVSGFSNYDESKFLNQSAIPNIDDESFQKELFEQMVDLSEMTSKDKFKSFEELSTKFSQVMGTAAMGGAAATAAKKADKVADDLDAFNVDDFKTKTEDDFMSSSSGSSSSADDTDLDDLLNDL

SEQ ID NO: 443 - protein, 76 aa, Unknown
  Description of Unknown: Bacteriophage F488/08
MAKVDIDIVDFEYIEEIIRNRYPELSITSIHDDPNYCNFSIVIEGPLEDLTRFMANEYCDGMDSEDAEFYMGLIEQ

SEQ ID NO: 444 - protein, 121 aa, Unknown
  Description of Unknown: Bacteriophage F488/08
MYIGKKYELVPRLIDTFINYRPRSNSSIVKIIQENGGWFEVKEAFFVDGFRVIKHIECANGKHFYFNVCEDEFHCFREYKEPTSEEDGAEDIVSGVTKIHCIVDENNVDEIIELLRKTFKK

SEQ ID NO: 445 - protein, 80 aa, Unknown
  Description of Unknown: Bacteriophage F488/08
MRLQRQSIKDSEVRGKWYFNIIGKDSELVEKAEHLLRDMGWEDECDGCPLYEDGESAGFWIYHSDVDQFKADWKIVKKSV

SEQ ID NO: 446 - protein, 110 aa, Unknown
  Description of Unknown: Bacteriophage F488/08
MSGIHVTGIAQVNIRCQFKTVPGVTHITLSHDPYSRGRQLTGVIKFFGGIGGSEFTIGDDEIVGCKLKVQKGVLELFSDEVFDEISRAVNKGMLTLIKMIKASGYVTDPF

SEQ ID NO: 447 - protein, 81 aa, Unknown
  Description of Unknown: Bacteriophage F488/08
MIFVFEFMNDEFDYAIFNALHNPDLSEFNEMFSDALSMSEEYCGECQRVCVTVFENKEKTYEELFFDANKATEWFVERGFA

SEQ ID NO: 448 - protein, 193 aa, Unknown
  Description of Unknown: Bacteriophage F488/08
MIKLVFAYSPTKTVEGFNELAFGLGDGLPWGRIKKDLQNFKARTEGTILIMGAKTFQSLSTLLPGRSHIVVCDLARDYPVTKDGDLAHFYITWEQYITYISGGEIQVSSPNAPFETMLGQNSKVSVIGGPALLYAALPYADEVVVSRIVKRHRVNSTVQLDASFLDDISKREMVETHWYKIDEVTTLTESVYK

SEQ ID NO: 449 - protein, 68 aa, Unknown
  Description of Unknown: Bacteriophage F488/08
MSNKLKVKDVPNAMALFICRQMHQGPMTPKQYLKGERSLGFTRKAKQMVKLGYKPNFAKYPSTYSWMN

SEQ ID NO: 450 - protein, 183 aa, Unknown
  Description of Unknown: Bacteriophage F488/08
MKQYQFLIKDILENGYETDDRTGTGTIALFGTKLRWDLTKGFPAVTTKKLAWNACISELLWFLSGSTNVNDLRLIQHNSLIQGKTVWDENYENQAKDLGYHSGELGPIYGKQWRDFGGVDQIIEVIDRIKKLPNDRRQIVSAWNPAELKQMALPPCHMFYQFNVRNGYLDLQWYQRSVDVFLG

SEQ ID NO: 451 - protein, 245 aa, Unknown
  Description of Unknown: Bacteriophage F488/08
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISEKMKGKKPSNIKKISCDGVIFDCAADAARHFKISSGLVTYRVKSDKWNWFYINA

SEQ ID NO: 452 - protein, 104 aa, Unknown
  Description of Unknown: Bacteriophage F488/08
MLPFNIASYATLVHIVAKMCNLIPGDLIFSGGNTHIYMNHVEQCKEILRREPKELCELVIGGLPYKFRYLSTKEQLEYILKLRPKDFVLKDYQSHGVLKGKMAV

SEQ ID NO: 453 - protein, 87 aa, Unknown
  Description of Unknown: Bacteriophage F488/08
MILRFKDTSGAVLFTLPNPSELEVPGPNQPIIIYGKKYYTHKMTREYFDNKISTVKTSSDCYYDITVLTEKQYDELSPRGPSMPGSE

SEQ ID NO: 454 - protein, 108 aa, Unknown
  Description of Unknown: Bacteriophage F488/08
MTNYHRAGRLCQVVNKYKSDFDVNIHRGTFWGNYVGKDAGSREAAIELFKKDFIRRIKSGEITKAHLEPLRGMRLGCTCKPKPCHGDIIAHIVNRLFKDDFQVEDLCN

SEQ ID NO: 455 - protein, 754 aa, Unknown
  Description of Unknown: Bacteriophage F488/08
MQLINVIKSSGVSQSFDPQKIIKVLSWAAEGTSVDPYELYENIKSYLRDGMTTDDIQTIVIKAAANSISVEEPDYQYVAARCLMFALRKHVYGQYEPRSFIDHISYCVNEGKYDPELLSKYSAEEITFLESKIKHERDMEFTYSGAMQLKEKYLVKDKTTGQIYETPQFAFMTIGMALHQDEPVDRLKHVIRFYEAVSTRQISLPTPIMAGCRTPTRQFSSCVVIEAGDSLKSINKASASIVEYISKRAGIGINVGMIRAEGSKIGMGEVRHTGVIPFWKHFQTAVKSCSQGGIRGGAATAYYPIWHLEVENLLVLKNNKGVEENRIRHMDYGVQLNDLMMERFGKNDYITLFSPHEMGGELYYSYFKDQDRFRELYEAAEKDPNIRKKRIKARELFELLMTERSGTARIYVQFIDNTNNYTPFIREKAPIRQSNLCCEIAIPTNDVNSPDAEIGLCTLSAFVLDNFDWQDQDKINELAEVQVRALDNLLDYQGYPVPEAEKAKKRRNLGVGVTNYAAWLASNFASYEDANDLTHELFERLQYGLIKASIKLAKEKGPCEYYSDTRWSRGELPIDWYNKKIDQIAAPKYVCDWSSLREDLKLFGIRNSTLSALMPCESSSQVSNSTNGIEPPRGPVSVKESKEGSFNQVVPNIEHNIDLYDYTWKLAKKGNKPYLTQVAIMLKWVCQSASANTYYDPQIFPKGKVPMSIMIDDLLYFWYFGGKNFYYHNTRDGSGTDDYEIETPKAEDCSSCKL

SEQ ID NO: 456 - protein, 392 aa, Unknown
  Description of Unknown: Bacteriophage F488/08
MSTVFNTNPVDVLKEPMFFGSGLGIARYDIQRHKVFEDLTEKQLSFFWRPEEVNLMMDAAQFNKLPQYQQNIFTNNLKYQSLLDSIQGRAPSAVLMSLISDPSLDTWVATWTFSETIHSRSYTHIMRNLYTDPSKVFDEIVLDEAIMKRAESIGRYYDDVLIKTRYWENAKADIEYQKEINADEDVIEDAIEHETYWKRELMKSLYLCLHVINALEAIRFYVSFACTFNFHKNMEIMEGNAKIMKFIARDEQLHLKGTQYIIRQLQLGTDGDEWVKIAQECEQEAVDIFMEVNRQEKDWAVHLFKDGDVPGLNTNSMWSFIDYLTVSRMKQCGLPCPITDAPVKHPYPWIREYLNSDNVQSAPQEVELSSYLVAQIDNDVDDKVMMSFKKYF

SEQ ID NO: 457 - protein, 136 aa, Unknown
  Description of Unknown: Bacteriophage F488/08
MKEIATEYSFIKYTELELDYNGSIKQLSIPNKYNVIYAIAINDELVYIGKTKNLRKRINYYRTAINRKDKTSDSTKSALIHAALKEGSKVEFYARQCFNLSMTNELGTMTIATIDLEEPLFIKLFNPPWNIQHKKK

SEQ ID NO: 458 - protein, 374 aa, Unknown
  Description of Unknown: Bacteriophage F488/08
MQELFNNLMELCKDSQRKFFYSDDVSASGRTYRIFSYNYASYSDWLLPDALECRGIMFEMDGEKPVRIASRPMEKFFNLNENPFTMNIDLNDVDYILTKEDGSLVSTYLDGDEILFKSKGSIKSEQALMANGILMNINHHRLRDRLKELAEDGFTANFEFVAPTNRIVLAYQEMKIILLNVRENETGEYISYDDIYKDAALRPYLVERYEIDSPKWVEEAKNAENIEGYVAVMKDGSHFKIKSDWYVSLHSTKSSLDNPEKLFKTIIDGASDDLKAMYADDEYSYRKIEAFETTYLKYLDRALFLVLDCHNKHCGKDRKTYAMEAQGVAKGAGMDHLFGIIMSLYQGYDSQEKVMCEIEQNFLKNYKKFIPEGY

SEQ ID NO: 459 - protein, 167 aa, Unknown
  Description of Unknown: Bacteriophage F488/08
MDLQLITTEMVVEAYGDTTDGISVFKGNRRVGYITDLKKDLAKQVKRKTTIKEYRNRRLEQARDMLPDAVEEMKVFLENQLAKYDCDVFINQTQPNVHINSCKCYIIVNPLTGKHRLGISNPNRSASDMAEDVEACFKISKSPAEHHILINGLSQDDIIEVIKTLCM

SEQ ID NO: 460 - protein, 117 aa, Unknown
  Description of Unknown: Bacteriophage F488/08
MHVSNFTAGLLLLVIAFGGTSIILKNKVERLETSVTEITKTANENALALNNLRIQYNYIDAMNNKNREAIAAIERENEKLRKDAKKADVVAHKPGLVEKQINNSFNKFAEDIQDLSK

SEQ ID NO: 461 - protein, 99 aa, Unknown
  Description of Unknown: Bacteriophage F488/08
MIKLSAVILSIGLLVGCSTKPLEVKKETVHPNWPVQIKSYDEAKLSWQVKVIDGKAWVGMPFEDSQEFRIWLNDVKRYVHDQKTMICYYRQELKEDKCK

SEQ ID NO: 462 - protein, 76 aa, Unknown
  Description of Unknown: Bacteriophage F488/08
MISWYQFEHLKGLIYESEMAAMIYGRQIQRLESLPPTNDVLLAQSRANLKNEYQNKWGKASKDLHDYIQSLVEKNK

SEQ ID NO: 463 - protein, 100 aa, Unknown
  Description of Unknown: Bacteriophage F488/08
MKTLLERYIECSDRYIDVCHDNASSISEDIEHAKALDDAGKALRKEAKARGFDMYQLKNHMIKFISSNVQSKSVNQSTAELYKGRREHNIRILEVFLGIK

SEQ ID NO: 464 - protein, 301 aa, Unknown
  Description of Unknown: Bacteriophage F488/08
MMKKIILTIGCPGSGKSTWAREFIAKNPGFYNINRDDYRQSIMAHEERDEYKYTKNKEGIVTYMQHDVANMILCQDATKGVIVSDTNLNPERRKVWEEFAKELGHQIEYKVFDVPWTELVKRNSKRGTKAVPIDVLRSMYKSMREYLGLPVYKGTPGKPKAVIFDVDGTLAKMNGRGPYDLEKCDIDIINPMVVELSKMYALMGYQIVVVSGRESGTEEDPTKYYRMTRKWVEDIAGVPLVMQCQREQGDTRKDDVVKEEIFWKHIAPHFDVKLAIDDRTQVVEMWRRIGVECWQVASGDF

SEQ ID NO: 465 - protein, 58 aa, Unknown
  Description of Unknown: Bacteriophage F488/08
LGFVIVNSGLVGTSNGQFCVFTSENRAWEECLKLREKNPDVELVVKKTKLPLPWKTYE

SEQ ID NO: 466 - protein, 66 aa, Unknown
  Description of Unknown: Bacteriophage F488/08
MNNLEKIYRLCDKIEKEKKYLFCLWPIVDGRVGLDVLDYETEDKVDGATFDNALDVIDWLEENYVR

SEQ ID NO: 467 - protein, 91 aa, Unknown
  Description of Unknown: Bacteriophage F488/08
MFPTYSKIVEVVFSQIIANNMFEKLDNAAELRIHAQVTHVLNALLPDQVDSIAITLYPGSAHIIVVFGLDAELVIKGDIRFESQTSEFKAI

SEQ ID NO: 468 - protein, 175 aa, Unknown
  Description of Unknown: Bacteriophage F488/08
MSEWFEEDKVYRFKAGYKDIFNETCGANKRIAQFIGENSFKVKIDPAKNVISIKREIDDCWYKAVDVMGESYKVSPLFSIAYMLEYSFFEEVQKDDSVSKFEIKTDKEIKWKVVGITGCMFYIYAQTDTKEEAKKKALEYLEEHEEGPVMITQDAELVSVKLVKNVESKELGSTC

SEQ ID NO: 469 - protein, 78 aa, Unknown
  Description of Unknown: Bacteriophage F488/08
MLSEKPITVKEFQEKVKLFAQELVNKVSERFPETSVRVITETPRSVLVIVNPGDGDQISHLKLDFDGLVEAQRVYGVL

SEQ ID NO: 470 - protein, 112 aa, Unknown
  Description of Unknown: Bacteriophage F488/08
MMNLTDIIDNCLENDTGDHRALDSETAQFIRITLMNDTLVNSIHPSVYDAIIVTKYPVELHKKMTGAVFIDKKNRFKDGQNITSSVIKSITKLRHEIYRVETAKSAYLVIMK

SEQ ID NO: 471 - protein, 193 aa, Unknown
  Description of Unknown: Bacteriophage F488/08
MKASTVLQIAYLVSQESKCCSWKVGAVIEKNGRIISTGYNGSPAGGVNCCDYAAEQGWLLNKPKHTIIQGHKPECVSFGSTDRFVLAKEHRSAHSEWSSKNEIHAELNAILFAARNGSSIEGATMYVTLSPCPDCAKAIAQSGIKKLVYCETYDKNKPGWDDILRNAGIEVFNVPKKNLNKLNWENINEFCGE

SEQ ID NO: 472 - protein, 78 aa, Unknown
  Description of Unknown: Bacteriophage F488/08
MKFRLVKLTAISSYSNENISFAVEYKKYFFSKWKQYYKTDWTSIDRPYSWKSDLEKCQKLLSTLKERGTTHIKTVIGK

SEQ ID NO: 473 - protein, 102 aa, Unknown
  Description of Unknown: Bacteriophage F488/08
MKLTTEQKVAIREILKTKLSMGISNVVFEKSDGTIRIMKCTRDADFMPTMQTGKLTESTRKESTDMIPVFDVELGAWRGFSIDKLISVNGMKVEHLLQFIGK

SEQ ID NO: 474 - protein, 111 aa, Unknown
  Description of Unknown: Bacteriophage F488/08
MSEVQQLPIRAVGEYVILVSEPAQAGDEEVTESGLIIGKRIQGEVPELCVVHSVGPDVPEGFCEVGDLTSLPVGQIRNVPHPFVALGLKQPKEIKQKFVTCHYKAIPCLYK

SEQ ID NO: 475 - protein, 82 aa, Unknown
  Description of Unknown: Bacteriophage F488/08
MIKQLQHALELQRNAWNNGHENYGASIDVEAEALEILRYFKHLNPAQTALAAELQEKDELKYAKPLASAARKAVRHFVVTLK

SEQ ID NO: 476 - protein, 72 aa, Unknown
  Description of Unknown: Bacteriophage F488/08
MPISPAFSFKREFIMAKQVKAKKAVEKKVGDSKRAGYKRGSNSRINQTVEKIMRRARAVLRDDASRFGKQKA

SEQ ID NO: 477 - protein, 121 aa, Unknown
  Description of Unknown: Bacteriophage F488/08
MNYINFERKYVSNGIAGSIDTICLWKHQNGSVCEIDQYMTPNYVYMRFENGITVSITKEGSNFKIALDDDFRERDLGTHPCWNGVHRKLLIKTWIRHILSNKAKPEHLEAIFDVVLNEFDI

SEQ ID NO: 478 - protein, 95 aa, Unknown
  Description of Unknown: Bacteriophage F488/08
MFMTTYFDTRKNFCEVVFSKAPKDLPAHLQPTSESIKNYVNVVCPLEFRTVNGRDTLAITKLNREIDIDPSIAREINSSDINGGNVKSHGFQMRF

SEQ ID NO: 479 - protein, 65 aa, Unknown
  Description of Unknown: Bacteriophage F488/08
MKFFLGQTVELKGVGIPGLISKVLPPFKWSGIQIKEAYIVSWVDGNEDLRMGDELSPIYGLKELV

SEQ ID NO: 480 - protein, 68 aa, Unknown
  Description of Unknown: Bacteriophage F488/08
MNIINKIFGIQYIKVTYKVTDKNPYTDEHEEPQVKSIILEKGSDWPVEFRLPNYGHWADVEIISIENV

SEQ ID NO: 481 - protein, 152 aa, Unknown
  Description of Unknown: Bacteriophage F488/08
MSELEIRSNFKWPSCALSNFAQWPFVMDGIQFGGLEGFLQGCKVKNVEQQRRIFGLSGLAAQQAGRSYARAQDRGTLFWLGVPFSRYSPAWKELYTNAYFEAAIQNKGFRDALHASKGKVLKHSMASGLTKDDTILTEAEFIDVLNLLRDSL

SEQ ID NO: 482 - protein, 279 aa, Unknown
  Description of Unknown: Bacteriophage F488/08
MKPTILTDIDGVCLSWQSGLPYFAQKYNLPLEHILKMIQDEKFISPGKLFNCDEELGVKLIEKYNRSDFIRYLSPYKDALCVINKLKEDYNFVAVTALGDSIDALLNRQFNLNALFPGAFSEVLMCGHDSSKEELFKKAKEKYNVICYIDDLAHHCDHASEILNVPVYWMARGERDSIPKTAQRVYTWNDVENKLFSPKENKESFDSEKAIKDVIEKMIKNDSFPWNTTWRTPGFNPYNHLYHPYQTHPFQTWNYIKPGGIEYLYNRPTSGDNIFQGAF

SEQ ID NO: 483 - protein, 89 aa, Unknown
  Description of Unknown: Bacteriophage F488/08
MFVVHTIYENEGNTTRDYGHVNQFFRCNPEFRAQKDERIFKKCVEQGFIYVKHWMQGNKVRTTYHRSLTELNDELIYNRAVNQTLKDEQ

SEQ ID NO: 484 - protein, 487 aa, Unknown
  Description of Unknown: Bacteriophage F488/08
MILKILNEIASIGSTKQKQAILEKNKDNELLKRVYRLTYSRGLQYYIKKWPKPGIATQSFGMLTLTDMLDFIEFTLATRKLTGNAAIEELTGYITDGKKDDVEVLRRVMMRDLECGASVSIANKVWPGLIPEQPQMLASSYDEKGINKNIKFPAFAQLKADGARCFAEVRGDELDDVRLLSRAGNEYLGLDLLKEELIKMTTEARQIHPEGVLIDGELVYHEQVEKEPEGLDFLFDAYPEISKAKEFAEVAESRTASNGIANKSLKGTISEKEAQCMKFQVWDYVPLVEIYGLPAFRLKYDVRFSKLEQMTSGYDKVILIENQVVNNLDEAKVIYKKYIDQGLEGIILKNTDGLWENARSKNLYKFKEVIDVDLKIVGIYPHRKDPTKAGGFILESECGKIKVNAGSGLKDKASVKSHELDRTRIMENQNYYIGKILECECNGWLKSDGRTDYVKLFLPIAIRLREDKTKANTFEDVFGDFHEVTGL

SEQ ID NO: 485 - protein, 62 aa, Unknown
  Description of Unknown: Bacteriophage F488/08
MKAYLETIVVAQKEGGDVSTSVSQVILEFVDAYAYNKFTETFDAYEKGPKFEIYRTLLPLDY

SEQ ID NO: 486 - protein, 697 aa, Unknown
  Description of Unknown: Bacteriophage F488/08
MELITELFDEDTTLPITNLNPKKKIPQIFSVHVDDAIEQPGFRLCTYTSGGDTNRDLKMGDKMMHIVPFTLTAKGSIAKLKGLGPSPINYINSVFTVAMQTMRQYKIDACMLRILKSKTAGQARQIQVIADRLIRSRSGGRYVLLKELWDYDKKYAYILIHRKNVSLEDIPGVPEISTELFTKVESKVGDVYINKDTGAQVTKNEAIAASIAQENDKRSDQAVIVKVKISRRAIAQSQSLESSRFESELFQKYESTAANFNKPATAPLIPEAEEMKIGINSLASKTKAAKIIAEGTADELHYDYKFFPMSQVGEVSEKIKEVIFNAIKNEPTTSIKCLEKYAAAANQLFEEYKDNWLDKHNKTRKGQPDEVWEEMTKNSWNAAKTKFLKRMIYSFSGIGAGPMIDITIARDGSKYTPSQKRGIREYCGSGYTDINNLLLGRYDPERYEVMSEKEIEAAITNLDSAFENGDRIPEGITVYRAQSMTAPIYEALVKNKVFYFRNFVSTSLTPIIFGRFGITHAGIGLLEPEARNELTVDKNEEGITINPNEIRAYKENPEYVKVQIGWAIDGAHKVNVVYPGSLGIATEAEVILPRGLMVKVNKITDASNNDGTTSNNTKLIQAEVMTTEELTESVIYDGDHLMETGELVAMTGDIEIEDRVDFASFVSSNVKQKVESSLGIIASCIDITNMPYKFVQG

SEQ ID NO: 487 - protein, 685 aa, Unknown
  Description of Unknown: Bacteriophage F488/08
MELITELFDGASAPVVNLNPKHKIPQIFAIQAGEESVLPGFRFCTYTSGGDTNKNVKPGDKMMHIVMIGVNEKLSLVKLRNLGGNPIGVINAVFDTALQTMKQYKIDACLFRVLKSKTNGAARQMQVIADRLVRTKGAGRYVLLKEIWGYDKKYAYIMVYRKNANLEDIPGVPPISTELFTKVESKVGDVYVDVKTGNAVPKAVAVAASIALENDKRTDQAVIQKTKISRRLAAQAQYSTVDASLQGDSFAAKKYQEFESKVPVYKAEGPMNSGVIQIGSNFSKGAIGGMRSASRFKSNDYELESFRNHIALAHARLRDPSIKLQSDITYQGSQEYLKNKEFFDYKTDKILSDLADINISNSFDVIKKIINDLVKGSKATPDEKTAIIQFVMNGIYKLINESAAQAYEYASTEVTPKGLTQAESDVIEDYCADSYVEMNSFLLGKPDSTREEYMERAIKHIETLDSAFAKGSVLPPGTTLYRGQEVTFKTLRHNIENKMFYFKNFVSTSLKPNIFGEHGKNYMALDDSGAVFSGEGEGSIDAEDLMHMGSHSTYVNEDAETSVGMVIKGAERIKVIVPGHLSGFPSEAEVILPRGILLKINKVSTYFMKETAYNKYLIEGTIVPPSEQLEESVYDGDHLMETGEVRPMTGFNQFLVEESKEEENEVSQILASLVNINGMSKKFKM

SEQ ID NO: 488 - protein, 96 aa, Unknown
  Description of Unknown: Bacteriophage F488/08
MKSSLRFLGQELVVEGVIPADNAFNEAVYNEFIKIFGTDKKFGIFPSENFSKPEQTESIFQGVVTGKFESEAPVKIEVYIEDSLVASVAAFISFRK

SEQ ID NO: 489 - protein, 321 aa, Unknown
  Description of Unknown: Bacteriophage F488/08
MYSLEEFNNQAINADFQRNNMFSCVFATTPSTKSSSLISSISNFSYNNLGLNSDWLGLTQGDINQGITTLITAGTQKLIRKSGVSKYLIGAMSQRTVQSLLGSFTVGTYLIDFFNMAYNSSGLMIYSVKMPENRLSYETDWNYNSPNIRITGRELDPLVISFRMDSEACNYRAMQDWVNSVQDPVTGLRALPQDVEADIQVNLHSRNGLPHTAVMFTGCIPISVSAPELSYDGDNQITTFDVTFAYRVMQAGAVDRQAALEWLESAAINGIQSVLGNSGGVTGLSNSLSRLSRLGGTAGSISNINTMTGIVNSQSKILGAI

SEQ ID NO: 490 - protein, 364 aa, Unknown
  Description of Unknown: Bacteriophage F488/08
MAIVKEITADLIKKSGEKISAGQSTKSEVATKTYTAQFPTGRASGNDTTGDFQVTDLYKNGLLFTAYNMSSRDSGSLRTMRSNYSSSSSSILRTARNTISNTVSKLSNGLISDNNSGTISKVPVANILLPRSKSDVDTSSHRFNDVQDSLITKGGGTATGVLSNMASTAVFGALESITQGIMADNNEQIYTTARSMYGGAENRTKVFTWDLTPRSTEDLMAIINIYQYFNYFSYGETGKSQYAAEIKGYLDEWYRSTFIEPLTPEDAVKNKTLFEKMTSSLTNVLVVSNPTIWMVKNFGATSKFDGKTEIFGPCQIQSIRFDKTPNGNFNGLAIAPNLPSTFTLEITMREIITLNRASLYAGTF

SEQ ID NO: 491 - protein, 590 aa, Unknown
  Description of Unknown: Bacteriophage F488/08
MKKPQEMQTMRRKVISDNKPTQEAAKSASNTLSGLNDISTKLDDAQAASELIAQTVEEKSNEIIGAIDNVESAVSDTTAGSELIAETVEIGNNINKEIGESLGSKLDKLTSLLEQKIQTAGIQQTGTSLATVESAIPVKVVEDDTAESVGPLLPAPEAVNNDPDADFFPTPQPVEPKQESPEEKQKKEAFNLKLSQALDKLTKTVDFGFKKSISISDKISSMLFKYTVSAAIEAAKMTAMILAVVVGIDLLMVHFKYWSDKFSQAWDLFSTNFTKFSSETGTWGPLLQSIFGSIDKIKKLWEAGDWGGLTVAIVEGLGKVLFNLGELIQLGMAKLSAAILRVIPGMKDTADEVEGRALENFQNTTNASLSKEDQEKVANYQYKRMNDDLGPIAKGLDKIANWKTRASNWIRGVDNKEALTTDEERAEEEEKLKQLSPEEAKIALMKANEARAAMNRFDEYANSADMSKDSTVKSVEAAYEDLKKRMDDPDLNNSPAVKKELAARFSKIDATYQELKKNQPNAKPQTSAKSPEAKQVQVIEKNKAQQAPIQQASPSINNTNNVIKKNTVVHNMTPVTSTTAPGVFDATGVN

SEQ ID NO: 492 - protein, 177 aa, Unknown
  Description of Unknown: Bacteriophage F488/08
MNLKLILPLKKVVLPISNKEVSIPKMGLKHYNILKDVKGPDENLKLLIDSICPNLSPAEVDFVSIHLLEFNGKIKSRKEIDGYTYDINDVYVCQRLEFQYQGNTFYFRPPGKFEQFLTVSDMLSKCLLKVNDEVKEINFLEMPAFVLKWANDIFTTLAIPGPNGPITGIGNIIGLFE

SEQ ID NO: 493 - protein, 390 aa, Unknown
  Description of Unknown: Bacteriophage F488/08
MSMLQRPGYPNLSVKLFESYDAWSNNRFVELAATITTLTMRDSLYGRNEGMLQFYDSKNIHTKMDGNEIIQISVANANDINNVKTRIYGCKHFSVSVDSKGDNIIAIELGTIHSIENLKFGRPFFPDAGESIKEMLGVIYQDRTLLTPAINAINAYVPDIPWTSTFENYLSYVREVALAVGSDKFVFVWQDIMGVNMMDYDMMINQEPYPMIVGEPTLIGQFVQELKYPLAYDFVWLTKSNPHKRDPMKNATIYAHSFLDSSLPMITTGKGENSIVVSRSGAYSEMTYRNGYEEAIRLQTMAQYDGYAKCSTVGNFNLTPGVKIIFNDSKNQFKTEFYVDEVIHELSNNNSVTHLYMFTNATKLETIDPVKVKNEFKTDTTTEESSSSDK

SEQ ID NO: 494 - protein, 250 aa, Unknown
  Description of Unknown: Bacteriophage F488/08
MANIIRCKLPDGVHRFKPFTVEDYRDFLLVRNDIEHRSPQEQKEIITDLIDDYFGDYPKTWQPFIFLQVFVGSIGKTKVPVTFVCPKCKKEKTVPFEIYQKELKEPVFDVANVKIKLKFPSEFYENKAKMITENIHSVQVDEIWYDWKEISESSQIELVDAIEIETLEKILDAMNPINLTLHMSCCDKYIKKYTDIVDVFKLLVNPDEIFTFYQINHTLVKSNYSLNSIMKMIPAERGFVLKLIEKDKHQ

SEQ ID NO: 495 - protein, 208 aa, Unknown
  Description of Unknown: Bacteriophage F488/08
MYEYKFDVRVGSKIINCRAFTLKEYLELITAKNNGSVEVIVKKLIKDCTNAKDLNRQESELLLIHLWAHSLGEVNHENSWKCTCGTEIPTHINLLHTQIDAPEDLWYTLGDIKIKFRYPKIFDDKNIAHMIVSCIETIHANGESIPVEDLNEKELEDLYSIITESDIVAIKDMLLKPTVYLAVPIKCPECGKTHAHVIRGLKEFFELL

SEQ ID NO: 496 - protein, 132 aa, Unknown
  Description of Unknown: Bacteriophage F488/08
MANINKLYSDIDPEMKMDWNKDVSRSLGLRSIKNSLLGIITTRKGSRPFDPEFGCDLSDQLFENMTPLTADTVERNIESAVRNYEPRIDKLAVNVIPVYDDYTLIVEIRFSVIDNPDDIEQIKLQLASSNRV

SEQ ID NO: 497 - protein, 137 aa, Unknown
  Description of Unknown: Bacteriophage F488/08
MRLEDLQEELKKDVFIDSTKLQYEAANNVMLYSKWLNKHSSIKKEMLRIEAQKKVALKAKLDYYSGRGDGDEFSMDRYEKSEMKTVLSADKDVLKVDTSLQYWGILLDFCSGALDAIKSRGFAIKHIQDMRAFEAGK

SEQ ID NO: 498 - protein, 74 aa, Unknown
  Description of Unknown: Bacteriophage F488/08
MRYNIDDAFNYEEEFETEIQFLMKKHNLKRQDIRILADHPCGEDVLYIKGKFAGYLDEYFYSKDMGIDMHMRVV

SEQ ID NO: 499 - protein, 55 aa, Unknown
  Description of Unknown: Bacteriophage F488/08
MSDKICVVCKTPIDSALVVETDKGPVHPGPCYNYIKELPVSESSEEQLNETQLLL

SEQ ID NO: 500 - protein, 76 aa, Unknown
  Description of Unknown: Bacteriophage F488/08
MLLEFKQFLYEASIDEFMGKIASCQTLEGLEELEAYYKKRVKETELKDTDDISVRDALAGKRAELEDSDDEVEESF

SEQ ID NO: 501 - protein, 503 aa, Unknown
  Description of Unknown: Bacteriophage F488/08
MTDIKVHFYDFSHVRIDCEESTFHELRDFFSFEADGYRFNPKYKYGHWDGRIRLLDYNRLLPFGLVGQIKKFCDNFGYKAWIDPQINEKEELSRKDFDEWLSKLEIYSGNKRIEPHWYQKDAVFEGLVNRRRILNLPTSAGKSLIQALLARYYLENYEGKILIIVPTTALTTQMADDFVDYRLFSHAMIKKIGGGASKDDKYKNDAPVVVGTWQTVVKQPKEWFSQFGMMMNDECHLATGKSISSIISGLNNCMFKFGLSGSLRDGKANIMQYVGMFGEIFKPVTTSKLMEDGQVTELKINSIFLRYPDEFTTKLKGKTYQEEIKIITGLSKRNKWIAKLAIKLAQKDENAFVMFKHVSHGKAIFDLIKNEYDKVYYVSGEVDTETRNIMKTLAENGKGIIIVASYGVFSTGISVKNLHHVVLAHGVKSKIIVLQTIGRVLRKHGSKTIATVWDLIDDCGVKPKSANTKKKYVHLNYLLKHGIDRIQRYADEKFNYVMKTVNL

SEQ ID NO: 502 - protein, 226 aa, Unknown
  Description of Unknown: Bacteriophage F488/08
MIDKDYIAELKALDDNKEAKAKLAEYAEQFGIKVKKNKSFDNIVNDIEEALQKLASEPMPETDGLSIKDLIDAADAAEGLKYDDEEVNPEAALLIDSPVKSDIKIEVVETDKIPENTDVLIEDTPFVEEKFEQAVAEIIESEKPSVFTLPENFSPNLQLIGKNPGFCTVPWWIYQWIAETPDWKSHPTSFEHASAHQTLFSLIYYINRDGSVLIRETRNSSFVTLK

SEQ ID NO: 503 - protein, 472 aa, Unknown
  Description of Unknown: Bacteriophage F488/08
MTFTVDITPKTPTGVIDETKQFTATPSGETGGGTITYAWTVDDAPQEETSATFSYVLKGPAGQKTIKVVATNQVAESEPETAEISTTITVQNKTQTTTLAVTPGSPDAGVIGTPIEFTAALASQPSGANATYQWYVDGSPVGEATSTTFNYTPDASGVKTIKCVAQVTATDYDTKEVTSNEVSLTVNKKTQTTTLAVTPDSPPAGVIGTPVQFTAALASQPDGASATYQWYVDDSQVGGETNSTFSYTPTTSGVKRIKCVAQVTAENYNEKEVTSNEVSLTVNKKTMNPQVTLTPPSINVQQDASATFTANVTGAPEEAQITYSWKKDSSPVEGSTNVYTVDTSSVGSQTIEVTAVVTATDYDSKTITAEGQVQVTDKVAPEPEGELPYVHPLPHRTSAYIWCGWWVMDEIQKMTEEGKDWKTDDPDSKYYLHRYTLQKMMKDYPEVDVQESRNGYIIHKTALETGIIYTYP

SEQ ID NO: 504 - protein, 67 aa, Unknown
  Description of Unknown: Bacteriophage F488/08
MRTEVVVFTLHESGKSFIEIARELNLQAKEVAVLWARAMTAKNKFETREKVVYRKRHINKKVKNGTV

SEQ ID NO: 505 - protein, 92 aa, Unknown
  Description of Unknown: Bacteriophage F488/08
MEQYDLYENESFANQLREKALKSKQFKLECFIKDFSELANKAAEQGKTHFSYYCIARDKLITEEIGDWLRKEGFSFKVNSDQRDGDWLEITF

SEQ ID NO: 506 - protein, 334 aa, Unknown
  Description of Unknown: Bacteriophage F488/08
MFKKYSSLENHYNSKFIEKLYSLGLTGGEWVAREKIHGTNFSLIIERDKVTCAKRTGPILPAEDFFGYEIILKNYEDSIKAVQDIMETSAVVSYQVFGEFAGPGIQKNVDYGDKDFYVFDIIVTTESGDVTYVDDYMMESFCNTFKFKMAPLLGRGKFEELIKLPNDLDSVVQDYNFTVDHAGLVDANKCVWKAEAKGEVFTAEGYVLKPCYPSWLHNGNRVAIKCKNSKFSEKKKSDKPIKAKVELSEADNKLVGILACYVTLNRVNNVISKIGEIGPKDFGKVMGLTVQDILEETSREGITLTQADNPSLVKKELVKMVQDVLRPAWIELVS

SEQ ID NO: 507 - protein, 40 aa, Unknown
  Description of Unknown: Bacteriophage F510/08
LLNEAVASKVLNSRLGWSAVGEYVELFNRTQSRVAGLIPE

SEQ ID NO: 508 - protein, 69 aa, Unknown
  Description of Unknown: Bacteriophage F510/08
MLSRQDRGERAWHQQDAAWQRQIATWAAQDHRHYAAPWRKRQASQEYAVALTKHREALERSRHYGQPKG

SEQ ID NO: 509 - protein, 117 aa, Unknown
  Description of Unknown: Bacteriophage F510/08
VGSRSVEFALSSRNNASTGSLETGLTHCQGIGRVRSQNDGRLQPSKRGTSHRRKGHGKLLGQEPQCVRPAGITEGIDTVQDTRYSSHHLMATQQKGLCQRTGRTNPRQRIDKTSASL

SEQ ID NO: 510 - protein, 94 aa, Unknown
  Description of Unknown: Bacteriophage F510/08
MAHFKAKAPKSPFAAQVAYWRDWEAKRTKLIAQDNVEGRKELRKMRDVRYATDPEPAPGRYHNPEQKAFVKGSEGKARNILKGWNAKKSQGKGL

SEQ ID NO: 511 - protein, 75 aa, Unknown
  Description of Unknown: Bacteriophage F510/08
MPRVNELTPRQRKAAKARRDKARRIDLAHRMPKGADCPIFRKAEQAQAKQPRVDTLTTPRSAGYLAAAAYLNKSI

SEQ ID NO: 512 - protein, 179 aa, Unknown
  Description of Unknown: Bacteriophage F510/08
MTNAISKTVIAFRGTEEINRAIDAIRVRGKELDEAIQLTGLSIIHHIDQCGDVTVVKALYEAMPKGSRRNALVEWLVLHGKVQVNTDKKSNKDLPFLYNKFGKTDLVGATNSPWYSFKPEKALDQEFNLAAALATIKKQVLQAQTKGKVIVGMELLGDLEALAAKAAPIAEQSKRAAAH

SEQ ID NO: 513 - protein, 122 aa, Unknown
  Description of Unknown: Bacteriophage F510/08
MQALNTLLIAIPKDPTAGMHAADKVLCAHGFRMGDLNTAHVLTPGGFVVVGAGVTVNRYDEAYRMSRNLDSEGFDVLLVQGSPLSGRVTCQAYGWINAEYHKGCANGRPIFDIAGTSYHVIA

SEQ ID NO: 514 - protein, 74 aa, Unknown
  Description of Unknown: Bacteriophage F510/08
MSSRDPYRIGHRVGLVNYSDRYLGADAAGTKGIIEAITRPSRCMTVYHVRCERTLRLIEAEARNVRFIRQRAER

SEQ ID NO: 515 - protein, 86 aa, Unknown
  Description of Unknown: Bacteriophage F510/08
MTLVATVVDSAHNLEVDDLTAGNLYAASSPSGNMFIVVVGNHNGRRLPVVLSSTDTRTIGDVISNTGFRYSEIAGFSVNLAQGDYD

SEQ ID NO: 516 - protein, 96 aa, Unknown
  Description of Unknown: Bacteriophage F510/08
MVTRTVYVTPEDPTPPILSVGRLAPGELYKVVAPSSAEGIIVLATKQTPALAQAAVVLHSMNPAQYPAGSAILNTAWKCRRLGVGEYVKLVQGEED

SEQ ID NO: 517 - protein, 79 aa, Unknown
  Description of Unknown: Bacteriophage F510/08
MAVAILILAVWLIGGALLFLPFDLVVSPRLPLSDEALNRTALYTVLWPVTLPTLIAITVVVMLHSAYRGAIELYQEMKS

SEQ ID NO: 518 - protein, 97 aa, Unknown
  Description of Unknown: Bacteriophage F510/08
MIRTHTHNVERTPHRLYRHTELASGELYRVVQPDSKRGTLVVGVAAWDSQGRPAVLPVVIHDDGDAKVTCARPTVLRNDGWRMVLADKGTQVTLTAE

SEQ ID NO: 519 - protein, 138 aa, Unknown
  Description of Unknown: Bacteriophage F510/08
MTNVNTTTETTTAAVLGAKLIKKPATVEDFRNNVVFHHSALTKLTEVYNEAVAALQTAERLSSLVAGDVITFDHGKGEKAEVLSGEVISVVAGVYQVLVRFSDSAPAKLLDVKASAIRAVQSSAAQAATLDEAIAQGE

SEQ ID NO: 520 - protein, 119 aa, Unknown
  Description of Unknown: Bacteriophage F510/08
MSKRNPEHINGTVRSVSVQKLAATQELEDRLEAALAVCQQRAEDIDLLSRRLQAAERARRWEIDEIRNHQATIRLLQNDLNAAHDAHEAQERRARKATIMAWVCLLTAGLAVTLKLAGV

SEQ ID NO: 521 - protein, 269 aa, Unknown
  Description of Unknown: Bacteriophage F510/08
MQCKDLYTNLASGMFNVPCSQVTPEMRRVAKSRAFAHAYTPKKQASGGTYTARVSGVTCDGGKVEVRLDNVERVSTFDYAELETRVAASLCQADAKRAAEYEKLLLKAFPSVSPKDGPLSAKDFELRLHDLCSTKLVVLRALRDAGIEMDGPLRSRVRKLADRNNVMGAELFSLKQELAQLVAVGQKAGLNWDGAETQRLLTVAPTKALCRLISALTGVRYTHHTVVAKAEAEARERAKAEAKDSLQAATFAAAIAGGVVGSALMFLLG

SEQ ID NO: 522 - protein, 180 aa, Unknown
  Description of Unknown: Bacteriophage F510/08
MSKTSLYPLNLHPGLIQIRTIHVFSIQAPSNAENWWQWFLWQRKYHPLRESLSPAGELSASIAECVLHLRRNGWQDSDIWRKKGGVLALGAFDLSGLMVGSCLVVGGELKALCVDDRHSRQGIGAELVRAAELAGAEYLTCFEFLEPFYADLGWSTTHREANWTAGEPDVLHMRAPGHDV

SEQ ID NO: 523 - protein, 274 aa, Unknown
  Description of Unknown: Bacteriophage F510/08
MALRRDSWLKQAQSLAVGQAGRFRHVLGCQSMSRGGTNMTCKNLPDRWVAYCYSCQEGGVVEKTHVRRVQCADQERFMPWPEDASDWTQADCYQSLYGLLLSKGIDYNVMTPGLPLLYSERQHRLIFPTDAGWIGRATADQNPKWVGYGYPAPDYHGWPQELSMGRPWVLTEDYLSALKVRWACPEVFAVGLNGTRLRDRLAAIMLQQTCKRAFIFLDGDRAGVRGSAGVMRRLRSLLIEGQVIPTPDGFDPKDLTREQIRSLVIGRIDASRTE

SEQ ID NO: 524 - protein, 422 aa, Unknown
  Description of Unknown: Bacteriophage F510/08
LDVLTLHALSDRDRFRTLRSVVPEGMMGPETCFVIDWIEQYWKVYPAHQKVDPQALRELIKLRGGYQPEQLAVVLNLVNQLDKPVDPDSLQGVVSQLNELDFSGRVDALLAQYNQGEDIDLAYELRRLSDEALRRGGVSTPTDYVTDDVFDILAEEQGDHGIKLPGLVLPAYMKGLHAGASVLVAAPPDAGKTSFMAWIAVHIAPQLKRYFDPGRPILWLNNEGKGRRIKPRLYSAALGMTVGEILALDPEEVRRMYAEKIGGDSELIRIKDFHGGSLAQAEQVIDAMKPSVVFWDMMAHVKGGQRKDQNRTDEMEYKVAEVREMAVRHDFISFMTWQISNDGHDQLFPPQSCLKDSKTAVQGAVDVQIHLGRLNGADQQVMRGLSLPKNKFQMDGKPSNVEAMINFDAARCRFFESVDHAS

SEQ ID NO: 525 - protein, 206 aa, Unknown
  Description of Unknown: Bacteriophage F510/08
MQAKHSRVLEGTKEIPLGSIEPLLGSVAGLLLCLYSDATHEEGVALAGGFPRDLMHGATPKDVDVALYSMTWGRAEHLIQKALPVLNPIFVRDGGWRSDYADGGDGGIFKGVMSLVGCRGLNGMDLDFNYYDADSLGRVMESFDFTINQVGIAYNWPDPEGGPRLGAYLHKDVTWGVNKEVGAGSRLPERCEKMRAKAAYYGWENV

SEQ ID NO: 526 - protein, 315 aa, Unknown
  Description of Unknown: Bacteriophage F510/08
MSKRDVVLDIEKGIWRGVDQNDKAVEAIIKKNGYVIVEPKIDGCRAIVGAHGVVSRSGRRFPALDGLEDRIIERLARPGLDSGLVLDCEMYLAGMPFSEATGRMSSKTPLTEEELECLHFAVFDATHIDVLRKARTSHLVYEERRAMASSLLAACRLSDTPTFFQVGFTVCRRMSDVYRQYKFNREVGYEGSMEKDPSLVYRNGKVAGCYKRKPGITVDGRIVGYVMGKTGKNVGRVVGYRVELEDGSGTVAATGLSEEHIQLLTYAHLNAHIDEAMPNYGRIVEVSAMERSANTLRHPSFSRFRDLASNPGVKV

SEQ ID NO: 527 - protein, 94 aa, Unknown
  Description of Unknown: Bacteriophage F510/08
MKIRKSRNRNYPEDMVYHATNRDSLLYPKYVMGSVFISQDGTFRICVMAGTWDHVGSEVLHHARDIQSLGAGRRKLHRVMRRLRRNLQQVGVKV

SEQ ID NO: 528 - protein, 111 aa, Unknown
  Description of Unknown: Bacteriophage F510/08
MRMPTEEERTIRCLLADIHEPLNLLFPGIRVKAETMPLGWGDSICALVLRVSYEHLTLGRLEYMHEVPILHLSQWGRDGLLQHLMNEIPRRVLDGMLRQAQKYSQSNWYSK

SEQ ID NO: 529 - protein, 807 aa, Unknown
  Description of Unknown: Bacteriophage F510/08
MTTIRILDLETESYEHKGRKASPFDPRNYIVMAGWRDDVDGKVGQKVEHRFRSRAEAEDPNNRWFNLDGVDVIVAHNAMFESNWFFTRYRDEYLAFLRRGGRVWCTQQAEYLLSHQTWLYPALDELAPKYGGTHKVDGIKMLWDQGVLTSEMDQDLLSEYLSGPCGDIENTALVFYGQLMKLQARGMWAGYLERCEALIGFSAMECAGLKVDLEVAKVNHAKQLEEVAGIEAELKKLMPDFPEYFEFKYTSLYHMSAWLYGGEVRYKGRVPYEDGRMEKADFVRFGTAKRGTPIESTSVRVPIHEVTDQGEWHWPTITELATKHGPVITFSAGKNKGSVKVFREDTDIPATKWDDDQRFRFPGLINLTNLPEVVREKFLGKRPEFQCALTLADGSPVFSTSGDALKALEKQGFEAAKLLMRLAELHKDNSSFYITHTYNKDGTIKDTKGMLQYVDDDGIIHHSLNTTATATTRLSSSRPNLQQLPSKDEDDPEAGSRVKEMFVSRFGADGMIGETDYTALEVVMLAALSKDRNLLAKLMAGTDMHLYRLAGKHNNWNGFDYDQLVAIKKDPNHPWHGRMMQARKNIKPKAFSAQYGASAAGIAFNTGCTVEEAQEFLDNEAALFPESIAFRQIVRDSAEATSLVMYKAEDQMPAGAFSEMGPDGNWRQYRRGFWQAPGGTCYSFRQQERWDKEQRKTVMDFKDTQIANYWNQGEAGFMMTVSVGRIFRWMLHRPGFMVTEFLINNVHDAVYTDCHKDTAAEVNKGVRDIMADAARYMSERLGYDIADVPFPAVAEMGPNMFNMEVIQ

SEQ ID NO: 530 - protein, 103 aa, Unknown
  Description of Unknown: Bacteriophage F510/08
VKELHPLHTPEFVKTFLDQTGCLPGVRRTGRTTGIALQAIGMALSHPRETLTFVDHPDGSAAALVASIETILATLGYKNVLVRPTTRADGRSVSIVFKTLPNA

SEQ ID NO: 531 - protein, 349 aa, Unknown
  Description of Unknown: Bacteriophage F510/08
MTQQLNALQAALALANKAAETATIDMSETSTGGGGGRIFPAGTAMGRFCIYIELGDHAKEFQGKLKNPAPQIRLGFALWGDVNPQAGNPQSRPDDLFHTYEADGSIKPGLFRTFEMTLGNNEKSKTKLAFDKMNWSGQHTHFAQMLGQAFIIPIKRTKITKGNNAGKERNDIDWGGIMKPYNPVDGSPYNVPELPMDLLQYFFFDAPTKETWDALYIEGTSDNGKSKNFLQETIRSATNFPGSALHIMLGGGDDLIIKPTSQAAGSNLPAVPNVAADAGVAAAPAVPAVPQAVAQTAPSVPQVANVAAPVVGTAEAQNVLPDVPQVAQTAAPAAVEVPAVPVVPAVPQV

SEQ ID NO: 532 - protein, 313 aa, Unknown
  Description of Unknown: Bacteriophage F510/08
MRLPSEEFLAGLSAQFDRSMAGGTLVCDADGPAYVAAATAKTLDTALRRFWKLILEQQFLAHCTGTRVHLTAAGGAKAYRDTYPTMKPYQGQRKGKAKPALLEPLRRAVADVHERGGAPEGIDVILHTFFEADDGMMMDAYAMQDKAIIRSDDKDLRMTIYPYWEIDTACVSRIEGGFGYLKEAYTPSGQFKLKGHGRKFFLAQWLGGDTADNIRGIDRFNGKLCGMKTAFDILHPITDEDEAIDMILEAYAKIKQNPLAEAEVLWMRRTPTDNAAQYLLSRDLRPAFRQWIIELDAYHEALLQKRRESDYDE

SEQ ID NO: 533 - protein, 146 aa, Unknown
  Description of Unknown: Bacteriophage F510/08
MTSEPKVYQIPRSQQRTFTLKLWAEQNKLCPLCGKPIDISVKGEAVMDHDHETGLVRGVLHRSCNTAEGKITNAAGSWGCKSMKYSDIIPYLRALLTYLEGPKHPLIYPLHKTDEEKHEAKLAKRRQAAAKRKAAMAVAKHNARNV

SEQ ID NO: 534 - protein, 348 aa, Unknown
  Description of Unknown: Bacteriophage F510/08
MSKLRKQFTNEYLRNVYVELGLKKGAEHLTEHSRFGEVSRQCFRNWCIKLGFHDSRTRGMYAKKGAMHWLGRKAAEVVRKFPGAVGNVVGQGPKVLSLDIETSPIEGWVWSLWKQNVGLNQIKRDWTILSFCAKWMHSDEVIYMDCQGDPLDDMHLLVALHKLLDEADIIIVQNGKRFDVPKINARFFLNKMPPPRPFKVIDTLIIAKQQFAFTSRKLEYMTHKACTIKKRLHGKFPGFDLWAACLQDNPEAWEEMRLYNIDDVRSMEELYILMRPWFVGHPNVAVYFNDAEPTIRCPKCGDTDVKQEGWVHTQTGKYEHYHCGGCGGWSRGRYTRNTSEQRKALLSN

SEQ ID NO: 535 - protein, 123 aa, Unknown
  Description of Unknown: Bacteriophage F510/08
MSLAFPDSYESTITTEPYRKGASLEERKVGKLPMHLVVEGFPLLKRELARMMQWAAEVKGYLPHDWKKMTVGEFKSAQHRHESKRLIDGPLDDESNLMHLVHEAFNAMAAAEVALMDREKGNE

SEQ ID NO: 536 - protein, 116 aa, Unknown
  Description of Unknown: Bacteriophage F510/08
MSKICWCTRPHETDEGVRVIWAFNERGIGVNYVTAYITPAMVSHRDWSDVILPDILREMAERLEREVKLVELRWFRAEILSCGEWRDYRAMTLEGAVSLAEAEWGPEDIGRVIERR

SEQ ID NO: 537 - protein, 816 aa, Unknown
  Description of Unknown: Bacteriophage F510/08
MDLIQQQIAHEEALVGAAQNDARIALEKAIAQGSIDRIPRARIMLMRMLPIVTEAIFAHQEAKAAGPAAKLRHLLRIIDAQDLAVMALRAGLSMLINYPTITATKYYTHMGKILCREIEVRLAFKVNQPYYDRTLDYLKTSRTRSVRHIQKTMDALLDAVLPEEARIDLPDGDYLRLGKFIGDPLIQCGLFEPNRFTGRGGTSVHLEPSPEAKEFLQDPSAAMTWGGPGRSVMLAPPRPWNDWCDGGYYSAKAQKHHVLVRRTKHQTKRARQMQLRHLGRDKMPRVYEAVNALQSVAYEINHDVYEIIERVFTSGGGVLGIPQRTYPDKPEFPLGDEWAKENASEQELEAFNRWKRSVHRWYTGEREHTAKLREFAALYRVVREHHGKAVYFPMHVDSRGRMYYWGTPNPQGSDIAKACLRFHEKRALGKRGLYWLKVHVANSLGCDKVYFDDRAAWVDERWDDFQRALDEGPENYPNLFPEDESPLCAIAGLLELRAAYASGNPEGYASGFIVHMDATCSGLQHYSAILRDEIGGAYVNLLPPGLAKADIYSRVLGLVNESLERDRAEGADGEARGYAILWDKAGLTRSLTKKPCMTLVYGTTFKGVVDHCLDYLDESGVEIPEGVPSYRLGSYMATLILDAIRETVPSAVFAMEWLQRLARALPDASKDLHWTTPLGMQVFQSYPKTEEVRVRLRAEAVEYVTLYEAKDELDPVRNANGIAPNFVHGLDSSHLGLTALACAAEGIPIQAIHDSMGTYAADVDRMHVHIREQFIAMYSGPCVLVELAKQLGIEATPPRRGSLNLEAVRDSWAFFC

SEQ ID NO: 538 - protein, 83 aa, Unknown
  Description of Unknown: Bacteriophage F510/08
MATMKTHRPTVMSPTVEGSRTGKGTARPVTFTSQQIEWLEQTFPEHQIGPGTTMEDIQFQAGRRDVVRAVRLRRRDAIAVELK

SEQ ID NO: 539 - protein, 157 aa, Unknown
  Description of Unknown: Bacteriophage F510/08
MNKSIWRVHAKAGTPSELQGLCWLAIQELEEFTLFRSKDDALNAMLDSIEGNDRTELLVFRDGQLAGGACIVFEDDPHVGPCVTAQWQYVLPRYRNTGVVREFIRELHRQAGWGQIPLVCWSHRESDSRYTIHYRRAKPYGQESKEGAGQDHHRQTR

SEQ ID NO: 540 - protein, 98 aa, Unknown
  Description of Unknown: Bacteriophage F510/08
MGKKVKKVLGKTIIGKLADGLLGTDLSGAQSDARKMEEQNRLMQQQADQLARNQQVDLTAENVAQVDLGAMADATGTGTRRRRNQAGTGVSQTLGINY

SEQ ID NO: 541 - protein, 510 aa, Unknown
  Description of Unknown: Bacteriophage F510/08
MKTTAAMLWEKLRDGSVESRAIEFAKTTLPYLMVDPMSGSRGVVEHDFQSAGALLVNNLAAKLARSLFPTGIPFFRSELTDAIRREADSRDTDITEVTAALARVDRKATQRLFQNASLAVLTQVIKLLIVTGNALLYRDSAAATVVAWSLRSYAVRRDATGRWMDIVLKQRYKSKDLDEEYKQDLMRAGRNLSGSGSVDLYTHVQRKKGTAMEYAELYHEIDGVRVGKEGRWPIHLCPYIVPTWNLAPGEHYGRGHVEDYIGDFAKLSLLSEKLGLYELESLEVLNLVDEAKGAVVDDYQDAEMGDYVPGGAEAVRAYERGDYNKMAAIQQSLQAVVVRLNQAFMYGANQRDAERVTAEEVRITAEEAENTLGGTYSLLAENLQSPLAYVCLSEVDDALLQGLITKQHKPAIETGLPALSRSAAVQSMLNASQVIAGLAPIAQLDPRISLPKMMDTIWAAFSVDTSQFYKSADELEAEAEQQRQQAAQAQAAQETLLEGASDMTNALAGV

SEQ ID NO: 542 - protein, 322 aa, Unknown
  Description of Unknown: Bacteriophage F510/08
MTQPNDQQLPPGLANLVANVPPAAAPTPSHVQVLPNPVIQPQAPVQPGQVGAPQQLAIPTQQPQPVPTSAMTPHYQPVAVPVAGQPVVPQAPAQPAPVAPPAAGAVLPENLEVPPPPAFTPNGEIVGTLAGNLEGDPQLAPSISYLEAFSDKLDTVRAFGKAAENRDPRFIDEHYLKEVLGPAQAQHVINVAKGVLTYVDAQTKAVLNQTYAAVGGEAVLKQAAGVFNQHADPATKAAIGRLMDSGDAQAMQYAAKQIVAFAQGSGAVVQATGQPLGAAAPALAALSAEQYRLEVSKLPLNASEAEMAALRERRKAGMAQGI

SEQ ID NO: 543 - protein, 335 aa, Unknown
  Description of Unknown: Bacteriophage F510/08
MSFLNDLTRPNYAGKNADVDIHLEEHLGIVDKHFAYTSKFAPLMNIRDLRGSNVVRLDRLGNVEAKGRRAGEELERSRVVNDKWNLTVDTLLYLRHQFDHQDEWTQSFDMRKEVAELDGQELARKFDQACLIQVIKAAAMDAPVDLEDAFSPGVLEKLDLTGLTAKQAADKIVRMHRRVVETFIDRDLGDAVYSEGLTPMSPRVFSLLLEHDKLMNVEYQATGATNDYVKSRVAILNGVKVLETPRFATKAIAAHPLGRHFNVSAEESERQIALFLPSKTLITAQVAPVQAKLWEDNEKFSWVLDTFQMYNIGARRPDTAGAIELKGIGAFDITA

SEQ ID NO: 544 - protein, 184 aa, Unknown
  Description of Unknown: Bacteriophage F510/08
MLLLDAVNVILRKIGELPIPSMDETYPTMAIALPELEDQRIQLLTQGWWFNTWWKHKLTPDPQGRINLPKDTLAFYPDSPDLQWDGLGVRDANTGDDRIGKSVEGRLVLSREWDRIPEIAQRVIAHQAALAVYTHEIGPDETAQVIAQELQAYQNELSRMHTRSRPLNTQAKRSFSRWRRSLRT

SEQ ID NO: 545 - protein, 826 aa, Unknown
  Description of Unknown: Bacteriophage F510/08
MSYKQSAYPNLLMGVSQQVPFERLPGQLSEQINMVSDPVSGLRRRSGIELMAHLLHTDQPWPRPFLYHTNLGGRSIAMLVAQHRGELYLFDERDGRLLMGQPLAHDYLKADDYRQLRAATVADDLFIANLSVKPEADRTDVKGVDPNKAGWLYIKAGQYSKAFSMTIKVKDNATGTTYSHTATYVTPDNASTNPNLAEAPFQTSVGYIAWQLYGKFFGAPEYTLPNSTKKYPKVDPDANAATIAGYLNQRGVQDGYIAFRGDADIVVEVSTDMGNNYGIASGGMSLNATADLPALLPGAGAPGVGVQFMGGAVMATGSTKAPVYFEWDSANRRWAERAAYGTDWVLKKMPLALRWDEATDTYSLNELEYDRRGSGDEDTNPTFNFVTRGITGMTTFQGRLVLLSQEYVCMSASNNPHRWFKKSAAALNDDDPIEIAAQGSLTEPYEHAVTFNKDLIVFAKKYQAVVPGGGIVTPRTAVISITTQYDLDTRAAPAVTGRSVYFAAERALGFMGLHEMAPSPSTDSHYVAEDVTSHIPSYMPGPAEYIQAAASSGYLVFGTSTADEMICHQYLWQGNEKVQNAFHRWTLRHQIIGAYFTGDNLMVLIQKGQEIALGRMHLNSLPAREGLQYPKYDYWRRIEATVDGELELTKQHWDLIKDASAVYQLQPVAGAYMERTHLGVKRETNTKVFLDVPEAVVGAVYVVGCEFWSKVEFTPPVLRDHNGLPMTSTRAVLHRYNVNFGWTGEFLWRISDTARPNQPWYDTTPLRLFSRQLNAGEPLVDSAVVPLPARVDMATSKFELSCHSPYDMNVRAVEYNFKSNQTYRRV

SEQ ID NO: 546 - protein, 181 aa, Unknown
  Description of Unknown: Bacteriophage F510/08
MAFWLPLLAAGGMSALQQGLANKEERNKIKAENKARLKTDLDNLGAAARDIANLGVMAASYRKQAVASQVEAKRQGMLAGGSAEAQAGAFGVKGASVDAVALDIEREVGEALIQIDDNLDNQMWNLAEQAHSIQAQAKAGLLGQKSTTAGQRSPLVAGLMSAGSLYASQYFKFGATPKGGN

SEQ ID NO: 547 - protein, 898 aa, Unknown
  Description of Unknown: Bacteriophage F510/08
MAESQRASQELGINVGQTQLQPGQSARRGVRDSEVNYSGPSVGSQILDGILGAGQQIAGKWFEHNVQQEVLRGERARMAGEAEEAVDSNVLAKPFVKGGWRKQDYRIAQADFSLKMQRFIANKGREMTPEEFRKYLSQEATHVLDSTEGMNPNDALQALAQQQKAEEQLFGMQAKAYMDWSIDQAARGFRTQGNSILAKAVQAQATGDELSRQLSLEEAGLFYTNIMTSEDIPLEVRDKVGMQFLAASLDMNQRGIYEGLRDAGFLDSMSFDDRRALNGLYEKSKAQTRAKESMATLRADADFQQRVANGAITDLAEVEAYSRGMVEEGRWSDAQAISFMTKAMTGLGNAQRMQGIMAALEAGDINALHTLGTNVTEALEQWDKMQAANGSSLTDRLVQGTQLGLRLGTFPKTYGESVGSAVRMIQAAKEGEANPELVNTLNSIFEQVASAQEINPSAGNVMLSGIPEAEQGAVAWALKQMKMGIAPAQALREFSANAEVVKQMDEFEKGQNTKAFKDNLGKQVNDKFVNNIFGRAWNMLTGESDLSNNEAVLSMYRRATIDEANWLASDRKHAGLLTSDTGREALLEIAAANVRNRTIQVGEGRNLKEGDLFSRRDSAPLILPRGTTAEQLFGTNDTETIGTVLAEQHKPHVEGLLGYKSVVAFEYDRTRGSLLAVEYDENGVALDRTRVDPQAVGNEVLKRNADKLNAMRGAEYGANVKVSGTDIRMNGGNSAGMLKQDVFNWRKELAQFEAYRGEAYKDADGYSVGLGHYLGSGNAGAGTTVTPEQAAQWFAEDTDRALDQGVRLADELGVTNNASILGLAGMAFQMGEGRARQFRNTFQAIKDRNKEAFEAGVRNSKWYTQTPNRAEAFIKRMAPHFDTPSQIGVDWYSAATAE

SEQ ID NO: 548 - protein, 1337 aa, Unknown
  Description of Unknown: Bacteriophage F510/08
MAKQFKGRMTPKYPLDQVQLDEAQVQGQLDAVPTVGFDALTGGEIGERNVAAGQRANARELERIVADQELPALDRASALWNQSTLVGRWVDALQLDADLAANSTGEVDPNFDAGTYGVQALQAAGIQPTDNYLQIMARAGNAEDAAYLLSRIQRYEQDEQIVRDNPYWNFAVGMLDPAALAVDAVTFGAGRALRLGRAGMAAAGGAGQVGYVAGLDAAGADVDAGTYIVAGALGAGVGALLGSGAGRIAAEAPTQPHVPEVSAPTVGLPEVAMTAEEAAARGFKAGDVVDLLDEGTVLSRVSARVEQAEIPAIPRRDTAFGDELHSLSGRKLSEVLDHIKTHAEVPKPLQGIAAKVADTIRTLEGLGQRTAFRVVQGGDTASSAFLKPGTAGIHSTQGLDTLVQVRGSTAPGRVGTNPVTVLHEAVHAATVGVMNAALRNPGAMSPKVAQAMQTLENVRGNVLNALKQDRAAGRQLSEFEETLLAGNSNTLANVKELVAWGLTDTRFQRTLNRLRYSDGGPGLWSRFVEGIRTLLGLRSDADTALSRVLAASETIMEAMPGYTKAQAKWANKGAPVTEEASLETIVRSTRERAREGAGFVNRFFSEADLLAQPGEGARRLLSRLIDDPVRRDGFSTNDNAASYLRRYRNEFEGYVKSYDEMMAKAMAEQGVGLTARALNSRRAMAVRDQLNEQVTRELLRRDREWTAYGSVRVDPNLPPTIKALADRSDEIHGLMGQRAREAGVRGFENFAPRPGYFHRSWNWSKMAQMDEAAPGLARRAISEAVFRGIPGLERADADTIAQAIVQRARDRATGIRSEFMGAMGVADTAFIRQALEEANVSQAKFDSIMAKIEQKQSDQGTVKYGKGRLSLDMTAEINHNGTVYRVQDLIDRDLDRLMENYAGSMSGRSALARAGMPGDSEIEAFIREYQREAAHLGTDKVQELTGQLRGVFGDFTGNVPREHQLGPVAQRASGLTSATMLGFSGVYQLAELATMAHRQGVFNVMKAMLNSRLGDFVGAMRRDPDLADEMQTVLGLNLANDIRMKPWKRQFDTFLVSQDTFMDRFLHAGKQAVPVLNGMKFIHNWQSRMNANLTLNKVARAAQGDEAALRVLQQYGKDVDWTPVLARVRGYVTYRGRNARSMNWGAWSQADVNTVMNTALRIMDDSLLYGRVGQNSGFARSPVGQILGQFRSFVAFAHNKLLRGTYENSGVLGVASLLAFQYPLTALMMGAKAAINGKFDTSDEGIRKMAIDGIGYTAGLGFTADMWGVITGHSRMSAPVFGLAEHSNEVFRGVKDLVTGDDPAAATGDIVNGAAGALPFVNVFPATKLLLESIKGE

SEQ ID NO: 549 - protein, 251 aa, Unknown
  Description of Unknown: Bacteriophage F510/08
VARFKNPETIHVADGVEAVFSLDFPFLRREDVFVQVDKILVTDYTWVDDTNIQLAVVPKKDQEVRIFRDTPAQVPDTQFSQGIPFLPRYIDANNKQLLYAVQEGINTANLALDGVLDAIRIAEEARRLAQEALDAANEALRRALGFAEIRTVTEDSDIDPSWRGYWNRCITSEQSLTLTMQMEDPDEPWIEFSEVHFEQAGIRDLNIVAGPGVTINRLQNTTMQLYGENGVCTLKRLGPNHWIIFGAMEDD

SEQ ID NO: 550 - protein, 146 aa, Unknown
  Description of Unknown: Bacteriophage F510/08
MRGIIAGVVASQIRRPKPVLTTITYPQSSSDRGGMTFHAIAGIIQDTVKFADSKDLGSYEMLVRDATLKSMVITLTEVKDSSVWSMGVLSAAIKSVVQFLTPVEEKSSLDMSIIHGEHKQSVIPYSRWAEAGSLSMGITEGKVYVP

SEQ ID NO: 551 - protein, 292 aa, Unknown
  Description of Unknown: Bacteriophage F510/08
MYHSSTIRGEFDLEIVRPDGTVRQHLHFKNLITDLALEAMSSKGVPSGGWTNMFAGTGNRTPVPADVSLVAPVANASASLNYGNRAVWDSTTGEKVHTGTGTFRAGSFQGQSLAEVGIGRVVSELYSRSLIKDANGDPTTITVLVDEELRVTYTLRIAPPASSEVKITMKGIEYTLSMRDRRTFRDLSPEPAAEFGTRGSLSWSAISAPDSNGQTKTANLSGDAGTGIIQVPAQSAQIMRIQPADANWTEGIQYLRWETPAGRELEIKLDPPLVKNSLERVDITVTHIFNRV

SEQ ID NO: 552 - protein, 196 aa, Unknown
  Description of Unknown: Bacteriophage F510/08
MIQFKFGDYRTRVPFQGARDRRDINDRSDYVDGGVAIQDPSQGLLYQEWHAELLEDGIYLTPEKERVTTRIGPGINEGVASMAVTFDQNMNYVLVYTKQGEGFIDFFDSATEERNVMNLGPVDYIKTDLDDRRPEGSAWAQVLVCYTRQGNFYVRASSTRFTEEELIVGTGKVTRPIVKCGMAANWRFQVLFRGRM

SEQ ID NO: 553 - protein, 101 aa, Unknown
  Description of Unknown: Bacteriophage F510/08
MSKKQTASAERLGLLHELVCTAIERNFKWYMDNDIPIPASDIAAATKFLKDNEITCDPSDTINIDRLREEMRQAQAENRRIALEGFIAGETDDEMERLYTH

SEQ ID NO: 554 - protein, 601 aa, Unknown
  Description of Unknown: Bacteriophage F510/08
MTPQERFQIAHEVRDMYPRFRDFCLDAMLFLGFKMTWMQLDIADFMQDSPNKAMVAAQRGEAKSTIACIYVVWCITQNPATRAMLVSGSGDKAEENGQLITKLIMHWDLLAYLRPEARMGDRTSATSFDVNWALKGVEKSASINCIGITAALQGYRADILIPDDIETTKNGLTATERAKLTRQSQEFTSICTHGKILYLGTPQSRESIYNGLPARGFLMRIWPGRFPTLDEQERYGDWLAPSILARIARLEEKGHNPRTGKGLDGTRGWAADPQRYNEEDLLDKELDQGPEGFQLQYMLDTSLADEQRMQLKLRDLLFIDATHESVPEQVAWAADERFKLKFDAHRFPVIKPELYLPALMAGGWAPLQQMTMFVDPAGDGGDELSYAVGGTLGPYIHVVSIGGWKGGFAEENLEKCIALAARYGVKVIYVEKNLGAGAVGQLFRNHMRSIDPDTNKPRYEGIGVEDRQKSGQKERRIIDTLRPIMQRHRLIFHVSAMDSDHVACQQYPADKRNERSVFHQIHNITTDRGSLPKDDRIDALEGLVRELAPTLVKDDEAATRAREEAAKKEWLNNPMGYTKSVLRSLGMGRERRKGRPKGRRL

SEQ ID NO: 555 - protein, 66 aa, Unknown
  Description of Unknown: Bacteriophage F510/08
MMLDTATEAGKGTLAVTGVGIAVYSPYEIASLCAAVLTALYVGAQLITLLPKMLDSIAELRRRFKK

SEQ ID NO: 556 - protein, 160 aa, Unknown
  Description of Unknown: Bacteriophage F510/08
VNKPLRGAALAAALAGLVALEGSETTAYRDIAGVPTICSGTTAGVKMGDKATPEQCYQMTLKDYQRFERIVLDAIKVPLNVNEQTALTFFCYNVGPVCTTSTAFKRFNQGRATEGCQALAMWNKVTINGQKVVSKGLVNRRNAEIKQCLEPSSQYSSLLW

SEQ ID NO: 557 - protein, 109 aa, Unknown
  Description of Unknown: Bacteriophage F510/08
MPRTIVAILVLAVVALGASYGFVQSYRALGIAQEEIKRQTARAEALEVRYATLQRHVKEVAARTNTQRQEVDRALDQNRPWADRPVPAAVVDSLCNRPGARCAVRTPTD

SEQ ID NO: 558 - protein, 104 aa, Unknown
  Description of Unknown: Bacteriophage F510/08
MANTREQYLAGRNTGLTFYQVCQPGTDNRIALHDMDEADVKAKATAVIAAATALGGEGGATPPDPLTAYKVKNGDTLPVDGGGSVKVTVANGAITKVVYTAPAG

SEQ ID NO: 559 - protein, 81 aa, Unknown
  Description of Unknown: Bacteriophage F510/08
MATFAAATQKDLRAFAGAIENLIRPLEEAALGSGFTEVITITKGTDGNETRTSERKVRPELVANLDALMAAVETAKAAVYK

SEQ ID NO: 560 - DNA, 137360 bp, Unknown
  Description of Unknown: Bacteriophage F44/10
aatttcattagaaaagaatttttttctttttctatagtatctttcttgttatcgtattctgaatacatcataaattctataaatatactatttctgtcagatgaaaacatatctatagaaaacggacaatcaaaacttatgtcatctttattaatactaaaacattcagtaacatttaagtcatttatttcatatacctcaaagtatccatcaactcttttaagttctatagcactattatatctataataacgttgttcctctattaacttatcttttgttagatagggatattcatttataaatataggattacttgttccatagttatttttaatatattcagcatcttctaaggaatcagtataacctaaaacttcgtaacttgttgtatacacagtatcctcttcccacaagtcatagtccatttcctctatttcttcctctagtatataaatttttttcatatattactcccaaacaccaataagatttttaagtttagctataacttcttcttctgtttgataagaaaatactcctgtaatgtgtccatagttacctataatttcataatcctgtgtaccatgtttgtctactagatatgagttacccataacatttaaactatcctccgagtaactgaaatttatattatagtctactaaaaaattaataatttttttcatttacataacctctcctatcggatattgtcctaacattcttgttccattttcgttatagaaggtatattctactacaataatattcattatatcgacatatatagcttctatataaggtgtaatattctcttcttcttgtatgtgtttacctataatattatataataattcagagtgtattcttttatctctcattatagacctccgtaagaaatgatacagtcttatcttttaaagatttttctactagttccatagcatctttataatgttttatattagattcattagacttcagtttatcttttacttcttgaattagaggttcaactttagtaactaaatcttttttattttctatactcacattgcttcttttattatctaatacttcctttggcatatacttaacttttgcaaagtctttatagctaacatttaagttatctaaatcatctaataaatcattataatattctaaatgattatagaatgtgtaaaacttaacaaggtctttacctgctagctcttctttttttagtatattattgatattaccaataacagaatatgctataggcttaaaattagccctaacataagttaaaaatataaaatcatcataaaacaagtctaaaacagttttattgaatctagtatttttagcttgctctaattgagcacataaattaagaacattatcaaacccactctttaataccaaagagataaatctttccactgcatagtacctagatacttcagtatgtttgcttgctttttcactatttctaaaaatagtatctgataaaggttgaactactaaactcatataatctttatctgaatattcatccgatgttccttgataagtacttccaaattctattgtagataataaaaaacttttttctaaattcattataacatcctccttttacttgttattataatactaacacatatgtttattaatgtcaaacattaaatatcttctgttgtgtcaacttcatcttgtatatacttaaagtattcataaattttaaatagtataactcctagtgttattaatcctaaaatatatttcataacaatcctccttaaaagtatttatccttcccatcctgataaagcatccatagccatatcatactcttcttcatttttagttcttataattttctctatttctttttttgcttgtttagagttcataaaatcaatatctactgtatctaaatttgtataatcaatattttctctaataaagttcttttgacttggtgttatagaattaactcgtacgttttcgtgatttaaaaattgatagaagtccatactattcaccttcttttaaacagtctgccatatcttttaaagtattaagtacatatttcaaatctctataataactatcagaaaaactaataacagcatatggtgtcatatcactatagtgtgcacaatcaaaacctaataccctatagtcaccctcatgttcatcgtatgttatacctccatgggaacaatcttctatactattaaactgttctttggttatattcgtaggcacattaatataaccatttagatgtcctgaatgagggtgacgtttaacagttaggtttattcccttataatctatatttaaagttaagtcctctcctaatatattatcctctttatctataatttccataatatgttctggagcttttccaaacatcataattcctcccttttctttatactcttactatacactactttttctattttgtcaacaaaaaaaggctactaattaaagtagcctaagaattaattatttagcattatatttccattgccaataaccatttttctgtgagaactcaaagtgaaaaccgtcatagtcaaattcaatattatagtctccatcttgaagtggttttgaatttagtacaggactattactctttgccaattctgctagaaactcatgatttactttttccatagggtttattcctcctaattattcttacagtactaatatatcacaggtctttttctaggtcgtttttaaatttctcctcataagaactagcataagttacttcataacctattaccttagtataatctatgcaaagtaatttataattggactttattttaatatcctctgattgttctattttattgataacttcatttagctcattcgaagagtaatgtttattatcaacttttattgtttttccttgggtatagatatcaatttcttgtatcatcatttcatccttttgattattcattatttgattataagtctctaaatcatcaatgttatctgtatctgaaccttttactaaccattctcctctcttcttaaggaggtcatcaaatttctcatgttctttaattatcttctctacttcactcggtattagaacagctctagcgtaatttatatgccacatagacatattatcaataagataattaaccattcttataagttccttctcatttgccatataccaacctccttatatctaatactaatataagagaaaagcagacttattaaaagtctgcttctgtacctaattctaatcttttatttttcatatgaggaatcatttttctatctcctgttaatagagataattctctagctttttctttagataatgttaatagtccattataattatctactttcttattatattccataattaagcgctctagctcatatgatatatcttcgagttctcctgatttaactccaagtaactttctatacatatcataatcttcagaaagactttctactttatttttagatacagaatcataaactgcttgtaaattaccttcttcaataagtttaaagttatgttcacctatgattaattcctcctcagaagaatcaagcgttactaatccgcttgtattacctgtaaagtcacctttataatctacaacaataccttcagttactttgtcacctaattcaatagtcccatcttcattttctttaaatttatgagcatcatatacttctactttgtcacctaatctcaaatcttgagttaagttatgtttaccaataattctatccattactcaatctctcctttattaatagggtcttgtgttaagaacatttctagattctcttttgtaataggtaaccaaaaatatttactttccggaattgtaattgtatagaaatcctcatctttgttaactttaatattaacatctgtaaactcatcctgcattaaccaatgagttacagttaagttatatgaaccatcactaacataccctaaatcaatatcatgtctaaaagccaaatcttctaaatgttctaataaatcgttcttttcattatgtttttcttcttctgtattatttttaattgggttaattaactctgtgcaaacaatatcgtacaattcaccatctgtaacctcatagttcttttcaattaatacatcttgtattttattgattgagtttgtaactactttcccatattcttcttctgtaaacttacatttatctaaatcaacatctgtaattaattctgcaatccatttatttaaaattgatactgccattgttctagaaataatactgtcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaaatttaatcaggtttttcataattactctaactccttaagtttattttttactttctctttatcgtacttataatctttactagagttttcatttttttctttctcttcttcattaagttctctatactgagcctcttctacctcttgttctttattatcattaccttcttctgctttttgaatttctacatttttactactaccaccatttaccttttttctaaaaagaaaccaaagtattaataaaatgatgagtaaaataataatgcttaatacaacagcccaaatattattaaccattacaacctacctccgaatagtttttttacggctcttaagttttcagatgaatcattatttatatcaatacctatgctagaatcaaaaattacagcattatcaagtatatgctctgtcaatttattaccgtaactacttttacttaccacactaccataaccatgattagttaggtcaaccatatcaggttcaacttctagtactctaaaagatattctacgtaagaatgaaggatttaccaagtaaaaggaagatttaaaaacatttaatctttgataagaatgttttatattaacaacaaaccctgttaacttattttcatattctgaatttgataacttacctaggtaaaggtttatactatatccttttgtttctaatgtttgaatagcacttaacattatagcccctctataagcaaggttttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgattctctatcacccttaaccattaagttataggcttcttgaaaactatgagttcctgtaaaatcatagctacctgtatctgatgaattttctctacctgaaactctattcttttttaaagcagaaaagaaatcaggtagaccatcatatttaattacatttaattctgagttatctattaatcgtctacccattgattttcctcctattctaatcctaacttatccataattgtatcaaagtccattgaatcttttgatgtactattagattttctaggttcctgtttaggttcttgttgcatacctaaaagctttcttgttgcttctgtatatctgttaccttcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagtttactaagtcttcattgcttgatagttgatgttccaccttagtatcatagtcaaattcaacttgagcaaagcggtctaatgtagctccatctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgagtttcatgaaacttaccatttgcatcaataaatcctgttaatttaaattcttgagtaattgcattactaaaatagaaatctaaatctagggcttctgctacttgttccaatacatggttcttacctgaacctgctccgccttttaaaaatactggaatattttggttaactaactttagtatatcttgatatctgtaatggaagattcctgagatatctttaattgtttttccttcttgttgtaattcaattttaactggtaaattactaagttgttcttctacatactcttcaatttgttttttaacatcagtaataataatttctctactctcagttcctgctttctcaacaattgcatctacaattgcttgttcatacggattagagtttttctctcctagtttttttgctaaatctgctgttgtttccatttgttgctctaccaatctctctaatctttcaatagtatcttgctttgccatatttatcattctcctttgatttgttatacatttattatattacaagtatttgaatttgtcaacaactttctaaaacttttttagttgctaataaaaaaataccttacacctataacttaacatagggtaaggtaattgtcaacacttttgttaaaaatacattaatttaaaaaaatcatcaatatctttagttccatgtgtatccatatcatacataaacatacaattatatgtatgactattcattatttctaacatgttatgcatagaagttgcattattgaattcctctaaatcaatagttaccgtaagttcttgaccttcataaagtatgtttgctatataatatttcctaacaccttccattgttccatgggaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttataatgttcaggtaaatgtgcatctacttgtatattataataatcttctaaaagacctatactctcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaacaccctgcttggatacaagcaaggtgaaaaaggaaagatattatggaagtgtactatctaagtacacctcataatataacagttttccttgctagttattacttattttttaaggtcttcttctttgacaaacactccgttaataagcttacctttcctttcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataattttaacatttgaccctcgggtttacctgtttgtaagtttctatcttttgcccattgtttaataagttctactttttccattattctatatctcctttaatttctgtatctttgataattaggttatcagagtcacttgttacatttaagttatcttcaactaattcatgtagattattagtaatatcttcttcatacctataacctacacgaacataagctttaactctgatatctatattaacataatcttcttggaatttttccatttctaacttcctttattatatcatattattatactattgtcaattaatctgagtagtttcctttagcaagttgatactttttgtgtaattcttcatataattctctcataccttcgtagtttctcatatcatcttccaagaaactaagataatctaataatacttttacatcctcaggttctaaagttataactggttttaccattaggcaacctccttaaattcttctttatttattttcttaatatctttttctaatgcttcttttaattcattaggtaatttataggcatcaattgattgttgttgacctaatacatatccattatctgtgatacgtatttccactgtaaaccatgaattatctaaatcttcttctaatcttgctaataatattaaacaactattttttaaaattctattagcatacccgccaacacaatgagataacattttaccttcatctttaagtttacttacagtatctgcaggaaggaattttacttttctaccatcttttaatttataagttttatcaattattttttctaatttattatcatatttagctttaagttccgcatcatctaattgttgttgtatagattgtttctcatctgtaactatatcatgttctagttttaatgagaatggtgttaggttaacactttctaatgttctataaccttctcttattaatattgataaatcatgtaagtaatctaagtaatagttatctagtgcatatcctgttatacgttgtctgtcttgagcatctacatctaaatagtgagtcatctttttgtagttagcaaaagatatagataatatttcatttacaataggttttacttttaaagcatttgtaacatctcttgaatctctaaccattaaaaaggtatcgtcaaataattggtgtaaattaacttcattgtgtaaatgattatagttcttatagagagtattagcaaatcttaagtaattaccttgctcaaatttatttaaagttagtagctttttataagtctgttttgtaagattgaaggcttcatgaactttccatttagggtttttaggtatatggaatagtaatgcatttctttcaaataatccaaattcttctaagttatttattttatcaatatttttaacaatatctgttaaagttattaagtaattagaagttgaattttctcctataaaaatcctatacttatcccctctataatttatatgaccataaacatctatattatcaggacaccaactagaaaaatcaaaattatgatgctctaatgtttgttctattatctttattataattcctctatttaagttaggttgtgaatagttttttaaaataacatttaataaaacagataatgtcaattcatttttgtattcacttttactaatatcatctttatataggtttaaagctatttctttattaacaagactatctgttaagaaaaccttgactgctcctgtcttaacgtcaaatgaacttttattttctaaaacccatttgttacccatattatgcttatccctgatatgtctaactttaagaccaaaagatgaattattctcagtacttgggtgcatgtaccaaacacgactatacaatgaatctgacatttccttataatactcactagaacctttttctatatcttcattcataacaataatagatgaatttataagaacatatttaccttggtctagtacatccatgatatcattatttaaactatctactgcttccttatactcatctaattgtctagcttcatatccccataaacggttttcattttctaattctttaattttttcttcaacataccctttagattgtatttgttttctacgtctactaccatataaaggaaaatcttttctttctcctctatcagcttcaatatactctttgtaatttcttcctttattattaccaatcacaccttcaactaatttttcaactgtttcataggggtcaccttcaaagtttgttacttctttattaccacatagggctaaaaataaatgtatttctgtagctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagttcttctaaatgagtttcgtatataactttttgaattttatttaatggttctaaatctaaattcctaataagtttttcatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataatttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctacctccttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctagagttaaattaagaccaactgatactacttgaaacatcgtagcatcagttagaagtaaattgtaaaaactaatacctactgtagctacaattaaataccaaaaataactactaacacctttaacactatctgacttaactagggctattaaacctggtatataacctactgtaactaatatagcatataatatacttaagtaatgtgataaattatccatcttgttcccctaatttctctaatctattagtaacttcttcccatgaaataaatccttctccgtttgttaattctaaaaccataccatacacaaattggtttgtactaaattcagctctgtcagggtcattgtatggtttaccatgaccctgtctaatatcagagcagtagattaatacgggtttttttaaaatatattcctgctctccaatttgtccttgtaaaatatcatatgtttctgatagttcatctatctcattgaacttaaataactcagactgttcttttaattgttttattgtttcttgtgcttgatgtttcatacctaataaaatacctagttctgcaattgttcctaatccttcattaagaacatcaaatacaaaaatatctgattcttgcatagccttaaagtcattagttaaaatacgttctgctagcttagtttgttctgcattagctttatcatttattgacttatctttgtgagggctatacggagttactcctacaatgccatctacttctttatgttgtttatctctgtaatctaccatagcttcatttaggatatgtccacccatataaattactttgtctttaattttattaaccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagctactagcaaagttttaactgtttttaaccctaaatgatgtgcaattacattcatgtcttctattgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacactagctaaaaatgctaatactactaaaccaggtaaattaagaactgttgataagaataatgatattgcacttataacataaactagaccgcttagaaataaagttaataatacaattgttataagtttcaccaaccaattattattaataaataccttagctaaataattcataaaaaaatcctccttagttattatagaataactataccataactaaggggatttgtcaacatattattttaccatttaaaattgtctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactgcgtttaaagttctgtgcttcatttataattatagtagcatctcttagatttccacctcttaggaataaatgggatatttgagatacccaacaatctcctagtttatcttctttaacattatcttccatcattaacatttcagttatttgttgttcaggattcatattaagttcaataagggcatcgtgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagattagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacccgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctatgactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaatactttaacagaatctacaactacactgtagttactaatagtaggatactctgtataaagtatttctatattagtattcatataactatcaattacagagttaactgtatctctttttagctcagatacattatgttttcgtatagtagggaattcttcatcatattctactaattcttttctatctgtattcaataacttgtctaaagaagacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagattcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaagactaagaaattaatcttagccttaatatattaataactattatgtgcgttgtggtatgcaagagctcctgatgttgaaccgtaacggtcaatcatatattgttttgcacctttagtttgttctgctatagaaccaccactccatgatttacctaatccttggaatagtccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccgtcactaaatgagaaatcataattaccttcttgaattggttttgtattgacttctgctgaatttgatttagcctgttctgctaacttattataatcaatttcgtctgcactagcttcgtttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaaagagaggtattaacctctctaatttattattttcctgttacatctacaatagttccgtctccgccaatttgaataggttgtttaccatcccatttttcaattaactgttgacgtaatatcttatcagataaggaagattctctaatctcattggcttttttatcaccattagcctctacttcttttttcttagcattttgttcagcaatttgtttatcaactttagtacgttctaattcttggttagctttaactcgactgtcaattgctttttgagtattcttatctgctttagggctagataatgcaatgtcctcaattacaaatccttgtttttctaagttgtcattcaagctatctaaagtatcttttttaatttcccctgttttaactccaaatgcatcaattacagaatacttagatactgcttgacggacattatcttgtacccgtgaacgtaaatatcctttttctagttcttcgatatctgcactaccaaaacgattaaataaatctacagctttagttgcatctactttataagatacatcaatatccatttgtaaattcttgccatctgaagttgctacatttaaatctttatatttatgtgtttgtgttttagttgggtatttatttaccttatcaaaaggtgctgttaaatgccaacctggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatatgacctgcttggatacaaacttcgtcatatacaattgtagcccctgccggtaagttaccgcctactggagcatttaagaatggagaacctattctggttactataggttggttaccattaacaaatgttgcgctttccggtttataccaagttccgaactggttctttttccaagaacctgtaactggtctagttgccggtgtacttgcactacttgttttaccatctttaactacagtagagcttgaagttccgttactcatgtagtttttaatttgtttaatgaagtaatcttttaacttattcattattgcttgtgatggtcttccttgtgttactgggttaaatcctgtatgaagaaccatcgaacggtgagggcaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatcccctgtgtgccaagcaatttgattcttagcatctattgcttcccatacataaccttcagagccatagtaatgagcaataccattagcatatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggtgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacattgagcgtgatagtagccatctgcgtcaatggctcctgcttccattacaccaaatgacgggtcataacttgtagcttttttaactctgtaagggctatctactgttccttttgcataagcgtctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagcgttatttgcgtttgtttgccattgaacgaactcattagggtctttactatcacgaggtttaacgtaatctgtttgaacaatatcactgtctctaagacctttagtattattatcaacaataatacctaaacctgctaataatgttagtatagaacctacaatatttacaccttgctcaatttgagctgagtagtctaaaccgaaagcacctgtaatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttccggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctaagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggttttctcttaggctcgaagcaacgattattaccactcataacaactatatattaagtgaaaggaggtgaaatgaacaaaacgtggtaattggtacctaagaaggtaatatgtataatctacaaggagtaagttattggttcataaaggagtgtgaacaataaatacatgaaagagtgaaagtttactccctgtagattcttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctactcatactgataacctctattatctaacacatttctgtgctccaactacagttagtcgttacagcgtatctttctaggattccgctaagaccctagaaagaaattaaaccctagccgttatcatactctacagaccttataagtaagtaccaagtataccaatcgtatttaacaatactaatgacgacccatcctaccgatatatctccgataagttttgattcgtttgattatcttgtaccttatgactaccaaatcattattcagtcactatgctcagatatttagttgtattatttatatattaattataacatagtttttattacttgtcaagttaatttcaaaaaaattatagaagtagggacgcttacctacttccatttaatttacacaaggatgataacattgttattgttttatactggaaaacaatgtaagaaaaacagtgatgtgtaaggtatttgttttattgttaattacattatagcatatactgatacctttgtcaagttaatttaatacttttttaaaatattagttatcttttgttaattcttcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatcctttaatatcaagggttacaagagaaaaagtacgtatttagaaaataaggagtactcctattatatataattatattctgatatagagtaataaataatattaaatatataattataattaataaggttgggaaaattgatataaacataactgatattgcttatagatactcagtataaaagtaaaatcccttagtatcagtacttacaggcaaaaaagtacgtatttagaaaataaggaactctcctattatagttatatatattaattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaactttctcagttgtatccttcttcttagtatccttagtttttgtacttccagcaagttctgaaatcttttcatcaagtctttctaattggacgtaaattgctgattgtttttcactattgacagctacatctttatctatactaactatcatttttcttagttcagctacctcaacttctaaatctttgaaagtccctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaatcatagaaagtaattacggaataacagcagaagagataaaagttagggctaaagcacaaagaagaatagaggaagatagtaaaaaggaagattacgatgaaaacaaagaaagaaattaaagaacaaaggaaagagcttaaggatggtgctacatctgtttctttagtaaaaaaaggagataagagaatagctagccctagtagaatttgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatggatttatgaatggtatcggtaaattaatgtacgaattcaataaaaaagtagataataaagaaatagaagttaaagaccctaatgatttatataaattatttgtgatattctctcaaatgcaaaatatggtcaatgaaacttctgaaggtggagcaatacctcaactatctagacctcaacaggaattatttgatgagattacaacagaagatagtaatggagaatctacagttgatttacagaagatatcagaaatgtcagcagaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaacccttctacctatatgcttaagtatcatacactgagaggtcatcctataacttttagtattcctaacagggatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgatagggtaaacttattagcagaatcgtctgcactagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacagaatggcagttaccaatttgtttgtcaaaaatgtggtaaaccattggatagatggtataacggtgagtggcattgtaagtaccctgagcgtacaaaaggtaataaaggggtacgaggatacctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataacgttttaaaactcattaatcattttggaaaagataaagtatttgggtgtacttataaatcttctcctaaatctacagggcaattaagacctgaatttaatgagaacaataatagggttacagtagataaattaatgcagaataaaagatatgtacaagcacttaagacaaaggatataagtgtttatagtacagtagatgatgatttaaaaactttcttaaaacattggcagaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatactttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagggctatttctaatggtgaagaaggaaaggtaaaccctaaaaaggtagcaaattcattatctaatttaagtaaaaaaggtgtagatgtatcacatattaatacaaactcatcattgtataaagagtttgttgatgataacggtgatacattaggaattacatcttttaaacgaactgaaaatgatataatattagaatcttatgcaagttcacatgattcagatggtgtaggagcaagagctattatggaattattacgtttaagtattaaggaaaataaaaatgcagttgtgtatgatatagaattacctgaagcagtagagtatttaaaaactttaggatttaaacctaataaagatggatacatcttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacaaccgaatgaaaatcctgatgaaggtaatgaagaaaaaccatctgaaccgtctgacaatcctgatgaaaatggaggatgggaaactgaaccaactgaacctgagtcaccttcagagccggacgataaagtggacgaagaagataaaaatgaagatactacagatgataaacagcccactgaacaaccggacgataacaacatagataatgaagataaaactgaagaggagtaattactcctcttttttgtttgctatattaaataagagctaaatataaaaaaattgaacattacggtggtgaaaactttgttaggaatgaatattataacgtcactatcagtagtatttacttgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggtgcaatacttggaggaatttggtacaagatgatgaaaattattaaaaagagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaggtaatattagtagataaagataataatatactattagaagattatgatattgttatggaaagtaagaagatgttttattacattgaagaaccgttcgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaagaaatgaaacgtatagaagattttattgttaatacaggtaaagataaagatgtagatagagattcatttcaaactttctgtaagaaaattgttagagatacttacatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagagttagctatgggtataagaaaccctagaactgaattatcttcttcaggatatggattatcagaagtagagatagctatgaaagagtttattgcctacaataacactgaatcatttaatgatagattcttctcccacggtggtactactagaggtattttacagatacgttcagaccaacaacaatcacaacatgcattagagaactttaagcgtgaatggaaatctagtttatcaggtatcaacggttcatggcaaataccagtggtaatggcagatgatattaaatttgtcaatatgacaccaactgctaatgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagagggcaatgaagatgaggaagttgaaaaatcagctaaagaatcaaaagaccctgtagaccaaaaagatactaagacagaaaataaagacaacgagaaacgtaaaaataaaaaagataaaaaagaagattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagttaaaggattaactaaagagcaagaaaaagaatttgcaaatgttccaggttttgaatttgaagaagaaaagaaaactactagaaaacaatcagcttctactagtaaagaagaagagcctaaggaagaggaaaagaaagcctctactagaaaaactacaagtactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacatatagacgtaagtgagatagataatttaacattagctgattatggatggtcaccggatgcagttaaagcatatatgttcggtatcgtagttcaaaatcctgatacaggacagcctatgggtgatgagttttataaccatatattagaaagagcggtaggtaaagctgaaagagcattagatatatctatactacctgacactcaacatgagatgagagattatcatgagacagagtttaatagttatatgtttgtacatgcttacagaaaacctatattacaggtagagaacttacagctacagtttaatggtagaccaatatataaataccctgctaactggtggaaagtagagcatctagcaggacatgttcaattatttcctacagcacttatgcaaacaggacaatcaatgtcatatgatgctgtattcaatgggtatcctcaattagcaggtgtatacccgccatcaggggcaacatttgcacctcaaatgatacgattagaatatgtatcaggtatgcttccacgtaaaaaagcaggaagaaataaaccttgggaaatgcctcctgagttagaacagttagttataaaatatgcattgaaagaaatataccaagtatggggtaacttaatcattggtgccggtattgctaataaaacattagaagtagacggtattacagagacaataggtactactcaatcagctatgtatggtggagctagtgcacagatacttcaaataaatgaagatataaaagaactattagatggtttaagagcttactttggatataatatgataggattataaggagggttagaaaatggaaaaaccgtatatgataggagccaactctaaccctaatgttattaataagtcaacaacatatactactacaacacaagcagatgaacaagataaacctaagtatactactagactagagtttgatacgattgacatgattaggtttattaatgaccgaggtataaaagtattatgggaagaagcatatttctgtccttgtcttaatcctgatacaggacatcctagggtagattgccctagatgtcatggtaaagggattgcatatctacctcctaaagagactataatggcaatacagtctcaagagaaaggaactaaccagttagatataggtatattagacacaggtactgcaataggtaccactcaattagaaaagagaatttcctatagagataggtttactgttcctgaggtattgatgcctcaacaaatgatttattttgtgaataaagatagaattagaaaaggtatacctctatactacgatgtaaaagaagtaacttatatagctactcaagatggtacagtctatgaagaagattatgaaattaagaataacagattgtatttaaatgaaaaatatgagaaccatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgttattgtactacaagacccttataaagttaatgatggcatagaagaagacctagaaattcaagtagatgaccctaaggcttcagcatctaatcctagtaatttaggtggattcttcggaggtgcatttaaataatgccagttcacggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttacctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttaccaagatatgagaactttaaaagtagataaaggtacaggttcagtctctaagataactgattacctagaaggacgtagaaagaatgtaagccatccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagataccttagtcgaatcttctacagcaataagagaagatgataagttagtttttactgtttctaaaccaataggagagttaataaaggtagaagatatagagtttgctaaatacgataatctccaagttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttagatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgaaggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactatgcacaagctaaacgtttattccgttcaggagaattacttgatgcaatagaattagcatggggttctaaccctaactatacagcaggtaagattttagctatgcgtatagaagatgctaaacctgcttcagcggaaatcggtggattaaaagtaacatctaaaatctatggtaatgttgctaacaacattcaagtaggattagaaaagaatacattaagtgattcattacgtttaagagtaatcttccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagtaaattagataaaattgaaaatgcaaatatcaaagataaagctgtatatgtaaaagcagtttttggtgacttagaaaaacaaacagcttacaacggtatcgtatctttcgagcaacttaatgcagaaggagaagtaccaagtaatgtagaggttgaagcaggagaagaatcagctacagtaactgctacttcacctattaaaactattgagccgtttgagttaactaagttaacgggcggtactaatggagaaccacctgctacatgggcagacaagttagataaatttgcacatgaaggcggatactacattgtcccattatcatctaaacaatcagttcatgcagaggtagcttcttttgttaaagaacgttctgatgcaggggaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaattggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgatgacgtaactacattcaatgataaatcagacccagttaaggctgaaatggctgttggggaagctaatgacttcttagtaagtgagcttaaagttcaacttgaagaccaatttattggtactcgtactatcaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatttctgttagcttggtttacaagcaacaaacattagaagcctagtctaggtgatggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatatttacgttatgaaggtacaattacagtagaacgtttacgtatgaaaaaagaaaactttgcagatttaggatatgcttcacttggtgaagaaattcttaagaaagatatcattgatattttagtggtagataacttaacgaaacaagttattatctcatatcatggttgctctgcaaataactacaatgaaacttggcagacaaatgaaattgtaacagaagaaatcgagttcagttacctttaactaatagaggctatgtttggtgacaagcatagaaaacactttaaattgcgtgaaagtcttaaagactagataactacaacgtaactcgaaagggtaagcgtgaatgttgagaaatcagaaaaaatatctagtatagtataaggttaaatcctaagtacagtaaaatagatgatacgcaggcaagcctacaaatgtgggaagcttcaacgactataataggtgagtcttagttacacattaagattatggtatagtctactccctttaaaatatatcgaaagatagggtacaaaggacagcatcagataaagctagaacttaaatttcttattaagaccaacaataaaagttggtcttatattttatacttgctttgtctgaggcagtgtgctataattaaaatacaaggaggtaataatatgggaaaaaatcaatatacatttaatattaaagaaaataaaaataaatggtatgaatggtgtaaactacaaaacgtaaaacctttagtagaatatgaaaatgcacaacaaatattttattttgaatttcttgaaggtaaatttaaaggactaataggaaaaacatattgggctagtataaatagaggttctaatatgcgtatgagttgtttaacatcagaaagtaaagataaatatttaaaaaatttaggaaaaagaaaaggtatagaggtagtagaagactataagggtggcagaaaattaaaacataaatttatagttttagaaggtaagtaccaaggatgtgaagggtatataactttaaatgatttagagaatttaggtagagtagataatagaagtttatctgaaaaaggaaggaaacaatactttgataaacaggcaagacttagagattgtattattctagagtaccctaaagactatagaataaaaactaaagataagatagtagtaaaagataaagaagggcatgttcataatattattgttcaggacttttttgagaaatcatctttattggagttatcttgtgctagtgaaggagagaaaatagttaaagaaatacttactaaaaattctataaaatttgaaaaagaaaaatcatttagaaacaaagaaggtaaagtacaaagatttgatttttatattaatgaaaataataaagaatatgcaatagagtacaatggtgcacagcactacatagattctacaggatatcttaaagatactttggaaacaacccagaaaagagataaactaaaaaaagaatacagtaaagataaaggtataaatttattaattattccttacacaataacagataagaaagaaatggaaaaaattattttaaattttttaaacaaataacccttgacactccctcaagggatatgttattataataacaggttaggagtaataagtatgaataataggcaagctaaactaaaaggatataaccaatttcattattatgattttccaacaactaaaggtaagtttaaagatataatgaaaagaaaatctagaacagaacttaaaaaagatttacaaaaagaaaggaagtattatcttgacaaataagagaaaaacgataggtaagatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgttataatatgagaatttatataagtaatgactataacaaagagctattagataaatgtttatcagatattaacaaagataaaggtaatataaactacagtattaattatggtgaaggtaacattaaagaagcagatgtagaaattattaaactagataagaatctattagaaacagaatcaagagcatttgcttattcgaagtttgttgaagattgtatatttttatttccttataagattgctttacttagagggggtaaaatagagttaagatttgattggaatgaaatattataacaaaaaaaggagatggatatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaagttaaaggtaaaccaacaacaaatatacctaaattaataggttttatttttaaaaataagtttgcctacgaaaatatcatagagtacaataacacagattataatggtaatattgagaggagaattgttgttaaacatcccaaagttataactgtagaaggaaaacttagctatcagtttttgacaattagtcttgaagatgctagagttattacggtgtggtataacagtgtagatgatacacatagaacactagatttaaattattatagtaaagacttgacaattcaataaggaggagttataatgggattaacaatagtaaatggttatttctttctatcaagtattatatttattgtagtaagtatactaaatggaaaaggtacagttacaagggaatcactagctatgagtcaagcattagtgataataacatccattcaatttttagcatttttaattataaatggcatttattactcattaaaatatatgtaataaaaaggagtacaaatggaaatatacattgtaatagacttaagaggaagcacagaagaagaaacaagtatggattttaaagcttttagaaaattacaagatgctataacatatgtagatggtaatggtaacagggatttacatataattcctctagaattagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatgtaacaagtaaatcaactgcaattgcaatcaatcagattttagataaattcaaaacattaacagaacaagcaggaaagattactagaaaatatttagaaggtcaagaaatattaactattgattatgagtactatgattcattacaagaatactatatttacctacttagaaatagtgaaaaaattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaaggaaggtatatcatattatggcagaagaaattaaaaaggaacaagatgtacaagaaacaactaaagaagaaaaaaaagatgttagcaaaatgacaccggaagaaatagataaattaaaatatcaagacaagcaagaaaaagaacaagttattaacaaagttattaaaggtgttaatgatacttgggaaaaagaatataactttgaagaattagacttaagatttaaagttaaaattaaattacctaacgcacgagagcaaggtaatatatttgcgttacgttctgcttacttaggtggtatggatatgtaccaaacagaccaagtaattagagcatatcaaatgttagctacattacaggaagtaggtattgaagttcctaaggaattccaagaccctgacgatatttataacttatatcctttaactgttatgtatgaagattggttaggattcttaaactcctttcgttactaatagtatagaaacactagataaagatatagaacgattgggcggtatggaatcaattgttaaacaacctttatctagaaatctatgggctattatgaaagagtttaatgttttacctactgagcaaagatttaaggacttagatgattatcagatagagtttattattgggaatatgaacagagatgtttatgaacataacaaacaacttaaacaagctcaaaaaggtggaaaattcgatagtcaatttgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgctagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgtttgacatatgaccaaggtgcacgagttagaagtgaactaggtaaagtaagttcttatgagagccaaagaaaacaaaaccaacgtaatttgggacaagcaagagaacaatatagcaactatagaaaccaacaacaagacttgactaaacgtagagctagcggtcaaattaataaggcacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcactaagtgaaactaatagacctatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggcggagtaaattctgataacatgaaggaaatgcaagatgcattcttaggtggtattaaacagtcaggtatggttggtcgtcaagatgaacaacttaaagcactaggttctatagcggaacaatcaggagaaggaagaactctaactaaagaccaaatgagtaatcttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatggctactcaaatgggtggcagtgaaaaagaacaaaaatacctatttaatagaagtatgaaagaaataggcgctaacctaactatggagcaatctgatgaaatatttaaggactctaaagaaggaaaactgtctaaagaagagttagctaagaaagctaagaaaatggaaaaagaaggtaaaaaagaaggagaagataacgccactgattataaagaatctaaatcaggaaaaaatgaccaaaataaatctaagactgatgataaagcagaagatacttatgatatggctcaaccactaagagatgctcatagtgctttagcaggtcttcctgcccctatatatttagctattggtgctataggagcatttacagcttcactaattgcatctgcaagtcaatttggagcaggtcacttaattggtaaaggagccaaaggacttagaaataaatttggtagaaataaaggtggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggatttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtatcctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatccctggagctttaataggtggagctataggttctttcggtggaggagctgttggtgaaaaagtaggagacatggctaagaaggctaacactaaagaaggatggaacctaggatggactaatggagataaagacggtaagaataaattccaagattctttattaggaaaacctatatctaaagcatggagtggtataacaggtctctttgataatgacgctgaagcatctgaagaaaatagcaaagataagaaaaaaggcgttaaaggtgttaaaggggatactaagaagaaagaaaaaatgacagcagaacaacttagagaaaaaaataaccaatctgaaactaagaaccttaaaatctatagtgatttacttgatagagctcagaaaattattgagagtgctaaaggtattaatatagatggaggaacttctgatagtggttctgatagtggaggctctgcatctgatgtaggaggagaaggtgcagagaaaatgtataagttccttaaaggaaaaggactatctgataaccaggtaggagctgttatggggaacttacaacaagaatctaaccttgaccctaatgctaagaacccttcaagtggagcatttggtattgctcaatggttaggtgctagaaaaacaggattagataactttgctaagtctaaaggtaaaaaatccagtgatttagatgttcaattagactacctatggaaagaaatgcaatctgattatgaaagtaaaaacctcaagaatgcaggttggagtaaaggtggaagtctagaacagaatacaaaagcatttgctaccgggtttgaacgtatgggagcaaatgaggctatgatgggtactcgtgttaacaatgccaaggaattcaagaagaaatatggaggttccggcggaggaggcggagggggcgctatgtcctctacttaccaagaagctatgagtaaccctgtattaaccactggttccaactacagaggctctaacgatgcttctaatgcttctacaactaacagaataacagttaatgttaacgttcaaggcggaaataatcctgaagaaactggagacattatcggaggaagaattagagaagttttagacagcaacatggatatttttgcaaatgaacataagagaagttattagtgattttgtattgacacaagagtagtatagtagtatactactcttatacatataaaaataaaaggaagtatgtgtatatgaaaagattaagaagacctaaggtaagaatagagatagttacagatgataatacatttacattaagatttgaagatacacgtgactacaatggtgatgagtttggagctaaacttttaggctttcaaactaaaaactctatggaagatgatagttctgtattccaaatcaatatggcaggagatacttactgggataagttagttatggctaatgatataatcagaatatttattacacctaatgatgaccctaatgataaagaaggtcgtcaagaacgtttaatacaagtaggtatggtatcacaagtatcaaaagtaggtagctatggtaatgaccaaactcaatttagaataacaggtcaatcttttgtaaaaccctttatgaaatttggattaggtgttattcaagaggttcaagctgtattacctgaagtaggttggcttattgatggtgatggggataatgaagtaaaatttactggtagttcggcacatgaagttatgacaggtattatccgaagatttgttccttatatgaaatataactatacagaaaaaacatataatacaatagatagttaccttgattatgatgatttaagtagttgggatgaatttgaaaatctgacagaagtatctgcttttactaattttgatggctcattaaaacagttgatggatatggtaacagctagacctttcaatgagttattctttaaaaactccgaaaaaacaccaggtaaagcacagcttgttttaagaaaaactccttttaatcctactgagtggagagctttggatatgattaaagtacctactgaagactttattgaagaggatgtgggtaaaagtgacgtagaaacatactctatatttacagctacacctgcaggtatgttaaaagaacttaatggtgatgtattttctaaaccacaatttcaccctgaattgactgatagatatgggtatactaaatttgaagtagagaatatctatcttagtactaaatcaggttcagctactgaagactcagattcttcgggtgatgataatggtactgaaagaggaacttattctaaaattatgaaagatttaagtaactatggaagagataatatatctaaaggtatagataagtatacaagtaaattatcctcaaaatataaaaacttaaaaaagcccaagctaaaaaaattatagagaagtttgtcaaagaaggaaaagtaacagaaaaagaatatgaaaagataacaggtaataaggtagatgatgaattaacatcagataacagaccgaagttgacaaaagataaattaaagagtatactaaaagagaagtttaaaacacaagatgattttaataattctaaaaaaagaaaaaagctaaaacagatgcacttaaagaattgacaactaaatatcgttttggtaataaaacacatgctacaactttgttagatgaatatattaaatacaaaggagaaccacctaatgatgaggcttttgataaatatcttaaagctattgaaggtgttagtaatatagctacagatacaggttcagatgcaagtgatagtcctttagttatgttctctagaatgctatttaactggtatcatggcaaccctaacttctatgcaggagatattattgttttaggagaccctaagtatgacctaggtaaaagattatttattgaagataagcaacgaggagacacttgggagttctatattgaatctgtagaacataaattcgattataaacaagggtattatacaactgtaggagtaactagaggtttaaaagatgctattctagaagacggtaaaggtagtcctcatagatttgcaggactatggaaccaatcatcagacttcatgggaggtcttatgggtgaagatacttctaaagaacttaaagaaaaaggtgtatcagagaaacaaagcagtggagataaagacggtggctctgatagtggtggcgctcaagatggtggctctttagattcacttaaaaaatataatggcaaacttcctaagcatgacccaagttttgttcaacctggtaaccgacattataagtatcagtgtacatggtatgcttataatagaagaggtcaattaggcattcctgtgcctttatggggggatgccgccgactggataggcggtgctaaaggagcaggttatggagtaggtagaacacctaaacaaggtgcttgtgttatatggcaaagaggagtacaaggaggtagtgctcaatatgggcatgttgcttttgttgagaaagttttagacggaggtaaaaaaatatttatctccgaacataactgggctactcctaatggatatggtactagaacaatagatatgagctcagctataggtaagaatgctcaattcatttacgataagaaataaaggaggatagtctatggcaacagataaagaagctaaagatgttattgacaagtttatagataatgtatttaattttgatgtattaactatggaaagagttaaagaaaaagatgaagaaattaaaaaaataactacagatgatatgtatgaaaaggttgtgtatatacgaccttatgttggagtaatacaaagccttaaccctcaacatgtacagtatgaatcattttctaataatggttatgatatagaggcagaattaagtttcaggaaagtaagttatttagttgataaagggtctatacctacagattctttatctactttaacagttcatttagtagaaagaaatcaagagctattaatagattactttgatgagatacaagatgtgttgtacggagaatatatggaagaagaatatgtattcgatgaagatgtacccttaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcataccctatgaatattaattatttctttacagagggtagattctttactatatttggtaaagggcataagtacaaggtagatgttagtaaatttatagttggagatatattattctttggtagaagtgatactaatataggtatttatgtaggtgatggagagtttatatctatgataggtaaatttcctaaagatgaaacacctataggaaaatataaacttgatgattactggaatgaatttaacggaagagttatgagattcgatgaagaggtgtatatttaatggtagtaagattccaatcttccatgggaagaagtttaaaaagagtagattcagatgatttaaatgtaaaaggattagttttagctacagttagtaaaattaattataaatatcaatcagtagaagttaaagttaacaacctaactttgggaagtcgtataggtgacgatggtagcttagctgtaccttatcctaaatctttcataggaagaacaccggaaggaagcgtattcggtacaaaacctcttattactgaaggttctgtagtattaatagggttcctaaatgatgatataaatagccctataatcttaagtgtttacggtgataatgaacaaaataaaatgattaatacgaatcctttagatggaggtaaatttgatacagacagtgtttataaatatagtagtgcactatatgaaattttaccatctttaaattataagtatgatgatggagaaggtacaagtattaagacctataatggtaagtcattcttctccatgacatcaggtgaagaagaaaaacctcaggcaacagatttttacactggaactgagtatcaagatttatttacttcttattatggtaataagacattaattgagcctagaatacaaaaggctcctaatatgttatttaaacatcaaggagttttttatgatgatggtacaccggataatcatataactactttatttatatctgaaagaggagatataagagcttcagttttaaatacagaaacacagaaaagaaccacacaggaaatgtcaagtgatgggtcttatagggttatcaaacaagatgacgatttaatgttggatgaagctcaagtttggattgagtatggtattagtgaagataataaattttatattaaaaatgacaagcataaatttgaatttactgatgagggaatctatatagatgataagcctatgttagaaaacttagatgagagtatagcagaggctatgaagaatttgaatgaaatacaaaaagaactcgatgatataaactaccttctcgagggtgtgggtaaagacaatttagaagaattaatagagtctacaaaagagtctatagaagcttctaaaaaagcaacttcagatgtcaatagacttacaactcagatagcagaagttagtggtagaactgaaggtattataacacagttccaaaaatttagagatgagacttttaaagatttttatgaagatgcttctactgttattaatgaagtaaatcagaatttccctactatgaaaacagatgttaataccttaaagactaaagttgataacctagagaaaactgaaataccaaacattaaaactagattaacagaactagagaacaataataacaatgccgataaaataatctcagatagaggagagcatataggtgctatgatacagttagaagaaaatgttactgtaccgacaagaaactatatgccaataccttggagtaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtctagggttaccttatacaagagatgtagctatatctacagcccctcagaacggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgactttatcttatatacaaactaactttacatctcttaatggtgagccgataccatctcttgatgatgtattaaatcattttggaacaaaagttaaatattatatagaaactaaacgtccgtttgatgctaatatggataaagaattattaactcaattaaaagcaaaaggattaataggaatagggtcagagagattccaagtaattattcaatcatttgctagagaatcattaattaatattcataatcaattctctaatatacctttagcttatttaacaagtacattctctgaaagtgaaatggatgattgtttaagttatggttcttatgctattgctcctaagtatacaactataactaaagaattagtagatttagctcatagtaaaggtcttaaagtacacgcatggacggtaaacacaaaagaagaaatgcaaagcttaatacaaatgggtgtagatggattctttacaaactacttagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccccgagaactacacaatagattcaccacaacgtacgacagcaattaaaacaaaatcagatattgtaatagaagattatggtaaagacatagaagttattaacttcacaggtacaactggttttagacctgttagagaagcagacggattaaaaacaggtaagcagaaaatggaagagttacaaagtagagttagtgaatatgctatgcaaggtggtagtggtaatgtaagtggttcttacttacaattttttaactttacagatgatagctactataaagttcatttagctcctcaagggttaaagataactaggtctaaagatgaaccattactttttagatatgaaataacattagtagttattggttcgttaacagaagcagatagaagtgctgtaacaacagaagagtttggtaatgttaaacctaatgcttctcaaagagtagatgagggtataaaagaattagataaaaatgctcgtaaaacgagagatagaaataatcaagaaatatctaaaagagaaaatacaatacctaaatctacaggagataatacgaatgagggtaatagacttaagcaaagcttccctagtagttctatatataatcctagacaatctactaacggattaaaagggaatattgacaatatggctctgataataggttacggtgatggaggtgtatctagctaatgaataattttataccacaacctcaaggtctactcagatttttaaatgccctagatgcagatttaacttcttctcacatgaatttactggatgaagaggtatcatttgtatctaaattttacacaccacagctacaattaagtgaattagcaaaaaaagtattgacaaatataaagacagatgatatacctgtattagaaagagaatttaatgataatacaattatccataaagctaatgatacattactaaaagtacaggctccaagaatgtatatgattctacagtctattgtgcttgaagcatatgctattgttaattgctttgtagaaaatccaagctctttaaaatacttaactgaagaagatgttagtataacacgagaaaatttaaattatgtagctgactacttaggtaactatgatgactacaatagtgttgtcttagacttaagagatttagacttatgttttagtgctatagaattacaattacctctaattaaaaaggaggctaatgtataatgagatttaagaaacacgtagttcaacatgaagaaacgatgcaagcaatagcacagagatactatggtgatgttagttattggatagacctagtagagcataataatctaaagtatccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaacggtaatggagatttagatactgtaaaaggcatagataatatgaaacagcaattacaggcacgtttattaactcctagaggttctttaatgctacatcctaattatggttcagatttgcataatttatttggtcttaatatacctgaacaagctacattaatagaaatggaagtattgagaacattaacatcagataatagagtaaaatctgctaatctaattgattggaaaatacaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttcccgttcattattagaagctgtatcattagagatagagcaattctatatcctaacaaaagaaaatattgattggggtatacaagaaggtatcattgaagcttttgattttcaaaaaagacaatctaaaagagcttatggtgatgttactattcaattctaccaacccttagatatgagaatgtatatacctgcaggaacaacttttacttcaacacgacaagaatatcctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcattgcagatacctgatgtagaaggtgtttatgtttatgaagaaacaggacatattacagtatttgctcatgatagaaatggtaatttatcagataccttaaaagaagatataatcgatgctttacaagactatagaccaagtggtataatgttagatgttacaggtgtagaaaaagaagaagttaatgtttctgctacagtaactatatctaataaatctagaattggtgatacattacaaaaacatatcgaaggtgttattagaagctatttaaataatctaaaaacttctgatgacttaataattacagaccttattcaagctataatgaatattgatgatgtactaatatatgatgtgtcatttgataacctagatgagaacattatagtaccaccacaaggaattattagagcaggagaaataaaagtagaactaaagtaaagagaggtgaaacttaagtcgtggctaattttttaaagaatcttcatccattattaagaagagatagaaacaaaaaagataatcaagaccctaactttgctctcatagatgcactcaatgaagagatgaatcaagtagagaaagatgctatagaaagtaaattacaatcctctctaaagacatctacaagtgaatatttagataagtttggggattggtttggagtttatcgtaagactgatgagaacgatgatgtttatagagcaagaattataaaatatttactcttgaaaagaggaactaataatgctataatagatgctataaaagattatttaggtagagatgatattgatgtaagtgtatatgaaccttttacaaatattttctatacgaacaaatcacatttaaatggtgaagaccacttaatgggatactattatagatttgctgttattaatgtctctataggtgattatttccctgtagagattatagatgtaattaatgaattcaaacctgcaggtgtaactctgtatgtcacttatgatggagcttctactattagaggtggagcaattattaagtggttagatgggttacctaaaatagaaacataccaagagtttgataggtttacaggatacgatgatacattctatggtcatattaacatgaatcaaagtaaagatactgataatagtacatcagatatttttaaaacaaaccatagcttaattaatagtttagatgttttaacaggttcctctagcgtaggtagacagtatgttaactatggatatataacatcatatgtttataatccaggtatgacatcttctgtaaatcaaataagcgctagtacagaaggtagagggcaagaagtacctactgactattatatgtatactagtactaagaataacaatacagtagaacttagtatgcaaactacttccggtgtgtcttatttatataataactttaattttagggattatatgagtaaatatagacctcaagtaaatttacaatctgatgaggctagaagaattgtatctgattatataaaagaattaagtattgattattatctcagtgctgtaatacctcctgatgaaagtatagaaattaaattacaagtttatgatttttctattaatagatggcttacagtatcaattaataatttatctttctatgaaaaaaatatcggtagcaatataggatatataaaagattatttaaacagtgaattaaatatgtttactagattagagataaacgcaggtaaaagagattcagtagatattaaagttaattacttagatttaatgttttattactatgaacgaggtatttatacaataaaaccttataaagccttagtagaaaattatttagatatatctagagagacttacgtagaggcatttaaaatatcatcgttatctaatggagatattataactaaaacaggttatttacctataggttatctaagagtatcaggagacattgataacttaagtaaccatatagaaattattaccatagataataatactaatagtattacaagtactcttttagaagatgactctaatagtttgatattatcatatggtaacgtcaaaaccaatatacacagttttgaattaaatagtgatgcttcaatttcaaatattaaatttgaatactcttattatggtgatgcttgggaagaactgacagtattaactgaaatatctgagggtgaaactatagtacctaatatactaatagatttatatggattacagacagtagattattctaatataaatccaatgtcaaaagtatcattacgttctatttggaatgttaaattaggtgaacttaataataaagaaggttctttatcaaatatgcctaacgattattttaatgctgtatggcaagatatagataaactatcagatattgatttaggctctatgagaatgattaaagacactgagggtggagtatttgatggagctacaggtgaaattattaaagctactttatttaatgttggtgtatatactgatttagatatgttagcctacactttaactaactatactgaaccaataactttaggttctagtcgattaataagtgaacttaaagaagaactattaacatcagaatcatttaatgtcgataatagaattaaagtaattgactcaatatctgagcagttacctaataacaatatattaagtaactcttaccaaacacaaactattacacagaatggatttgctaagtataatttgaaagaacctatagagcagagaaaacaatacaatctaagaatacatggagattttaaagaaggattagaaagattagctataggtaattctaatggttcatttaatgaagtatttgtttaccctgaaaatattaaagatggtatagtagatattacttacacttctagagatgataattacgcagaagggaaacaaagacttaataatgattatagagtttacgctcaaccatacgatagtgaagtagtaacaatttacagtttagagttaataaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttataggatacaaaaaagctactaaagtaactttagttagaccttctaaatcacctgaagatgataataagaatttaatttcttatggtaataaatcatgggtagaagtaacacctgaaaatgctaaagatgaaggagctaaatgggtttacttagaaagcagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcaaacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcaggtcttggattcacattatctgaagataatgtattgacagtaaatcctggttatgtatatatcaacggtaaaataagatattacgataatgacgattcagttaaaataactggcgtaggtaaagaaactatcggtattaagttaacagaacgtattgttacacctgatgaagatgctagcctactagaccaaactagtggagtaccaagttacttctctaaaggtgcagatagattagaagaaaagatgtcattaactgttaatgaccctacatcagcaactatttatactttcatggacggagatttatatatccaatcaactaatgctgagatggataaaatcaataaagtattagctgaacgtacttatgatgagtcaggttcatataaagtaaatggttttgagttattctcagaaggtaatgctgaagatgatgaccacgtttctgtagttgtagatgcaggtaaagcctatgtaaaaggttttaaagtagataaacccgtatcaacaagaattagtgtacctaaatcttatgacttaggaacagcagaaaatgaaagtactatctttaataagtctaataattctattagtttagctaatagccctgtaaaagaaattagacgtgttacaggtcaagtacttattgaaaaagaacgagttacaagaggagcccaaggtgatggtcaagattttctttcaaataatacagcatttgaaattgtaaaagtttggactgaaacaagccctggagttactacaaaagagtataaacaaggagaagacttcagattaacagatggtcaaacgattgactggtcacctcaaggtcaagaaccttcaggaggtacttcatactatgtttcttataaatataataaacgtatggaagtcggtaaagattatgaagtaacaactcaaggagaagggttaagtaagaaatggtatattaattttacacctgaaaatggtgctaaacctattgaccaaacagtagtattagtagattatacttattacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgccttagatgatggtgctatggaaggacagaaccctctaacattacgttcagtatttagtgaaggtttcattagtcttgataaagcagatattacccatcctgacttcggaatagtatttagttttgaagacgcagaagctactctagcttatacagaagccgttaaccaacctaaaattattcctggagatacaacagctcatatttggggtagattaatttcagcaccatttactgaggaacgtacaatctatcaaggtcaagcatcagaaacattaaatgttaacccttataatatccctaataagcaaggtgtacttaagttaacacctagtgaggataattggattgatactgaaaatgttacaattactgagcaaaaaactaagaaagtaactatgaaacgattttggagacacaatgaaagttactacggtgagactgaacactacttgtactctaatttacaattagacgcaggtcaaaagtggaaaggtgaaacttacgcttatgacagagagcatggtcgtacaggtacattactagaatcaggcggtcaacgtactttagaagagatgattgaattcattagaattagagatgtatccttcgaggttaaaggtctaaaccctaatgataataacttatatttattatttgatggtgtaagatgtcctattactcctgcaactggttacagaaaaggttctgaagatgggactattatgacagatgcaaaaggaacagctaaaggtaaatttactattcctgcaggtattcgttgtggtaaccgagaagttacactcaagaatgctaactctacaagtgctacaacttacacagctcaaggacgtaaaaaaatcgttcaagatattattattagaactcgtgtaacagtaaacttagtagacccgttagcacaatcattccagtatgatgagaacagaactatatcatcattaggtttatactttgcttctaaaggagataagcaatctaacgttgttatccaaattagaggtatgggtgaccaaggttatcctaataaaacaatctatgcagagacagttatgaatgcagatgatattaaagtatctaataatgctagtgctgaaactagagtatactttgatgaccctatgatggcagaaggcggtaaagaatacgctattgttattattactgagaacagtgattatacaatgtgggtaggtactagaactaagcctaagattgataaacctaatgaggttatctcaggtaatccatatcttcaaggtgtgttattcagttcatcaaacgcatcaacatggactcctcatcaaaactctgaccttaaatttggtatctatacttctaaatttaatgaaacagcaacaattgaattcgaaccaattaaagatgtatctgcagatagaatagttcttatgtctacgtacttaactcctgagagaacaggatgtacatgggaaatgaaattaattctagatgacatggcatcttctacaacattcgaccagttgaaatgggaacctattggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacaaatatcacaacctgactttaataatattttagcatctatacctgatagtggtaactactatgtaactaattcaaaaggtgctcctagtggagaagctacggcaggatttgtaagattggataaacgaaatgtaaattattataaaatttattattcaccatatagtagtaataaaatgtatatcaagacttatgctaatggtactgtatatgattggattagttttaaattagatgaaggtaacttatacaatgaaggtaatactttgaatgtaaaggaacttactgaatctacaactcaatatgtaacactagttaatcctccaaaagagaacttaaatacaggttgggttaattacaaagaaagtaaaaatggtgtttcttctttagtagaatttaacccagttaactctacctcaactttcaagatgataagaaagttaccagtacaagaacaaaagcctaacttattgaaagatagtttatttgtttatcctgaaactagctcttcaaatattaaaacagataattggaatacacctcctttttggggatacacagctaatagtggtcgttcaggggttagatttagaggagagaatactatacagattgatgatggtagtagcacatatcctactgcaatgactaatagatttaagatgggtaatgagctttctgtaggtgatacaattactgtatctgtatatgctaaaattaatgaccctgcattacttaaagataacttagtttactttgaactagcggggtatgatatggtagatagaactgataatccttatacaggaggacgtagagaaataacagcaagtgagataacaactgagtggaaaaagtactccttcacattcacgatacctgaaaatacaattggagcatcaggcgttaaagttaattacgtatctttactcttaagaatgaattgttcatctagtaaaggtaatggtgctgtggtatactatgctctacctaaattagaaaaatcatctaaagttacaccgtttatcacacatgcaactgatgttcgtaagtatgatgagatttggtctaactggcaagaagttattagtaaagatgaattaaaaggtcactctcctgtagatatagaatataatgattactttaagtaccaatggtggaaatctgaagttaatgaaaagagtttaaaagatttagctatgacagtacctcaaggatatcatacattttattgccaaggctctattgccgggacacctaggggacgttctattagaggaaccattcaggtagattatgacaaaggtgacccctacagagctaataagtttgttaaattattgtttactgacacagaaggtataccttatacattatactacggagggtataatcaaggttggaaactcttaaagcaatcagaaacttctactttactatgggaaggtactttagattttgggtctacggaagctgttaacttaaatgactcattagataattatgatttaattgaggtaacttattggactcgttcagcaggacatttttctacaaaaagattagatataaaaaatacatcaaatttactgtatattagagattttaatatttcaaatgatagtacaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatacttgtattatagtaaacctgaagaggttatagagaataaaaactatgtaccacctcaaatcaataatggtgatgaggaatctcaacaaaatactgtacctaaagaacaatatgatagtttaaaagaagaactagaacttatgagaaaacaacaagaagctatgatggaaatgcttcaaaaactcttaggtcaaaaggggtaataataaatggcattaaattttactacaataacggaaaacaatgttattaaagacctgactactcaggtcaataacattggggaagaattaacaaaagaaagaaatatatttgacattacagatgatttagtttataattttaataaatcacagaagattaaactaactgatgataaaggattaactaaatcgtatggaaacataacagctcttagagatataaaagaaccaggttactactatataggcgctagaacattagcaacattattagatagacctgatatggagtctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattaccgagtaataaaaatgctgttatatcaggaactaatattctagatatagcttcaccaggtgtttattttgttatgggaatgacaggagggatgcctagtggtgtagattcaggttttttagatttaagtgtagatgctaatgacaatagattagctagactaactgatgctgaaactggtaaagaatatactagtattaagaagcctacagaagtatacacagcttggaaaaaagaatttgagccaaaagatatggagaaatatttactaagtagtatcagagacgatggtagtgcatcattcccactcctagtttatactagtgataataaaacgtttcaacaagctattatagaccatatagatagaacaggtcaaacaacctttactttctacgttcaaggtggtgtatcaggttcccctatgtctaatagttgtcgaggtctattcatgtcagatacacctaacacttctagtttacatggtgtctataatgctataggtacagatggtagaaatgtaacaggttcagtggtaggaggtaattggacttcaccaaagacatcaccttcccataaagaattatggacgggagcacaatcattcctatctgtaggtactactaagaatctagcagatgatattagtaattactcttatgtagaggtttatactaaacataagacagtagagaagactaaaggtaatgatgactcgggtacaatttgccacaagttctacttagatggtagcggtacttacgtttgctcaggaacttttgtttcaggagatagaacagatacaaaaccacctgttacagagttctatagagtaggtgtatctttcaaaggttcaacatggacgcttgtagatagtgcagtacaaaatagtaaaactcaatacgttacaagaattataggtattaatatgccatagactaggataagtttcctagtctttttttcttgacttgaaaaggattctatggtatactataactcgtgtaaggatataaggagattaaaatgagattaagaattaagaacttatatacctatgtagaatttgaggaggatgataaatacttaaaagatatatttttaaagagagttcatacaactataggagcaaggcaagaaggttttcagtatagccctgcttacaaaagaggcagttgggatgggtatgtagacttttatgtttatgaggaagataaattccctactggacttttatttaaaattgagttattattaggtgagctacaatcaagatataacttccagtttgaaacaattgatgagcgtgatgaaagtttcttatctgaagaagatattgatgacgagataacattgcttgataataatgtaggtcaaattaccttacgagattatcaatatgaggcagtgtacaacagcttaacattttacaatggtattgctcatttagctactaatggaggtaaaactgaggttgctagtggtattatagaccaactattacctcaattagaaaaaggtgaaagagtagcattcttcacaggctctacggagatattccatcagtctgcagatagactacaagaacgtttaaatatccctattggtaaagtgggtgcaggtaagtttgatgttaagcaggttacagttgtaatgatacctactttaaatgcaaaccttaaagacccaacacaaggggtaaaggttacacctaaacaaaatattagtaaaaagattgctcaagagatattaccgaaatttgaaggcggtacaaatcaaaaaaaattactaaaagtattacttgataacacaacacctaaaacaaaagtagaacaaaacgtattaagtgccttagagataatttaccaaaatagtaagacagatgcagaagttttattaaacttaagaaatcataatgcacattttcaaaaaattgttagagaaaaaaacgaaaagaaatatgataaatatcaagatatgagagattttttagactcagttacagttatgatagttgatgaggcacaccattctaaatctgattcctggtacaacaatctaatgacatgtgaaaaagctttataccgaattgcattaacagggtctatagataaaaaagatgaattactttggatgagattgcaggctctattcggtaatgttattgcacgaactactaataagtttttaattgatgaaggtcattctgctagaccaacaataaatattatacctgtagctaatcctaatgacatagatagaattgatgattatagggaagcttatgataaaggtataacaaataatgattttagaaataaacttattgcaaaactaacagaaaagtggtataatcaagataaaggtacattgattattgtaaacttcattgaacatggagacacaatatcagaaatgttaaatgatttagatgtagagcactacttcttacatggagaaatagactctgaaactaggagagaaaaattaaatgatatgagaagtggtaaacttaaagtaatgatagctacatcacttattgatgagggtgtagatatatccggtattaacgcactaatattaggtgcaggaggcaagtcattaagacaaacattgcaacgtattggtcgtgctttgcgtaagaaaaaagacgataatacaacacaaatatttgattttaatgatatgacaaatagatttttatatactcacgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagttagcagattctctaggtgtttccatctctgctctatccaataaccttaaaaagttagaagaagaaaataaagtcgttactgtttctaaaagaggaaaaaacggtggagtaataataactttagttagagagtatgacacagaagaattgaaagaatttaataattctacagataatattattacttccgatttacagtatgctaaggcattaagagaaaagcacttcccttcttatagatatgagagaaaagaacaacgtagacgtactaagatagaaatggcacaatacaatgctattaaggatgagaagagaagaattatagcagatatgaatttctattcagaaggtcttccttacccttctaaagatatttttaatatgtcttatgacccggaaggtttttataaagcatacatcttatgtaagttatatgaccaatatgctatttctcatatggatgctaaacatacaagtcatcttaaagcaatgagtaaggcaacaactaaagatgaatatgactaccatcaacatatgtctgaatactatagaaataaaatgattcaaaatttacctagaaatagtgttagtgataatttctttggtagtaaaatgtttaatactttttataatttttatttaaaaataaaagataaaaatattaatgtatttaaatatatgaaaaacgtatttaaaaatgtaacattttattacgagaacggtatgcaacctaatccaataccttctcctaacttctttagttcagataagtattttaaaaactataataattatattaaaggaataaaaaaaggcattaacagtacgaatagacacctaggtgatacagacagcatcattaattcatcagactatgtgaaaaaccctgctgtattacatctacaccaactatatactacaggattaaattctactttacatgatattgatactatgtttgaacaagccttagaccttgagaatgcttcttatggattatttggagatatgaaacatattatcttactacagtataattctatgattgaagaagaaattaagaatttacctatagaagagaaggatattattaataaatatgtaaaacaatgcataattaataattactcaccaacaagtatttcaccatctgcaagattatcaatgtttactatgcagaaagagcatatagtttataataagcaattaaataagggaatcaagagagaggatttattaccattaagtctaggaggtatagtgaataaagattcattaagtagtatggatatacaaaacttagaacagaatggcaatgaatacctatatatgagacaacatacttcaacttattatatactaagaatgtttggtgactatttagggtatgaggtaaatttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaacttattttcagcagagtctgaagacatgggttacttatttacagccataaagagaacagcacatatttccgataagatgtcaaatgaagcattagcaattaaagtagaacagcttatgggtaataacaaggaagatgaggagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccgggtgaagttacaccaaaccaattagagcaaattattgtcaatacaacaattaagaaagataaaaatattgatgttgttattattgactatcctcatttaatgagaaatccttatgctaaatatcattcagaatcagatgcaggcggaaaattgtttgaagatattcgtagattatcacagcaatatggatttgtttgttggacgttagctcaaactaaccgtggtgcttatggttcagatgttattacaagtgagcatgtagaaggttctcgtaaaattgtcaatgctgttgaggtgtctttagcagtaaaccaaaaagatgaagaattcaagagtggtttcttaagattatatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagtcattttcacctatttactaactatgctaaacctgataatgaatttgtgaatgatagatttaaagaacagatagaagcattacagaaagtttttgatattgctaaaaaagaagaagcaacagttatatttggtggagatttattccataaacgtaactcggtagatactagagtatataacaaagtatttagtacatttgccaaaaataatgaggttcctgtattattacttagaggtaatcatgatgctacaactaattcattatatactgattcaagtatagatacatttgagtatctacctaatgtaaatgtaataaaatcattaaatacaattttaaaagataatgttaatattgtgtttactgcttatggggatgagacgaaggaaataaagacatacattaatagtaattatgataaagatatggtcaatatactagtaggtcatttaggtgtagaaggttcattaactggaaaaggctctcatagattagaaggggcatttggataccaggatttattacctgataaatatgatttcattttactaggtcattatcaccgtagacagtatttccaaaatccgaatcatttttatggtggctcattaatgcaacaatcattttctgatgaacaagaagctaatggtgttcatttaatagatacagacaaaatgactacagaattcattccaattcatacacgtagatttattactattcaaggagaagatattcctgataactttgaacaattaatagaggaagataattttattagagttattggtacagcaaatcatgctaaggttttagaaatggatgacagtatgaaagataagaatgttgaagttcaaattaaaaaagagtatactgtagagaaacgtattgatagtgatgtatctgatgaccctctaacaattgctagtacctatgctaaacaatactcacctgaatcagaacaagaaatccttgaatgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtaggaagtaaagatttagataaaagtaaacctatactacaattccaagattcagatggagtaatagagaatatttgtaatgttgaaggtttagaagatggtctaagtaaaatgaaaaagatttttgatgatagtaattttgaaaagcattattacaatagagtagtagaccatgatgggtattactggattgattatggttctcatcattgtttctttagagttacgaaaggggataagtaatggttgtatttaaacaagtagaagttaataattttttagcaattaaagaagctacactagagttagacaatagaggtttaattctcattgagggtgagaataaatccaatgagtcatttcattcaaacggctcaggtaaatcaactttaatatctgccattacttatgctttatatggtaaaactgaaaaagggctaaaagcggatgatgtagtaaataatattgagaagaaaaatacgtctgtgaaacttaagtttgatatcggggaagatagctatttaattgaacgttatcgtaaggacaaagagaataagaataaagtaaaattattcgttaatgaaaaagagattacaggttcaacaaatgacgttaccgataaacaaatacaagacttatttggtattgagtttaatacttatgttaatgccatcatgtatggtcaaggtgatattcctatgttctctcaagcaacagataagggtaagaaagaaattcttgaatctattactaagacagatgtatataaacaagcgcaagatgtagcaaaagagaaagttaaagaagtagaagaacaacaaaataatataagacaggaaatctataaactaggttatcagttatctacaaaagatgagtacttccaaagagaaatagaacaatataatcagtataaagaacaattggttcagatagaaaatagtaataaggaaaaagatagattaagagaacaagaggagaagcaaatagaagctcaaatagagcaattagcttcacagataccaacaatacctgaagatgaatttaagcactcagaggagtataataaagcctctcaaagcctagatttactttctaataaattaacggagttaaatcaagtatactcagaatataataccaaagaacaagtactaaaatctgaaatagctacattaagcaatagtctaaatcagttagatataaatgaccattgtcctgtttgtggctcccctatagataattctcataaattaaaagaacaggaaaatatcagcaatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagtatcattcaagaggcttctaggattaaatcagacattagttcattagagaataataaaacttatttaaaagtgaaataccaacatcaatctgttcaaggattagagagagaagaaccaagtaaagaaaaacatgaggaagataaaaaagaattacaagaatctattgacaaacatgaagagaatatagtacaattagaaactaagaaagggaaatatcaacaagctgtagatgcttttagtaataaaggtatacgttcagtagtgttagactttattacaccattcttaaatgagaaagcaaatgagtaccttcaaactttatcaggttcagatattgaaatagagttccaaactcaagtgaagaatgctaaaggagaactaaaagataagtttgatgttattgttaagaataacaagggtggaggctcctacaaatccaattcagcaggagaacaaaaacgtattgatttagcaattagttttgcaattcaggatttaattatgagtaaagatgagatatctacgaacattgcactttacgatgagtgttttgatggattagatactatcggttgtgaaaacgtgattaaattattaaaagatagacttaatacagtaggaacgatatttgtaattactcataataccgaacttaaacccctatttgaacaaacaattaaaatagtaaaagaaaatggagtatcaaaactggaggaaaaataatgaaattaaagattttagataaagataatgcaacacttaatgtgtttcatcgtaataaggagcataaaacgatagataatgtaccgactgctaatttagttgattggtaccctctaagtaatgcttatgaatacaagttaagtagaaatggagaatacttagaattaaaaagattacgttctactttaccttcatcttatggtttagatgataataaccaagatattattagagataataaccatagatgtaaaataggttattggtacaaccctgcagtgcgtaaagataatttaaagattatagagaaagctaaacaatatggattacctgttataacagaagaatatgatgctaatactgtagagcaaggatttagagatattggagttatattccaaagtcttaaaactattgttgttactagatatctagaaggtaaaacagaggaagaattaagaatatttaacatgaaatcagaggaatcacaattgaatgaagcacttaaagagagtgatttttctgtagacttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaaacaggcaaccctattacatttatgaagacttattataacattacaggtaagcaagcttttgatttattagagtctaagaatatagatatagagagagcccctttacttacaactaataataaggatttaacagaatcagagaaacttatattaatgcttagaggtgtgcaccaagataaaggaactactagtattaaacctcctcgattacctgaaggatataaattattaaaagataatttaaataataaagagattataccttttttaaaatacttaaaaggtagaggtataactttagaacaaatcattaataacaatataggctatgttattaatggtagcttttataaagttgacggggaatccaaagtatcattaaggaatagtattatattttttacttatgataacaatggaaactaccagtactggaatacaagaagtatagagaagaacccttatattaaatctattaatgctcctgctaaacaagatgaagtagggagaaaagatgtcatatttaatttgaatatagcaagaaagaaaaagttcttagttataactgaaggtgtatttgatgctttaacctttcatgaatatggagtagcaacattaggtaaacaagtaactgagaatcaaataaaaaaaataattgattacgttagtatagatacatcaatatatattatgttagacactgatgcattagataataatatagacttagcttataagttaaaaacacattttaataaagtttactttgtaccacatggtgatgaagatgcaaatgatatgggaacaaggaaagcttttgagttattaaaacagaaccgggtgttagtaacacctgaaagtatacagagttacaaaatacaacaaaaacttaaactttaggcttgaccttagagaagttttatgttatactagtaattaagtaattaataaaggagaaaaaaataatgtcaaatagtaaaaaagatattttagaatttgtagatgaatacattacagctttaagagttggtaatgagcaacgacaacaccaattagaagaaatgggtaaagaagaaacagcaacattaacagatgtagctaaagctattactaaccttatgttaggtgttaatgagcagatgacagacttagaatataataacgagttaaacttaaatattttaattgacgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgtagtgtttctttagaagaagcaactcgtattgctaaagttcttaatgctgtaacagctcaagaggttacaggagactttaatgatgcatttaatgcaattgacttaatgatgattatcatggaagatgagctaggagtaactcaagaaaaagtgggtaaagctaaagataaactaaatgaaaaacgagaagcttacctaaaagagaaacaagaagaattacgccaaaaacaacaagaagaggcacaaaaagaaactgaatctgacagcaatgagaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacatacatggtgggagcaagtcattaatgatagtagcaaggtggataagacaccttgcttaatatttactagaaacagagctcagagttatgttgctttaccttatgatgagaaagtatatgaagatttgagaaataatgaataccctgtcatgagaacagattttattattgataatattagaaaagataaatttttttatgatgtacttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagtaaagaaagaccattaatcgtatatttttcaggtacagggcaaacagaaagattagtaaataaaattaatattaataattcatttgaaacatttagggttaagagtggaaaagagaaagtaaataaaccttttatactaataacacctacttatatgaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaaggttcctgatactattattgatgagatgactaagttagcttacagttttaattttaaattccctagtttcatggcagggcaaaagttttatgaatcttacgcatcaaaacagtatgatgaaaacaaaaaacctatttttgttgaagactatgagcaacataatgttcgagtagctttatatttatttcaaaatgactatgtaaaggctagagaattactagtacaacttatggagcaaacattccaaccatctacacctacgtataacaactcagggcaagctaatagaggtgaactaagttcatgttatctatttgtagtagatgattcaattgagtctttaaactttgttgaggatagcgtagctaatgctagttctaatggtggcggagttgcaattgatttaactagaattagacctaaaggagctccagtacgtaatagacctaattcaagtaaaggtgttattgcttttgctaaagctattgaacataaagttagtatttatgaccagggcggtgtaagacagggtagtggtgcagtttacctaaatatattccacaatgatatcttggatttattaagctctaagaaaatcaatgccagtgagtctgttagactagataaattatctattggtgttacaatccctaacaaatttatggagttagttaaagaaggtagacctttctatactttcgatacttacgacattaataaagtgtatggtaagtatttagatgagctaaacattgatgaatggtatgataagttattaaataatgatagtatcggtaaagtaaaacatgatgctagagaagttatgacagatattgctaaaacgcaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtttgtacattaggttctcttaacttggttaatgtagttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagagaagcattagacctagtaaacagtttatatagtgctattaacttccagtctattaagacatctatgttaatggctaaagaaacaggaaaaccatttaaaggctttgagaagtctgattacgctacaggtgaatactttgtaagatatattagagaatccaatcaacctaagacagataaagctaagaaagtcttagataaggtttatattccaacacaagatgattgggatgaattagctaaagcagtaaaagtacatggcttgtataatggttatagaaaagcagaagcacctactcaatctatatcttatgtacagaatgctacaagttctattatgccagtccctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagagtcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacggtatgtctgatatttattgggagcaaggaatctcccaattttggactcctgaagagtttgatgtatcaagagatttaagttcttggaatagtttaactgaaagtgaaaagaacacttataagaaagtccttgcagggctcacaggtctcgatacaaagcaaggaggagaaggtatgaacttagtatcctaccatgaaccaagacccaaataccaagctgtatttgcgtttatgggtggtatggaagagatacatgctaaatcctatagtcatatctttacaacattactaagtaataaagaaacaagctatctattagatacttgggtcgaagaaaatgactttttaaaagtaaaagctcagtttatcggatattactatgaccaactattaaaacctaaccctactgtatttgatagatatatggctaaagtagctagtgcctttttagaaagtgcactattctactcaggattttattatcctttacttcttgcaggaagaggtcagatgacacaatcaggagctattatttataaaattactcaagatgaagcttaccatggttcagcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagacattaaagatgaagatttctcattcttagatagtaaagaatacaatactgccaaggaattcctataaaaaggagaaaagatattatggatagaaaagaagcaatggatttactaagtaaagcagaaatattatttaaaaaacatgatgagttttcatgtgtaagtgatattaatgaccctatgaagttattcagtagctctaaggatgctaaagctgatgatacgtctaagtcttttcagctagagtttatgcatgatatgaccatgtatactttatcttatggctcaggacagttaaaacttattgatttagcagaaggttatgaagcacaaaaagctacagtagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtcacacatggtaatgaagaagaaattgagaagaatatggatgaattaatatctaagtctagacgatatatcatgagagatgaaaatcattacatgttatttaatgagaagtataataatgatagacttatagaaaaagtatgtaaacatggcggtaaagttacatactatactgattcagtattaccttattatgttttaaaagacttatctagtcaccctgactcagaagttgtttatcgtatgcgcaatggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattagaggtagatgaaaaacaagaaaagttttatttctttgatggtgaagcttatgatttaaaacctgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttactagaagaaggatatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaatggaaaaacacttaagaaattacttgagaagtgttctaacttaaagagagataagacaaacagagattatgatattgattttctctacaatgcagtacctacacctatcagaaatgactacggtaaaatcattaaatatcaagatgttaaacaagcagaagtaaagccatactatgagagaatgaacaatattattattgataattcttatgatatggtaattcctgtaggtaaactaggtgttaaatacctattaaatgttacagctatcggtaaagtaagaggagtcccaagtaaagtaactattgaaaatgaaacatcttctcatgacgtgtgggtattacctacttacagtattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaacgacaattatgatggcgtagatattaccgcatgggacttagagactaactcattaaaacctgataaagaaggaagtaaacctttagtactatctctatcatggagaaacggtcaaggtgtaactatacctttatataaatcagactttaactgggaaaatggtcaagatgatattgatgaagtcttagaattgcttaagaattggttagctagtaaagaagacattaaagtagcacacaacggtaaatgatttgctgttgtaaaatccctctcatatcgggcatagctttaagaagctgataagagaacctaagtcctgtaataaggatagtggtaatcccgagcctacattattggtgacaatagatggggtgtagagactgagctgaggttttgtagaccaaggtgagacatagtgtatcaacttaatagaggtggtacagtgaaaaaagattatatgacatcagttaaaaataacaaaaaagtatgtagaagatgtaatgaagaattagacttatctaattttaaaacatataaaaagaatgataaaatttattatcagagtatgtgtataccttgtagaaaggaatacaataaattagataaaactaaaaatactattaaaaaatgttatgataaaaatggagataagtatcggaaacaaggtaatgagtataacacttctgatagaggaagagaactaaataaaaagcgttcaagaaaatacagagaaaataattctttaaaagctaaagctagaaactctgtaagaactgcattaagaaatggttctctattaagacctagtaaatgttcagagtgtaataaggaatgtattcctgaagctcatcatcctgattataacaaacctttagaaataaaatggttatgtaaatcatgtcatgaagatacacatcataaaaaataatcacactatgtaaatgagggacatcaagcccatttaggtaactacaaacaaacctaatggtaagggcttatgaaggtatagtccgttctgtatagaaatatacaggctaaaacgaaatatgatattaaattcttaatgagtactgaaaactttaaagattttgagagtattcaggatactaaagtaggttggtacctagccgttacccaggaagttaaagaatctttaagattatctgatttagcttacgaggttacggatgtcggaggatatgataaaccattagaagactttaaattatggtttgttactaagttattaagattcttctcagataaaattaaagagatacagaaagaaaataaaaaaattgctaagaaagagtatgatgttaaagctcctgaatataaagaatggttagagaataaactaaatgaaacagtagtagaactagatgatactgagaagaaatttagagtcagtgaattagagaaaaagtatattcaactaggtctttcacctgaaattgtaaatatgaatttagttatgaataacgatgagtttataagtattgcagaacaatcacctgagtacatggggttatctgactacgctaagtcttacacattaaatactgcaattaatttaattaatgagtatagagatgtaaaagatgtagttaatgatattgatggaggtaactttaattatgattggttccctattgagttaatgcatccatatgcttcaggagatactgatgtatgtagaagaattcattgtgatgtagttaaaaaacttaaagaacaagatagacctaaatcaatgcatttattagaagttaattatccaagacttactaagtctttagctaggattgaatcaaatggtttatattgtgacttagattatatgaaagaaaatgatgagtcatacgagtctgagatggctaaaaatcatgctacaatgagagagcactgggctgttaaagaatttgaagaataccaatacaatctttaccaaatggcgttagaagaacatgagaaaaagccaaaagatagagataaagatatccatcagtatagagataaatttaaagatggtaaatggatgttttccccaagttccggagaccataaaggtagagtaatttatgatattttaggaattcaattaccttatgataaagaatatgttaaggaaaaaccatttaatgctaatgttaaagaagcagaccttacttggcaggactataaaacagacaagaaagctattggttatgcgttagataatttagaattaaaagatgatgttagagaacttcttgagttacttaaatatcatgctagtatgcagacaaaacgtaattcatttactaagaaattacctaatatgattaataaacaaaaacgaacattacatggttctttttctgagacaggtacagagacatcaagactaagtagtagtaaccctaacttgcaaaacttaccggcacacacatcagatgtaaacaagtttgattacaaacatccaattaaacgttcatttgtttctagatttgaaaatggagtactactgggagccgactatagcgccctagagatgcgtattattggattatttactaaagaccctgatatgctacaatcattcttaaatggggaagatattcataaggctactgcaagtattgtttataataaaccagtagaagaggtaactaaggaagaacgacaagcaactaaagcagttaacttcgggttagccttcggtgaatcacccttctcatttgcaggtaaaaataatatggaagtaagtgaagcagaagaaatatttgaaaagtacttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactattatccaaggttcaggtagtttcttaacaaacatgtctttaacttacttagatgattttatccaatctcgtaacttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaataccctattgaagctgatatggaaatcgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaacgttgttaaaagtgaaaaacatatttaccaagaaatttaataaaagtattgacaatatatttaacttatgttatactatataggtaataaatataaggaggaaaaagagtgaatacaggagagattagatttaatcgttctatggatgaatggattataacaagtatgtaccaggatgagctaggtgatatgaatattgttgttacattctataatagagaagaaaataaacacggttctacagttttacccacagagtcatctactggagaagtaacagaggaattggcaaatcttgaagaagaatatcctctagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggactttatgcaacaatcagctaaatatgctttttgggcttctatattagagaaggtaagagcatattctgaaatggaacaaagaaatctagaaacaattggtagtaagctaaaccttacaattagacaagagtacgaacaacaaggtaaaaagcctactaaagatatgattgaatctagtgtttatattcatgattcttaccaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcaaggattcacaggattaacattacctgcagaagaaggttcatctgtccttgacccgtacattcaggactggataacaaatggtgttcaatttagtagattccctaataaaccaggagtacgctattacattcatgtgattgaatactttaataacaatggtcaaattcaaccaaaaacggatgctcaaggaaatgtaatgattcaacctatggaattatctaacacaggatataaagaattattagctaacttaaaagatactatgttaaaaccatcacctaatgcacctcatagctttatctcagcaaatgaagcattcttagttaatattgttaaagctaagaaaggtgaaatgtcatggaaagtaagtgtttatcctaatgctcctttaggtgcgttaccgcaaggttgggaacaacaattatctgacctagaccaattagcaaaaccaacagaagaacaaaatcctaattttgttaacttcttaatcaataatgttaataacacagagttaagtcatgataactttaaatttaaccgtgaaacaaatgtcttaggtgaagaaccttcagagcctaaacaagcacctacgcaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacacgcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaccaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtagatttaacagatttaaatacaattgatttaggtaaagaattaggattaacattgctatcagatacaaacagagcagatattaaaaacgttatacctacaatggttcctcagtatgactatattttaggtggaggtattccattaggtcgattaacagaagtttacggtttaactggtagtggtaaatctacttttgcagttcacttatctagaattgcaacacaactaggtgttatcactatttggattgatattgaaggaacagcagataacaatcgtatggaacaacttggtgtagatgtttcaaaactattctctattcaatcaggagaaggtagacttaaaaatacagtagaattatctgtagagcaagtaggtaaagaattagaatactggattgacactttcaatgaaaagattccaggagtacctattgtatttatttgggactcattaggggctacaagaactcagaaagagattgatggcggtattgatgagaagcaaatgggtctcaaagcatcagctactcaaaaagtaattaatgcagtaacacctaaactaaatgatacaaacacagggttaattgttattaaccaagcccgtgatgatatgaacgcaggtatgtatggtgaccctattaaatctacaggtggtagagcttttgaacatagtgctagtttacgtattaaggttcataaagcatctcagttaaaacagaagagtgagttaactggtaaagatgaataccacggtcacattatgcgtattgaaactaagaaatctaaactatcacgaccagggcaaaaagctgaagcagacttactatctgattatatggtaggtaaagaagatgaccctatcttattaaatggtatcgacttagaacataccgtatataaagaagcagttgaaagaggtttaattactaaaggagcatggagaaactatgttacattgaatggtgaggaaattaaacttagagatgctgaatgggttcctgtacttaaagataatagagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaagaacaagaggaagaactaaaaggagaatctcaagaaaaggattctgaataatagatggataatttaatagataaaaacatgagtcaggtaaaagaatctttggggaacgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaggaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagagatttagatagtttacttaataggtataaaaaccttagatggtctttatatcatagatacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtccttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaagacttaattgaagcagttagtgcaggaacagctaatgttactgtaactactgaagatggtagtcacactgatattgttgctgtaacagttaaggaacctattcctgaagcacctgcagacgtaacagttgaacctggtgaaaatagcgcagatattactgtataagaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgactatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattataacatctaagtttaataaaattactaaagagtttggtttagatagaatcggtaaagatgaccttaaagaaattgtagaggatatccgacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaagcaagattaaatcattttattaatacaacagttaaagaaattgaagatagagaaatttctaatgtaactgtttactttgttggggacttagtagaacatattaatatgagagatgttaaccaagcatttgaaacagagtttactttagcagaacaaatctctaaaggtactcgattacttattgatatcctgaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaaggactattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattattcataaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatctttaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtataaacataatcatgtaggtataatgagttacattagttttaaaggcaaacctgttgtaggcaaatacaaagatgctacaccatcaccacatagaagcccttatcatacaatgaatatattatggaagacaaacttaatgacaatacttagattgattagagaccctcatacgtatagaacagggtatagctataatgctagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaatccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagagcaaagaacatttaagggtaaacatttgatatttatattcaaaacaagacatagagttaaagcagaaaggaaagataaataatgttaaaaggattttcagaacatgtagacaaacctacaactagtaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcaaaacatcagttaccataaataaatgacagttaaggagagctatataatggctagaaaaaagaatttacgaaataaaaacagtgatataaaagttgttcctgataaagaaaaagaaagtatattatctaagctataccataataaattactacgttctaaggtagataatgcattagatgaagatatgagttatgatgatattatagaactatgtaaagaatatgatttagaattgtctaaatcagctattacaagatacaaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaagacattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggagaaacaatgctctttgatgaaaataaattaaataaagttaaagattagggttgacagcttctatagtttatgatatagtatatgtatactaaaaataaaggagctaacaattatgtttatttcattaaatcaagaagagaaagaattattaactaaagaggaaagtaaatacacaccactagaaacatcaagagagtttaacacacctaaagaagaattcattgtaacaagttataacgaaggtaaacccttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtagaaagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctccttctgaagaacctgaagtagaagaagaaaaactatatactttaaatgagttaaaagagaacttactagatgctcaaggattaaaagatgttgtagctgattttcctgcatctaaagatttatatgaacctaataaactatatatttgtacaataccaaaaggatatcgttctacagaagtacaaccaggtcaatatattggtatcagtacaggattattatcagaatcagaagattttagtcatttaagaggtcaaatgcctagaaatctttatgaaacttctcatgttttaaaacctttagtacgtattaataatacaaatctcgaatatcaacagcatgagttacttgaagatattaaagatgacaagaagatatacgatgttgaattagaagacctgagattagtaacaggagaagaaatatcccatttagaaattgtcgatagtaagttttttgaaagtcgtattaatgaaattctagaccgctatactgaattaacggattccgatgatttgcttatatactatagtaaattacgagaattagttggtagtgacaaaatgatttattgttcacttttagataaatgtgttaaaattatagattaatagttagtctcctcttatattataactgtaagaggagacatttttgtatagaggtgttaattatgtcaagaaaagcaagtatattctatatactagtggttattgttttggctttttctatttcatcttattatatatcttctttcatgtatcacgacaaagcaaagaatgaagtctctactgagttatcaaacacgggaaagattaaagaagaaaagaacgtagaatttgtcggtgactatacacttaaaaaagtggaaaataataaagcttattttatggaaacattacctacttacctacccggtagaacaggagataacagcatagatatgaggtactacaaaacaagtagatttaaagaaggggtaaatttcaagcttattagggtatatactgaagatggggaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaattatggaaatggcagatttagaaagattcgatacgtttgtaagattagtttcagatgatgagctttcggaggagagagcattagaattaagtgtagacttattaaatccgatactagaaggaggtacagcttaccaagctaaaaaacgcattagaagtaagttcggtaaaatagaagcaaaaaactttaaaagaaattataaattcttactcaagtcgatagctcaaatagaccaaaggagataggacaatgatagaaagggaaaagttagttaaagaaattgaagatgctaatagagacatacaattgaggttaaaagaagtagatgattataaggatagtatacgttctaaaggaacaagaaactatgtatctactaaggtattagattcagttatggtagggctaattataagtttctttattcttgtaatgttacgtgtacttgaatattttgtaacaggtaatgctgtttattcacctttagcacccgcagttattattatgtttgttttagccttaggtacatggaaagtaagtaaaatgaataaaatagtatcctataggggaactattaagatgtactgggaattaagtaatgctgaacagaaccaagctaaggtatttaagtatcctaatgatgaagtagatattgtatcaaaacataacttaagacaaataacttttagtgagattaatatacttcatcttaaatatatgagatataataaggcagtagaacagcatactaagttatctaaagaactttttaaaaaagataaagaaactgttgacaagaataaataagtgtagtatagtattactaaaggaggagagatattatggttatacctagtattaaagcacaaaacaaattcaagaatgaattagagtattataagcaaggtcacattagtgaaagtaaaatgttagaattagcttttgattacattcaagaattagaacaaaataatgaatacgttactaatttgctagaagaggagagatacggtgagtaaatttattggagtgtacttatttaatttattagtagtagcactaatttacacagtaggatttttattcttttatggtgtagctagcttagttattattttaactcatgctactattgacccgttcgtattagctactttcttaggaataggattcttagttattagaactgcacacagaatcatggcacgagtaattaatgatgcagtagctaaagctattaaggataaagaaaatgaataaaggggaatttattatggataaaacattaccaaagtttagtgtatatgaagttattgtaaagactgtaattatgacaccaacagaaggaagttctgacctagaatcattttacttttcaactagagagttagcagaaagatttgttgaagaaaatacagtggaaacaaaaaacggtaaacgtgtatcttttgctgttaaagaacgtaaagtaaatcaaccaggctaacattaatttgttagctttttttattgacaaatcattttatatagtgtatagtaatattatacagaaaaggaggaattattatgaaagtttcagaagaagtaaaacagagttatctagagaatagagctaatactaaaatggataagataagttggtctgagttaaggtctagtcctttaggtattaccttaggtgatattatattttatagtgtggttattatagataacattatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttagcatgacagatttacgtgagttcacaaaggaagtatctacagctcagaaagctttagaatattttaataaaaaactttatattaaaggcttgacagatgaagcattttaatatatactaaaagtataaataaaataaagaaaagaggaatgattattatgttattaggaattttatggtttatatggggatttgtatcgtactttgtattgatgtttggaattgagttttggaaagatagatggatgccaggtgttatcggagcaggagctttactactattcttattttggattatgaaatctattcataatgctatgacagtagtatacttgtattaggaggttgtatagatgattgatatactagttattcactatgaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaaggaactattaaaattgtaagtggtgaaacaaaagcagtagaagttattgataacttagttcaccctcactcaggacgtttacctattaaaacaacagaacgtattgcgctaggtagattaacagattctttacagtttgttatctcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcgggattttatggatggtttttcttactacaagcaggtatgttacttttcttattattagctaggaaggttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattaatatgagtaaagaaacaatcagaagacaattttcaaatgcaattgagattatggcaacaactaaagaatggtggaacttccctaaaagttttgatacgaataaagaatttaaaattaaaacttttaaaaatgatacacttgtatttgaagttagagaaggtagtagaaacttaggaagctttgtagtttttacaaacattgattttgattatgataaactagaaggaacttcaacacaatatatgattaattactttgctaagaaattaactaaagatatgtttaactatcataagttacaattatagtaggaggtggaaagatgagagaagagttaaaaccttttaataggaaacaagttaatgttaaagggtatttagatgatgttaagtactcaaagcgtagaagacataagggtaatcaacatgggtgtgttaaaatcacagttactgatgtaaagattaatggtatacctattgaccacgttaacattgaagttggtatctctttctatgaaaaactaaaggagcttcaaggaaagagaatccaatttgtaggcactgtttacaagtatgttaaacatgctagagggcgcaaaggtagaattaaaggattttataaagaggattatagcgtaactttagataagaagttacaaaaggaggaaaaataatgactgaatggtatgctttatgctattatgataaagtaggtaaaaagaaaatacctaggcaagttagagcgcacagagatatttcagtattagaagaattaaaagaaagattagaagaaagaaatcctaatacagaatactctataaaaacaacaaaagaatttgatgaggagagataaggatgttaacaccacaacaaaaagattcattaaaagaacaacaaaagaaattaagtaaaaagaagaaataactgttgacaaatgagtgtgcataggttatacttaagttaacaaataaagaggaggtatgacctatgttattcataatttttattctagcagtattctttgtactaggatttattaacggatggaactcagaagactaaaaaaggagtggttatagtgaagttagaagataaagtattagaaagaattgattctcttggaggtaagttaggtgatattagccaacatgcttgggaagctttagtaaagtaccaaattatatatggtattatagaccttatagtaggtattgtagttatagcattaactttatttttatggaaggtatttattaatcaacataagaaggtaaatgatatggatagagatgatgattatagtttactatttgaagattgtgaagatttatcaggcataggtttgttttatgtaatagttacatcattaatatcactatttgcatttatatacttaatctatggaatacctatggatattataaagatattaaaccctgaagtatttgcagtaaaagacttaatagaacaagctaaaggaggaaattaatatgaaacaaagagatttcgaatttgaagaggattttgtattaacttatgaatgtgaggattgcaaacatttcgaggattggggtcatgatgaagagcctgaagaatgcagtgaatgtggtagtagtgacttaattaacaatacaagtcatgaagacactgagtgtgatatgtgtaaaggatacattgatatgtggcaagatggttatagatacatgggagataataaagcataccttgaaaaagaagattcaggtttaatttgtgaagattgctatgagaaattagatatttaataaggaggaatttatatgaataaagcagtagaacaagcaagtaacgcagtaggtcaaggattttcagccatggtatggcatcaagtattagtaggtctagggtttattttattagggttgatattatccttactagtttgggtactagtgaaaaaatttcatgtaccttttaatcacccaacagcttttgttgtatattcaattatgttagttagtattgttgctagttttatttggggcggtttacatgtaattaaccccgagtattacgctatcttagaacttaaaggttttataaagtaggaggaattctatgactaaagaagagttagagcaaagagtaaaagaacttgaagcagagaataaagaacttaaaaaacaaatagaacgttttgaagacgagggaggaaaaacaaaagatgaatagtagacaaaagaaaattttaacattaacagtaagtaactttttaattctagccttagatactgtagcactaattagatataaaaaaggtaaaattaaacaagagaattataacacagggcaaattacaagaatgatagctacaacagctaactcattaggtattctttacttagaagagcaagagcgtaaagaagttaaagatattaaagtaggtacttttgaaattggagccttaaaaagatttacaaataataaataaaaaaagtttaagaaacctattgacattaggtttcttttattatatactaatattataagaaataaggaggttaacttatgaaaggtattatcatattttacaaggaagagaccaaagaggatttaggatattttcttgggtttataaactttaagctagaaggattatcttacacaactgaaggtactttagtagataatgatgtagtagttttaaaggataaccaaattaatgaggataatttagagcagtttagtatgtcaaacaataatttagttattggaatactaggtcattcatctctttcagtacgcatctatgaaaaaggtattagacaagagtttgatagagtagaagaatatttagaggagttgagacaataatgatatttatattaatttttggtttactatttattttatctttactaggtatttttatttattctatagttttacgaaagaaaaaacaattaatagaagaaagagaatcatttggtatttataatagaacaaaagaaaaactgggtgatgtaacacgtttagggtatgaggaagatgtatataagttaatccataaccaatctaataaaacaatcatagaggataaaaagagtaaagttgtagatacaattaaaaagatgtatgaattagaattaacatctgtagatgtttctaaggtagaaggattatctccacttgatacagaacctatgacaaatatgaaattactttcatataagctagatagagaaggattatatagtttaagtaaatttatttaggagtgatacaatggaatttatagataaaaataatgtaattaaagcttatgatataccaaatgtttatttaaaaggttatgtattacaggcatgtgataaaaatggagatacaacagcttatgatggttatgaccaaatacactataaagaaggtagagtattaacattcccttttgataaaccattaagaaagataaatgtactatcaggatattacaaactatttaaaaaggaggacataatatgatttattttgttagtgatttacatttcggtcatgataatattagagaattcgaagcacctacaagaagtcactggaactcagtagaagaaatgaatgaaggtttaattgagttgtggaataatacaattacaaataacgatattgtttataacattggagacttctttttcaatatgaaaccttctaaagtagaagatatacttaatagactaaattataaagagatgatactgattgcaggtaaccatgaccataagaaacttataaaactatatgaacgtaatggtattacagtaaagtacgcagacatgattaaaaaggatggtaagagattttatctaagccattatcctacactaataggtagaaaaaacatgtttaatattcatggtcatatacactcacaattaatgggtactgaatatcacatcaatgtaggttatgatgtagagggtaaaattgcctatagttttgatgatattataagtagagcaggtgaatataatggagaaattcaaaggtaaagatttatataaaactagaattagaaaacaaacaattaaaaatttagttataaaaacagagaagctacataataaacacggaaagtatagacctattggtcatgtttattattatccaaaaacaaaagagtttactttatctaaacctgagcagaaaatatttatagagtatatgaaggcattaggttttagtgttaaacataagagacgtaagaaaataattatagtatacaagaatgtgttagatgaatatcttagtatgtatcaggaagcaattgaaagtacgtgttgacaattaaggtatactatgctatagtatagaaaaggaggttaactgatgaagcattttattttgattttaggtattgtaattctagttattgcattaggtattgttttacctgcatggattttacaattagtattatctgcattcggtgttaaagtaagtatttgggtatgtatcgggatatttattttaatcagtgcagtaggaagtatgtttagtagaaattaaaggaggaactataaatggcaaaatatgaatcaaatatcaatggagaaaattatattgcaacaccgtcacaagctttaagagaggcattggcagaattaattagagaagaaaagaattttgcagagtatcaaactaagggtgaggaacagtatgaatcacagttacaactaagacactttgattcaatgatttctcagtatgaagaggctattcgagtactagaggatagatattcacctcagatttttattccaaaagataataaggaggaaaagtaattatgaaagcagaatcaatagcaagattttttcaggataaggtattacaaatagaagggtataaagtaagattcactcaagctagttcatcatatattttagatatagatactatggatgaatcagtattgtttttagatactgtagttttcactctatcaggcaagtacttattagatacgcacattacaattaataaacctgagacactaagttctaatgaattatacacagagattagtaataaactacaagagattgtaggagaccaaactaaaacagatatagagttatcaaaatactttaaggaggtaaaataaatgagttcagaagctattacaaatcatttattaaatttaaatcaaataaaaattaaagaatataatattcatgcttacattaaaaaatctgtttgttccggtattgaaaatgcagattttgaagtaagaataaactatatagcagacaaagaccctaactatattagaactattaattctattatttttgttgattacagtaaccgtaatccaaaagaaattttactacagtttaaagaaaaaattctttctattgtaaaagaacaggtagagattgataatgattttattgaggctattaaagatattaatacaaatcatgaactagagaaattagaaccttttattaataaagaatactattctatgtttaagtcatctattgaaaaagaggtaccagtagctttatcatctgaagtacttaatagatgtacaggtaaaacaagcacactagcttatttagctattgaaaaggatttacctttaattgtgtctaacaattctatgatgaaaatgcttaaaaaagattacccttctgttaaagtttcgtctgttgaagatttctcaaactataatattaaaggtgaaattgtacttatagatgaagtagatgtagaccagttatatagtgcagatagagtttctgttgatgcactactagtaggtatcataaaaaattaaataaatttgtaaatacctgttgacagcaggtattttttatagtatactttagatgtaaagaaaaaggaggtagtaatatggttggtattataattttaattgtcggtttaatattatttttagctagtggatataaattagttttaggtaaatattatgatgacatagatttaaagatgttatttacaatctttggtattggtgctatactattacttacaggatttatattataaaggaggaaattacaaatgaactataaagaagtactagaagttattaaaaagaataagccatgtaaggttagatttactggaagtattttagcaatcgttaataaggaatttaatgcagatactgataaaggtatactacaaattgatgtatcaaatattaataaaaatgactacattaagttacaacagtattgtttagaaagagatgattatactgtagcaggagctattttattttaaggaggagtaattatgaattatagagattttattacggattgtattagttgtggttataaagtccacattagtgttactgagaaaagagttcacattatttcagaaatgacatcagcatcttatccaaagaaagaaattaatttggatgaattacaagcttatgtttattatatgaataattttggaagtcagattacaacggagggattataaatggaattagttattaatattatagcagtattaattggtatgtatggtatttacttttatgttacaaaatttagtactggtctatcaggtatcttaattgtactaggtatggctgtaggtctttacttttacttagattacttaaatgttagagagaatgttattcgattagtatctgtaatgtttggtgctttcttatttagtatcgagatgatttataataagattatgtttgaaattaaaaaatctaagtatgataagactgttagaacgtacagaggagaccaataagaattttactataaagagtacttaaaataggttaagtgccctatatggtaccttaaaatggcttagaattgaaattaaggagatgaaaagttattatagctactaaatatattgtatctattgaacgatggtaaataaggaggagtagttatgaatgctaggaaagcacgtaagaacactaaaaatcataaagactctagtgtagtaactaaggagcaacacctaacttatatctataataagataaactacttgattgcaaatagtagtagtcagggtaagacatatgtggtaatgaacctaagaacaggttatcctgacgagttctctttatctaaattaaaatatctaaaagaaattaaacagcactataaagacctaggatttaccgtacaaactcaagtaagaaagtcacggtggtcagagaaaagtataatcaggtactactttaacttaggttatatagatagcgtgttagttcctattatacacattagttggtaattacaaggaggaatagttatggataatccaaacttaaataaaaagacactgagagctgtaataagagaaatggataaagatatagaagaaagagcagaagcattaagaagagaagagactagattaagtattgctagggataatagaaaaaggctttacattgaattagagtctatactagaggaggaataattatggattttaatttgaaagactatgctgtaagacctataacagacaaagaaggaaatatggtagtaagaacagtgtatgtgtgtttaaagagagaatacagtgattgggtagtagataaagtatatggtagacaagagagttctgaaacgtggttaaaatttatgcaagaaattagaaacatagagagagcaaaactaagagtggagaaatggcaagttaattagaataattagttaaaggagggaaagatatgagtttatcagaattattagagtatcataaaaatagtggtaaggaacgagcagagtatataagtgataatggtaattgtagagtagctattatgcattatgataaatgggcagttgtaggagatttagagaatgcagtctttacaattgagaagtaatagttatgtacttatttgctaaaataattattatatctattgatgttatacccttaatgtctattattgttgtacagttaattacagattataatgatagacattaagtatcgaatattgttgactagtaagaagaagaaaatattactattaagaagttaaagttacccgggaatattgttgactaacaataataagaagaaaaaaatattattactattaagtacctgggaattcttttacctctcccactcagcctattacttactaccgacttccctaactacttattctatagttatagtattcatttattatacaatacttaaactatagtattctaaccttaatctatgctgaagcggtattaatctattgttattatataataatcttatctaatagtggtataatctaggttattacattagaatgattctaatctagtattttaatctttagaccctaggaaaagtggtactaaaatatagaaccctataggtacgggattcttatttttaaaattactaaaaagtattaggttttccctagggtaaagttttaatgtacttaaaatcgtaagtagctccttatcatttaggtctgtttaattgagaatattagaagatatccgcttcaattacaattaagtgttgacaatcatgaagcggtatgttatacttagtatataaattaataggagatgaattaaatgattataccattaattatactcatgatgaccttcggtacatttgcattcagttatgttgcacatgatgcatacagggtagatgaaaaaggtatcatgtatgctatggtagttggtattgtagttataaatgtaattggtttagaaatgataattgtagaatgtttatagaggagatgatttaatatgattgatatttatttacacagtgaatatgataaagataagttaaaatttatccttaaagcaataagggatttttctcctagagaattaacctacgattttaggaatccaaaagcggatgttagtatccaggaactactaggagatgacatagacatatttgaatctatagcattagattaccctaatgatattaatatccttgtaggagatagtggatactcgatagtttatcagaatgattttcttacaattagtggattgagtacggctatgaaggaggtaataggatgataggattcacaatattaagtacaataatggttatcttagttatagctatgtacactcaggtgttagtagatatgattcagtcaatcaggtatgatagatttgataaggtacttaacatagtaacgtttatagttatgacagttgtactagtatcaggtattttaattatgtttgacatttagagcttatttaagaagcggttaagtagttaaggataaattggtctagaaatatactaccgcttctctatggctctttaaataggcttagaattgaaaggagatggaataatgaaagcaattgtatattgtgctaaaagatatagtaagcatacactgaagcatattttagaggaattagaagcggagaatagtgacttaacatttagtacagaaatatcagatttaggggaagtagatattgttgtacaacatactaaattacctttctcagaactaatggatttgtgtagtaaagtaagtaaagggtctgaccgcttctatgtatttgttggtaatcactcagggtattatataaacggtgatttatatatcaacgagataggtaagtttattacatctagagaaactaatgttatgatgtagaggaggagatattatgatagaaattagattagttgaaggctatgataaaagtcagttgaagtttatgttaaagaaaattaagagagtagcacctagggaattaacttatgatatagaagcggggatagattcggtagatgttaatattgaagatgtacttcctcataaatcaccccaggagtatgaaagatattcaatgttacttgaagaagacttatggatagttatacttgagtcaggttatatagcttactgggatggaaagaagtatggtggtgaagctttagatgatattatatataatatgtttaaagggagagggagactataatgatagaagtatttttaagtaaagattatgataaggatttactcaaagcttatttagagtatattagaaagtccgcttcaagagagttaaagtataatactaaccatactaaaggaacggatgttaatattgaaaatattattagttatactaatcaagaggttcatcattttagctcttacggtatgtatagagatgacttatgtgtattcatagataatacaagagtatctgagtatcttaatggtgaacctgtaggggtagatacaatatataaatatataaaggagatgtaatggatgtttaaagtatattatacagtttatcatagacaaagtatgaagactattaaggataagttagatagaagcggtttaatctatttcttatatgaaacttggtataaagatataaataatgtatgtccttctaactataacccggaatttggtagtcttaataaagatatagacatagatagattaattgaagcggttaatgaagaagggatactacttattaaccatggtaattatgttacagtagaagagtggtaggatgttgacaaatcataagtagtgtggtatgattaaggtagaaattttacgataaactcgtaggataaaaccgtaggataaaaaaggaggatagaatatgatagatattgagataaaaatttgggatgaaacccttaggatgcaggttgaagaagaggatgtactttccttcttatctaagtttaaaaataaaacaacaggtgataaagaagaatcttatggagtagggttagatgaatctaaatggaaagtacacccattctatacacgttatgaggtacaccctgaaggatacgttaggttgaaggatactaaaacacctgtaatatttactaagtatagaaaagaacttcaccataaaccacagtttattagctctaatataatggatgatgaaggtaagcatacagtagctctacataagttagttgctgatacatttatacctattccatggtatttacagggatataactatacagatttatcagtaggcttgaaggatggagattatgaaaataaagaagcggttaaagcatataacttagcttggtatgtaggaaggatacgaggtaatgctccaatgattaaacttatggacttagaagatgatagagtattatactttgctagtattcctcaaatagagaactttattagagataataaattagaccctaaacgttttaattacaaaactgaataaatgataagtagagagggcttaagtagtcctcttttatttaggttagaataattagtaagtagctcctcgtaatactaagtagttcctgattttttgatatagttgtaagtagtcccctggtaatccccccagtttatcccaaccgcttcaagcagaccgcaataagaatccccaggaattatattcccagggatttctataatttttttatttaattaagatatgtttcaatatattcttcataaattgcacttgctaaatcattgtacccgtctttttgtttttcctccattaaccaattgtaatctacacttaaactgaataaataatctttttcttttacatcaattaaatttcttaattcattctcaaagatattaacttgatacacatagtttactttttttaataggttgtgcacctctttattcaattcttctttagttccctcaaatttaaattccattgttatcaatccttttcatttagttgttaaggtgtttgattaccttacaaatactattatatcagattgaggataaattgcaataggtttttgaaacttttttaaattctttttgtgttgacttgatcgacctataacaactatttagtaggcttttttgaatatgttttttctgtttcttccattataaacaaaaaataggctcataaaactttttaaaagaatttgtaaatatgtattgacttattaatcatatgatagtaatataaaggtacagcaagggaacagcaacaagatattagaattatataaaaaaattatttaattggagatgatttaaatggatgtaaaagaaattgcaaatactataatggagttgtggcaaatggacggctacagatgtacagaaccaccattatatgaaagcacattaaaccatacacgcacatatacggctttaatcgtaagcattaaaggaaactatgacactgttcaaatgttccgcaaaacgcctataatgagcatgagagggcaagcccaaccggctagtatgttagtaaatgtaattgatgatgtgattataatcgtatatgaaaatgttgtttacggggtacagaataaagaaataaaatttattgaagaaatttaaaaataggggttgcaataccccttaagatgtagtaatataatagatgtaagggatagcaacacaccttaaaaaactttttaaaaagttaaaaaaagtgttgacaccttacaagatacatgttattattagtatagaagttaagacaagccacatagcaaataacgaaattaaataaaaaaattatagaataggatttgattattatgacaaacaaaaattacttatatgaagaagctcacacagtacaagggaacgaaattacggctttcagaattccaaatgacgcaaacggcaacccacgttatgtagtgcatttcatggatttaaatattaaactagcagactatgacaacatcaataaactttacggatttaataaatatcgtgctaaatggtttggcggtggtgtagtattccaaagctataatatagaagatacattaaattttgcactagataaagttaaagaaatagaagcggttaagaattaaaaccgcttctgaattaaataaaaaatttatataaaaaggatatgataatatgaaatttaaaatagaaaaaaataacagtgatataaaaactttatggaatttagctaaaaatggatatatgagttatcaaactgtacacaatatatttaaaaatgaatcagatgaatttattatatttaacagtaaacaaacttataataaatttatggaattaagatataatagaagtgcaatccaatagtataaaaaaattatacaattccctgggattaaattcctagggatttttatttgttttaatttatataaaaaaattatttaataaataagttagtgtaaaattgactattgacaaggttgtattttttatggtataatgaagtgaagaccttttttagtataaaaaaattattatataaaaaatttatattaaatggttttaaagcgggtctttctcccaaccttgtcatttatatagcggaagggttaggctggttaccgctgttttactttctatatatagaatactatgaataatggtaattgtcaacacctttcagaaactttttttactttcttttattattatataaaaaaattatacatattttagggctccacttccattatataataattcggtattaatgtcaatagataaatgtaaaaaagttttttaaattaatttcattaaatccattgacttgtgtttctttctatagtaatatataggtataccaacaagggaggcaatacaaatgctaaaattcaaatggaaaaacaaaacaattaaatcaactcaaaaaacggataacattctattacttattataggtggtttagttgcaacaatcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacactacatgttattattaaggtacaaggtaagggaagcggtcaaccgcttccaacctaaataaaaaagtttaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaacggtcgttattatgacggatatagaaacggtgagcttgaagaaaaatacgcaatcgaaattgagggaaacaaattagttatgcgtcactggggaacacaaacaattgagattgacttaggtatgaaagaaattgtttcatactatggagaaagcaactcagaccgtgacagtttaaacacacttgtatattgcttaggaattgcgccaaactttagatacttaccaagcaaagacttatttatttacgaaaattaattaaataaagggcttgacttccaagccctaccatgttattattaaattgtaaggtaatcaagcacaacgacaaaataaactgaaaaggaattgatgaaaatgttcaaattacaaaataaagtggaaattatcgtacctaaatatactaatagtggtaaagagatttcaagccctgcaattaaagaagcggttaacaatgcaactaaaatatgtggaggttgtacgataactgaaatcaagggacaatggtggtcagacgatgaacaacgtattatggaagatgacaacttaaatcttgagtggtactatgacaaaggtatgcaagacatgaacgaccaacaagggttattacaagccttatcaaagattgctagacaattgattgtattctatgaacaagaggcaatcagtataaaaattaatggtacactatatattatagattatgaagatttagatttattatcttatgacttatatgaattaatgtttaaaaattaaataaaaattttatataaaccgcttcggattaaattcttgaagcggttttttatgtaaaatttatgcttgacaaatgtattaaaaaatgagataatagagtgacaactttttttagtataaaaataatattatataaaaaagttatagagtttttaaggctccaagtccattatatcaattttactactggttgtcaatactttctttttttatataataatttaattatcttaaagataccgtccacctccattatctcaaattttgcccccaaagtcaagaactttctttcaaataatttatttaaaaaagtttataaaaagggttgacttattttgtactatagtgtaatatataaagtgtagtaaggaagcggaggaaataacctaaaaaaagaatttaaaaaacttttaaaaaggtgttgacaaacttccaaatacatgataatattaagatagttagaaaaacaaaaaacgaaaaggaattgataattatgaacagattagaaatagtaaaagatacggcaatggaatatatccttatgatggataacagtgttatggacggcgttatgacacaagaggaatacaacgaagcggttagctttgaaaaggtgtatgactatactctatcagaagcaaatcaagaatgtaaattcttaggtggtaaggttttaactttcctagtacatgaagcaatcgaagaatacgcataaaaaaacttaataaaaggggttgaatgtcaacccctaccatgttaatattaatatataccaaatgagaggaattgataattatgagatacgaaatcgtaacattagttaatggagaattattcatgtttgcaacatttaagaaagcagaggcagaaaataaatatcaagaatggtgtgacttgtacggtcaagaaaatgtgagcatggaaaaaaattaaaataagcggttgacaaactaaccgcttcatggtaatattaaactatactaaagaaaaggaaatgattacaatgacaaaaacaatcaaacaattagaaagccaacttgaaagactagaaagaaaatcagatgagcaactagcaaacggatattatgaagcctttgaaagaacttgcgcacaaattagagaattagacctacaaatcgaattaaaaaagaattcagaaactgtttaaaaaaattaaataaggggttgacacttaaccccttagatgttattattaatacataaggtaaaacaaataaaggaggaaaacaaaatgatgatttggatattgatttttatggtaatcccttttgtacttggattcattaacggttggaactcagaagaagaaaattaaaaaaagtgttgacactttaaaaaatacatgttaatataaatatatactaaagaaaaggaattgataaaaatgaaattattaaacagagacaatgaaatcgtaattagcatagcaacattagagagcgtaaaacaagccttaatttgggaatacatcgaccacatagataataacatcctagacagtgaaatctatgaccaagaagcggttgtcgttacttctaagactctacaatcaataaaatttgcagacactatggaagacctgcaggaatacattgcagatatcaattggaaattagtttaaaaaagttttaaataactgttgacaccttagcaaatagatggtaatataagagtataaagaaaaacaaaaaaacgaaaaggatttgattataatgacaaacacaataaaaggatttttacaaacagaagaagcaagcacagttaaggacgtagcaactcacggagtacaaagcggagcaattggcagattaatctatacatcggacgtagtaaaattctttgatagacattattcagatattgaagcggtagtattagacttcttagaaggctttacaggtcaaagatactatgacctattagattatgacttgatgagagaactcgaagagcatgcaaatgtagagtttgaagacgaagacgaatataataatattcaatttgacttagcagaaaatattgcttctgatgagattgaaggattcgaagacatggacgaagccgagcaggcggatgcagttatcgaagctatggacgatgtagaattagagatactagacacggataaggtgcagtttgttaacttagcagttgagattgtagcacaacaaatgcaagaagcataagaccctgcaggaagcacacagagacacacagagaagcttaaccgcttctctaatataaaactattaggagatgttgaacatgacaattaaagagattataaaccaattacaagcagtagaaaataaggaacttgaactattcgtatgtgacaaggaaggaaataacatttcaattaaagatattactttgtttgatagtgaagcggagcacacagaaaacaacccattagggattaactattaggaggtttataattgaacattagagaggttcataatgtcgttaagagtgcaaagagcaaactcctacaggagcagaataatattaataatgtaatgatagatgactacatcacagaagagcttcacagacgcacacagagaagcggaacaatacagatgaacaataacaccgcttcatatagtaatggctcatatggtagcttagaagagattagagaagcttatgacctatcttcattatctactaatgagattaaagaactgcttgaaacatttgtttaaattattttatcaaaacgctttacaactatttaatttgtatgatataatgaacttaacaaattaaaagaaaaggaaatgatgaacatgagagacttacaagaaagaaaaagagaattgaaaacattactatttaacttagctatagagaagaacagagcaactgacgagacactaagaagtgtattagaagaagcccatcaagaggtaggaaaccaactaagaaaagtaagaaaagaaattgaaattttagttgaagaaaaagaaagagaattttggaacgatttcgactttaatggattagactaagagggaataaaatccctcttttatttttatcctattatataatttttttatattatacgggggcaggggtaaaatgccactcaatgggggtgggtctatatacccctatggtctacccaggtacttattttttggggaaaattatgaaaataaatattctaaaagtcaacacccccctattataagtcaacattacaaccctaccctataagtcaacaatttataatataaatagatagcccttaaatataaagtcaacatatctaaaataaaaaagccacccctttaggagtgacttagtgttttaatattttatttcttctcctaaaatgagtttgttttgataactacctaatcttgtatatatcttactattagggtctgatgaatttatactatttgtgctaccataagctatacaactatctaaccacatatgactacctgatgaagtttggaaatctttgccttggtaactttcgaaagcggtacatcctaaattccaagattctgtaccttcatttacatctgcgacattaccgccatcatttctagcataaataccgtttactcgtatagctttaagaccatcatgagttgtggaaccattatttgatttagtacctgctgttcctttttcgaatccattttctaaagctgtacaattaatttcaataactaaaggtttagagctatctgcacctatatgataattaaatccatccatatagttattattagctacactattattgacgataacttctttacctccaacaatttctaaaccattaccattgacttgggaagcatagctcagtacacagttattaatatatacgctattgtcttggtttaattcaaacctagcaggtctagctccaccgtacagatttaaattttcaatataaaagtcagttggtacactagatactattaggtgttgggatgataatagcggtacaacttttttgttaggttctatggaaccgttattaacataaacttttgtaccatcagagtaccaagaaaaaagtgtcgtatctactttatctaaggaggtaacatttgtaaactccctatcattattaaaatctactacccttctaacggcggaacgtgtaaattcataagtgctatctctacctgatgttttagtccaagttggctcatctgccataaataagtttacatttgagcccaaaccaataatattaatactcttattacttattggtggaagcaatgtgcctcctactctaaagtaatccccgtcactaacataaagtgtatccccattatttattatgccttgagcttttttaaatgttttaaagggggttgattgagaaagaccgtcattagtatcattaccattttctccatcaacatagtaagatttacctcccctaagtttaaagttctccatatttaaagaagtggaaaacttacctaaaccatctgtaaaaatattattgacaagcgggtggtctttaattaagtaatctacaggagtgaaaacaggtattttatacgatgtttcttttttcatagaaattttcatattatcaatttctttgattaatcctttaatgaattcctcattattaactgtttgtattttcttagtagaagaaccatcaaaaagtagaaactgttttatatttacaggtgaagtaacttgtcttgtatctattcttaaactaattttgcttgaattttccgggatatttatattattaattgcaaatgtcgtgtcatttattttattaagttgagtaattgtttgtatatatgaaccatcagaatcttgtattgaatactcaaatgatgctttcgggtcaggtacgtcatctgttattattttagcactaaatgttttacctggtgcaagtttttcaacagctttaactgtgtaaaataaccaaccatttgaattaagtgtaaaagaaccatcggggttcatggtattttccggtatactgtttctaattgtaatattagagaaatatgttttatctactgttgatgggtataaacgaatgtcttctccattatcagggtacactattaaactatcttccattgttttatttacttcttgtaaattagagtcactaggattaacaaaaactctcaatgaatctaattgttcttcggtaaatctatcaaaagtaaagtctttacctggttcccctgttttacctggctctcctggttttcctggctctcctggttttcctggctctcctggttcacctttaatggacttaacccattcttcttctgtacctgtaaaaccattatctactgctatatcataagctgttttaggtttaacagttaagatgtctttagcataaaaagtaatttctttgtaagaagattctaatgtagtaaattcaggaactacagttttttccgactcatagttatccccttcccaagaaacataaaactccccttgagggtacttagtatgaggttttaaatttggtataataactgaaccttgctcagtatatacattataacctatggctagtatattgccttctttatcataagcttttaaatgtggcatttataaatctcctattctaatgtgttagtacatataatatatcaaattgaataaaagaagagtattagttacccttctttatgtttatatcgcagtctacgatattaagttcatgaatagtaatcatatccattccatcgaatcctcttgggtctcctttaatgaactcttgttctcctctataattagtctcttccctatacccttcttctttaatacgtttaattaatttttccttatttgtatatacattgtcttctctaaaatgaaaattatcttcataaggttcacaattatcatgttctacttgatatagtttcattcatttgtcctcctttactctctataataatcatatatttctaagtaaggtgaaaatggtgaatcacctctagtattaataataacttcaccttcatgtttacttatctctgtaagctcttctagactattaatttctacacaccatcgttctagtgtaaatggattacctttttggtctacaagttctagtttctttatataggcaccctctataggctttttattaatggtgcttgtcctatctataaaaaattccattagttttcctccttttcataagaccattcaccatattctgcgttaaaatgggctgtatccgtaccctcgtcttcatattctacactataccatgcatcctcttctgtttctgcatctatatatcttacttcctctgtagtaataatacgttttactttaaatctctccatattagttttcctccttatattctttataacttttaataacaatcttacagatacctctattaacagctaaaaacaataaaaatgataacagagttataactgctctagtatctcctgtgaaaggtaatactttaaatagtaaaacactttctaaaacacttgtagctgtgatagttgttaggtataagatagttagtaaataatcttttaattttagcttaacaaaaggttttttattatcttgagttcttactataccatatagaattataaaccattctacagttacgagcatagttataaagtaattatttatgtctaatgcatataaaccataaatgatacctgcaggaataccaataatgaatgctaaaaatacagagagtataattagcattataagaagagctacaaggaatcctaagccttgttttgagtactctagtgtattctttcctatggctttaaagaatgttttattcatctgctacctccttgtaatatacagtatctatatggataatattgtctttgaaccatatagatgtatcacctttgttagattctaaaaatttaacaccattaaaaacaagacccccgataaaagaatttaaattagttttagtatctttttgctttataatagtagaagtccctgatacatcatgaatccttataaaattaatatctttttttacttcctcttctttatgttttttaaatatcattattcttcctcctttatattctcttctaatatttgttttaacgtctgacaatctttttggtctaaagtattccaactttctagattttgtaattgatagtgaaattcatttacaatttcatcgaaggcttctgctttttggtagacttcttgtaactcttctaattctttttcattatcaatacaccagtagttctcgttgtcagttataatatcttgaattttatttttatattcataagccattatttatccctcctcttctatagaattactttccgtaatagttacctctagcatgttattgtaatactcattcttttgattgatattgtagtagtcattatattcattaaagtctacataagtgtattcatttgtatcatcatcataaataatatctatagctgtaatatctgagtatgctgtaatcatttcataagcatttgtattatccggataagcaaaaccaacttgagatatttctttagggttatcaataagaataccaaaataagtacatctacgtgttcgacttatatgtgaagtaccatagtaatctataccttctgtaattccatctacatggaacctttttacatctttaggttctagtcttacaacatcacaattttctaatactaaatcaatatattttatattcattttaattctcctctttatttaaacctattatatacgcaatggactctaacatcttccattactttacctaatagattctgacctttccagttgctttcatctaatatcttagggtcatttgctttaatacctacaccccatattttatcatagggtgatgcttctacgaaatctttacgtaaatctgtatctagtattttttgttttaagtgtgtagtcataaatttatctttaaccacttctaccataatgtcatatctcaccttattccattgctcttcattaaaattacgaactttacgacctagacttttagcatggttcggatgcttagcatttaatatttctcctgctatttgccagtctttaaaatattgagctttacgccacataaaggcttgttctgagttattaaatgttcttcctttgtgtttaaatgttattgggtaaaagttagaatagatatcttccttaccccaaaacataatgtattctttagtctctttcatattatctctcctttaattccataatgatggtaatacgattttaaagttatctagaattttgttttgtacctgttcaatctcgtcctcattatcaacatcaaagctatccattgattcgtggtagaattgaattaaacttaatatatgctttatcatatctatctgtgttctttcttttccttctatatcagtaaatgtatggtactccatatccacatgattactactttctacaaaagcatttaaatcagcatatagttgaataaagaaggacatatcatagttccaatatttaggttcatttctacctaattctttattcatttttttgtattttttattcttttttaatccaaaaacttctttttcaaagtcatttaatttaagtcctttaaaatatcttttcttcatgagtttccctccaatttaataaaaggtaaatctatatccctgaatacagcacctacatcacacattaacatgtctccattaatttctacttctccactgtcagttggtgtatgaccacatacataggtaaaaccatcttttctaggttgaaagtctcttgaccatattaattggtcaattgtttgttcttctacaggcttccaactaaccccgcctgaatgagagaatatatacttgtcttctttatagtactttctacaattaaccataagtattttaaattttctatagtcgtctgattctttaagtttctttagttcacttttaataaaatcataattacttcttaggttttcttctacactactatactttaaagttaccgtactcacaccgtaagagttaagtgtttctatacaatatcttgagagccattcaatatcatagatacttaatcggtctacgttttccataacattataaaactcatcatcatggttccctaacagagttactacattatcatcattagacattaaatcaaatatatagttaacaacgtcttttgaccttttacctctatctacataatcccctaaaaatactattgtttctttaggttttctttcattgtttattttatccataattgttaataatttttggtattctccatgaatatcgggaacaacgtatatagccatctaatctcctccttattgtatataactatcttaccatacttagtaaaaaaagtcaataaaaaaacacctattaatttaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcatcagtaagttctgattctgttaactccattgtatcataatctttttcgttatagaatactacaacattatgttgttctatactagaatctccgtctttatacttagatataaaaaatccaatatttcctttatgctctaaataatctgctttcataattttaaatacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggagggacactaccatccggagtctacggtcagatacaaagcctctgccgggcaacatacggtatctctcgtacatcaggttgactagacctttagagtttttcactccttctcttataaccagtaacttaggagaaataggttttacttagtagatatgaaacaataaatccacatacaatattaaatcatagtcaagtgattgcacatatgtctaatacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaatagtataccataaataatacttaatgtcaagttaatttatcaattgaatccataatttttgatgtacttcttatatccgcttctttactgtgtttaagaagatatttt

SEQ ID NO: 561 - protein, 155 aa, Unknown
  Description of Unknown: Bacteriophage F44/10
MKKIYILEEEIEEMDYDLWEEDTVYTTSYEVLGYTDSLEDAEYIKNNYGTSNPIFINEYPYLTKDKLIEEQRYYRYNSAIELKRVDGYFEVYEINDLNVTECFSINKDDISFDCPFSIDMFSSDRNSIFIEFMMYSEYDNKKDTIEKEKNSFLMK

SEQ ID NO: 562 - protein, 72 aa, Unknown
  Description of Unknown: Bacteriophage F44/10
MKKIINFLVDYNINFSYSEDSLNVMGNSYLVDKHGTQDYEIIGNYGHITGVFSYQTEEEVIAKLKNLIGVWE

SEQ ID NO: 563 - protein, 64 aa, Unknown
  Description of Unknown: Bacteriophage F44/10
MRDKRIHSELLYNIIGKHIQEEENITPYIEAIYVDIMNIIVVEYTFYNENGTRMLGQYPIGEVM

SEQ ID NO: 564 - protein, 245 aa, Unknown
  Description of Unknown: Bacteriophage F44/10
MNLEKSFLLSTIEFGSTYQGTSDEYSDKDYMSLVVQPLSDTIFRNSEKASKHTEVSRYYAVERFISLVLKSGFDNVLNLCAQLEQAKNTRFNKTVLDLFYDDFIFLTYVRANFKPIAYSVIGNINNILKKEELAGKDLVKFYTFYNHLEYYNDLLDDLDNLNVSYKDFAKVKYMPKEVLDNKRSNVSIENKKDLVTKVEPLIQEVKDKLKSNESNIKHYKDAMELVEKSLKDKTVSFLTEVYNER

SEQ ID NO: 565 - protein, 34 aa, Unknown
  Description of Unknown: Bacteriophage F44/10
MKYILGLITLGVILFKIYEYFKYIQDEVDTTEDI

SEQ ID NO: 566 - protein, 75 aa, Unknown
  Description of Unknown: Bacteriophage F44/10
MDFYQFLNHENVRVNSITPSQKNFIRENIDYTNLDTVDIDFMNSKQAKKEIEKIIRTKNEEEYDMAMDALSGWEG

SEQ ID NO: 567 - protein, 128 aa, Unknown
  Description of Unknown: Bacteriophage F44/10
MFGKAPEHIMEIIDKEDNILGEDLTLNIDYKGINLTVKRHPHSGHLNGYINVPTNITKEQFNSIEDCSHGGITYDEHEGDYRVLGFDCAHYSDMTPYAVISFSDSYYRDLKYVLNTLKDMADCLKEGE

SEQ ID NO: 568 - protein, 57 aa, Unknown
  Description of Unknown: Bacteriophage F44/10
MEKVNHEFLAELAKSNSPVLNSKPLQDGDYNIEFDYDGFHFEFSQKNGYWQWKYNAK

SEQ ID NO: 569 - protein, 160 aa, Unknown
  Description of Unknown: Bacteriophage F44/10
MANEKELIRMVNYLIDNMSMWHINYARAVLIPSEVEKIIKEHEKFDDLLKKRGEWLVKGSDTDNIDDLETYNQIMNNQKDEMMIQEIDIYTQGKTIKVDNKHYSSNELNEVINKIEQSEDIKIKSNYKLLCIDYTKVIGYEVTYASSYEEKFKNDLEKDL

SEQ ID NO: 570 - protein, 180 aa, Unknown
  Description of Unknown: Bacteriophage F44/10
MDRIIGKHNLTQDLRLGDKVEVYDAHKFKENEDGTIELGDKVTEGIVVDYKGDFTGNTSGLVTLDSSEEELIIGEHNFKLIEEGNLQAVYDSVSKNKVESLSEDYDMYRKLLGVKSGELEDISYELERLIMEYNKKVDNYNGLLTLSKEKARELSLLTGDRKMIPHMKNKRLELGTEADF

SEQ ID NO: 571 - protein, 177 aa, Unknown
  Description of Unknown: Bacteriophage F44/10
MVYDSIISRTMAVSILNKWIAELITDVDLDKCKFTEEEYGKVVTNSINKIQDVLIEKNYEVTDGELYDIVCTELINPIKNNTEEEKHNEKNDLLEHLEDLAFRHDIDLGYVSDGSYNLTVTHWLMQDEFTDVNIKVNKDEDFYTITIPESKYFWLPITKENLEMFLTQDPINKGEIE

SEQ ID NO: 572 - protein, 54 aa, Unknown
  Description of Unknown: Bacteriophage F44/10
MKNLIKFLSMVVVTILTFSLTYVILKKETNNKRNGVAPFDFSLEDHIHLNKEIK

SEQ ID NO: 573 - protein, 92 aa, Unknown
  Description of Unknown: Bacteriophage F44/10
MVNNIWAVVLSIIILLIILLILWFLFRKKVNGGSSKNVEIQKAEEGNDNKEQEVEEAQYRELNEEEKEKNENSSKDYKYDKEKVKNKLKELE

SEQ ID NO: 574 - protein, 281 aa, Unknown
  Description of Unknown: Bacteriophage F44/10
MGRRLIDNSELNVIKYDGLPDFFSALKKNRVSGRENSSDTGSYDFTGTHSFQEAYNLMVKGDRESYDMVVKLKKMTDALFRMDKSVKRKPVVAPEGYQPHVPNAIKGLPNSMMSQQRVKAEKKVIDVFYNSSISWMEDPENLAYRGAIMLSAIQTLETKGYSINLYLGKLSNSEYENKLTGFVVNIKHSYQRLNVFKSSFYLVNPSFLRRISFRVLEVEPDMVDLTNHGYGSVVSKSSYGNKLTEHILDNAVIFDSSIGIDINNDSSENLRAVKKLFGGRL

SEQ ID NO: 575 - protein, 372 aa, Unknown
  Description of Unknown: Bacteriophage F44/10
MAKQDTIERLERLVEQQMETTADLAKKLGEKNSNPYEQAIVDAIVEKAGTESREIIITDVKKQIEEYVEEQLSNLPVKIELQQEGKTIKDISGIFHYRYQDILKLVNQNIPVFLKGGAGSGKNHVLEQVAEALDLDFYFSNAITQEFKLTGFIDANGKFHETQFYKAFTKGGLFFLDEMDASIPEVLLILNSAIANKYFDFPIGRVTAHEDFRVVSAGNTMGTGADHIYVGRQQLDGATLDRFAQVEFDYDTKVEHQLSSNEDLVNFVQQLRHENDEKGLPYVFSMRAIINGSKLDGVMEDEFVVESIIFKSVPKDEINQFISSLPEGNRYTEATRKLLGMQQEPKQEPRKSNSTSKDSMDFDTIMDKLGLE

SEQ ID NO: 576 - protein, 108 aa, Unknown
  Description of Unknown: Bacteriophage F44/10
VSKRTDNFIYFCKYYFSEYLPSLGVEVLNHNETSHGTMEGVRKYYIANILYEGQELTVTIDLEEFNNATSMHNMLEIMNSHTYNCMFMYDMDTHGTKDIDDFFKLMYF

SEQ ID NO: 577 - protein, 138 aa, Unknown
  Description of Unknown: Bacteriophage F44/10
MNAKEFMKTQAQVEDYLDKLKVTIIEDALSVSKEWSNDSNDLGYALSSLGESIGLLEDYYNIQVDAHLPEHYKGSKDVISFLEEHFSYDGFVDSMIFNIVKYTTRLGRKDAVDKEVQKIKTYYVRLERNIKYGDSTRV

SEQ ID NO: 578 - protein, 100 aa, Unknown
  Description of Unknown: Bacteriophage F44/10
MEKVELIKQWAKDRNLQTGKPEGQMLKLLEEAGELASGIAKSNDHVTRDSVGDIFVVLTVLCLQLDIDIEECIDMAYDEIKERKGKLINGVFVKEEDLKK

SEQ ID NO: 579 - protein, 62 aa, Unknown
  Description of Unknown: Bacteriophage F44/10
MEKFQEDYVNIDIRVKAYVRVGYRYEEDITNNLHELVEDNLNVTSDSDNLIIKDTEIKGDIE

SEQ ID NO: 580 - protein, 53 aa, Unknown
  Description of Unknown: Bacteriophage F44/10
MVKPVITLEPEDVKVLLDYLSFLEDDMRNYEGMRELYEELHKKYQLAKGNYSD

SEQ ID NO: 581 - protein, 682 aa, Unknown
  Description of Unknown: Bacteriophage F44/10
MAITYKQKGLTEQEIINLPKVNKGCIYIGEEDVFLKKKKNNIINLGSKELFRDIHNIFSFDTATEIHLFLALCGNKEVTNFEGDPYETVEKLVEGVIGNNKGRNYKEYIEADRGERKDFPLYGSRRRKQIQSKGYVEEKIKELENENRLWGYEARQLDEYKEAVDSLNNDIMDVLDQGKYVLINSSIIVMNEDIEKGSSEYYKEMSDSLYSRVWYMHPSTENNSSFGLKVRHIRDKHNMGNKWVLENKSSFDVKTGAVKVFLTDSLVNKEIALNLYKDDISKSEYKNELTLSVLLNVILKNYSQPNLNRGIIIKIIEQTLEHHNFDFSSWCPDNIDVYGHINYRGDKYRIFIGENSTSNYLITLTDIVKNIDKINNLEEFGLFERNALLFHIPKNPKWKVHEAFNLTKQTYKKLLTLNKFEQGNYLRFANTLYKNYNHLHNEVNLHQLFDDTFLMVRDSRDVTNALKVKPIVNEILSISFANYKKMTHYLDVDAQDRQRITGYALDNYYLDYLHDLSILIREGYRTLESVNLTPFSLKLEHDIVTDEKQSIQQQLDDAELKAKYDNKLEKIIDKTYKLKDGRKVKFLPADTVSKLKDEGKMLSHCVGGYANRILKNSCLILLARLEEDLDNSWFTVEIRITDNGYVLGQQQSIDAYKLPNELKEALEKDIKKINKEEFKEVA

SEQ ID NO: 582 - protein, 87 aa, Unknown
  Description of Unknown: Bacteriophage F44/10
MSIEKKEEIIAHNEVVFRSLTQGLYVKEVDIYSDVVSYTKDVDEALAMPNTINFKNSRKYEKLIRNLDLEPLNKIQKVIYETHLEEL

SEQ ID NO: 583 - protein, 57 aa, Unknown
  Description of Unknown: Bacteriophage F44/10
LNDLIKEGNKYYHKVRAGETLWTISKNYDVEIKKLQELNNIKSVSLTNLEYVLVCVE

SEQ ID NO: 584 - protein, 192 aa, Unknown
  Description of Unknown: Bacteriophage F44/10
MDNLSHYLSILYAILVTVGYIPGLIALVKSDSVKGVSSYFWYLIVATVGISFYNLLLTDATMFQVVSVGLNLTLGIVCLLVASYRKKDYFSIPFIIVFSLLLFLLSDFTALTQTVATITIILAYVTQITTFYKTKSAEGTNRFLFLIIGLGLASLIVSMVLTHTYVHIIATEFVNFVLILICYLQANYYSRR

SEQ ID NO: 585 - protein, 207 aa, Unknown
  Description of Unknown: Bacteriophage F44/10
MVNKIKDKVIYMGGHILNEAMVDYRDKQHKEVDGIVGVTPYSPHKDKSINDKANAEQTKLAERILTNDFKAMQESDIFVFDVLNEGLGTIAELGILLGMKHQAQETIKQLKEQSELFKFNEIDELSETYDILQGQIGEQEYILKKPVLIYCSDIRQGHGKPYNDPDRAEFSTNQFVYGMVLELTNGEGFISWEEVTNRLEKLGEQDG

SEQ ID NO: 586 - protein, 298 aa, Unknown
  Description of Unknown: Bacteriophage F44/10
MKSYTKVKNKGIVLDKFKERGLVVQEKLDGSNASFTVENGELVCFSRRKKLNENETLNGFYDWVHENINVRNTYVSALEKYIIFGEWLVKHKIQYKEEFYNNFYVFDVYDKENEVYLSIEDMNVIAHHLGLKTVKTLLVAKPSHYLNDLKPEEIQELVGKSDMTVKPDKGEGIVIKYLDGKSEYDDYFKLVSNEFKEFSRQKMKTEVKKNESVADYAITRARMEKMIFRAIEEDRLSEDDLELENFGLIMKQVGQNFVDDIMEEEKENILKIVDKQIKKKMPHILREILEEKGDTIDG

SEQ ID NO: 587 - protein, 74 aa, Unknown
  Description of Unknown: Bacteriophage F44/10
MNYLAKVFINNNWLVKLITIVLLTLFLSGLVYVISAISLFLSTVLNLPGLVVLAFLASVSLILFSIVHNSKEDN

SEQ ID NO: 588 - protein, 246 aa, Unknown
  Description of Unknown: Bacteriophage F44/10
MAIQLKELDFKLKDYPNVRYNMGEHLIFNEFLEKATTEQLDFCEDFFNDNVEILWNESQAGTGKTMCSVACAYADYLNKNRKLVFIISPVSEDLGSRPGNQTEKEMAYFMGLHDALIELNMNPEQQITEMLMMEDNVKEDKLGDCWVSQISHLFLRGGNLRDATIIINEAQNFKRSELKKVLTRVHTKNSTVIVEGNFKQIDLKNESKSGFGDYMEYFKNYEGAVFHNFTVNFRSKLAQYADNFKW

SEQ ID NO: 589 - protein, 204 aa, Unknown
  Description of Unknown: Bacteriophage F44/10
MKKINSVIKGEGKKVQTADVRKISYYVKDYNPCMTVDDANDYNATSQYLVSDNGKFIAKYNKDMNAVGFYEESGDTVKHLTHTTPERLEGTVFTIEEETEIDLINDTLPQGDILIKFSDGSIYLPDNESVLDSVNYLADNDWDSVDDIIYTGLSKGNSENCIVDFNYNNYDIGYDDVEDEDVCDNYPECECSNYCSSTGEYIGN

SEQ ID NO: 590 - protein, 141 aa, Unknown
  Description of Unknown: Bacteriophage F44/10
MQDSVNIYTDGSSSYNKGKVGSGAVLVSKEGNIISEISKSVDKPGLIKYNNVAGEILACCYGIEEAIKLGYNQAIVYIDYIGLIHWYEGTWSARNILSKTYINMIREYQKVIDINFVKVKSHSNDKWNDYADNLAKKSIDI

SEQ ID NO: 591 - protein, 63 aa, Unknown
  Description of Unknown: Bacteriophage F44/10
MKKGVFTVIADGFKFNVIAKDKKEVQEHCFKCFDFNYISVSFCREVYSDCEFPQFMEDYKYAG

SEQ ID NO: 592 - protein, 213 aa, Unknown
  Description of Unknown: Bacteriophage F44/10
MENNNLVNFLMTTDDIDDTIEMVDSFELQDINKVLGEDTFLTIMEITDSLPDNQYKIVLLSSLDKLLNTDRKELVEYDEEFPTIRKHNVSELKRDTVNSVIDSYMNTNIEILYTEYPTISNYSVVVDSVKVLNTLYLIESKNGKIEATLSEDGEDLHEYISEEGYSVTDILNKFDDVEDLFDEDDSLINFFSDIDEGKNKTIKSFIELVINLK

SEQ ID NO: 593 - protein, 76 aa, Unknown
  Description of Unknown: Bacteriophage F44/10
MDEKKESKPLNLQKIRVEKGHTLRSLASEIGVHYSLISYWEYGKKKPRSANLMRLEKALNTPGKELFKELEEDDGE

SEQ ID NO: 594 - protein, 75 aa, Unknown
  Description of Unknown: Bacteriophage F44/10
MNKFKRWFRINVLKKETLLFKVYWRYESPSLKKPHVFHIELYAKSKAEARNKSQEYILKNAKESEDFKFLKVEEK

SEQ ID NO: 595 - protein, 230 aa, Unknown
  Description of Unknown: Bacteriophage F44/10
MKKTIFATLALGTAITFGGIATNEASADEIDYNKLAEQAKSNSAEVNTKPIQEGNYDFSFSDGEFTYHFYNYNGNFGYEYHSGSTQVDNTVSRLAGEEQTPEQKVDQQQAQFDTQNKQDTKKEVQTTSAPVQKETKQPTQSTSSTGGSVAEQIRQAGGDEAMIEIAMRESTMNPNAVNASSGAQGLFQGLGKSWSGGSIAEQTKGAKQYMIDRYGSTSGALAYHNAHNSY

SEQ ID NO: 596 - protein, 264 aa, Unknown
  Description of Unknown: Bacteriophage F44/10
MRKSVVISGVLGFLAIIGFIILLMCITKIPQGHVGVVYSVNGVKEDTKSPGWHLTAPFDKVNKYPTKTQTHKYKDLNVATSDGKNLQMDIDVSYKVDATKAVDLFNRFGSADIEELEKGYLRSRVQDNVRQAVSKYSVIDAFGVKTGEIKKDTLDSLNDNLEKQGFVIEDIALSSPKADKNTQKAIDSRVKANQELERTKVDKQIAEQNAKKKEVEANGDKKANEIRESSLSDKILRQQLIEKWDGKQPIQIGGDGTIVDVTGK

SEQ ID NO: 597 - protein, 102 aa, Unknown
  Description of Unknown: Bacteriophage F44/10
MALLLTYFAIFIVFLVLVGFGISYLFDFLSMKEKKSNIRKQYRELVRQGTLDEYGLEQYVKYKKQFLNDRRQSIVTRADKQEIDQEEKALNSLIKEIEKGEM

SEQ ID NO: 598 - protein, 495 aa, Unknown
  Description of Unknown: Bacteriophage F44/10
MAKTQAEINKRLDAYAKGTVDSPYRVKKATSYDPSFGVMEAGAIDADGYYHAQCQDLITDYVLWLTDNKVRTWGNAKDQIKQSYGTGFKIHENKPSTVPKKGWIAVFTSGSYEQWGHIGIVYDGGNTSTFTILEQNWNGYANKKPTKRVDNYYGLTHFIEIPVKAGTTVKKETAKKSASKTPAPKKKATLKVSKNHINYTMDKRGKKPEGMVIHNDAGRSSGQQYENSLANAGYARYANGIAHYYGSEGYVWEAIDAKNQIAWHTGDGTGANSGNFRFAGIEVCQSMSASDAQFLKNEQAVFQFTAEKFKEWGLTPNRKTVRLHMEFVPTACPHRSMVLHTGFNPVTQGRPSQAIMNKLKDYFIKQIKNYMSNGTSSSTVVKDGKTSSASTPATRPVTGSWKKNQFGTWYKPESATFVNGNQPIVTRIGSPFLNAPVGGNLPAGATIVYDEVCIQAGHIWIGYNAYNGNRVYCPVRTCQGVPPNQIPGVAWGVFK

SEQ ID NO: 599 - protein, 167 aa, Unknown
  Description of Unknown: Bacteriophage F44/10
MANETKQPKVVGGINLSTRTKSKTFWVAIISAVALFANQITGAFGLDYSAQIEQGVNIVGSILTLLAGLGIIVDNNTKGLRDSDIVQTDYVKPRDSKDPNEFVQWQTNANNASTFEIDSYENNAEPDTDDSDEVPAIEDEIDGGSAPSQDEEDTEEHGKVFAEEEVK

SEQ ID NO: 600 - protein, 61 aa, Unknown
  Description of Unknown: Bacteriophage F44/10
MASAKQLYYTESLVGKAIINNKVSNKEEVWDKLELLPETKLEDLDNKQMSEVIKKLNQINE

SEQ ID NO: 601 - RNA, 72 nt, Unknown
  Description of Unknown: Bacteriophage F44/10
acacccuuaguauaauuaguaguacaagggucuccaaaacccuuagucuuugugcaaaucaaagagggugug

SEQ ID NO: 602 - RNA, 73 nt, Unknown
  Description of Unknown: Bacteriophage F44/10
gguuucuuagcucagaugguagagcacuagauugaagcucuaggugucauugguucaaauccaauagaaacca

SEQ ID NO: 603 - RNA, 74 nt, Unknown
  Description of Unknown: Bacteriophage F44/10
ggcucauugguguaacugguuaacacacugcccugucacggcagagaguacgaguucgagucucguaugggucg

SEQ ID NO: 604 - protein, 72 aa, Unknown
  Description of Unknown: Bacteriophage F44/10
MKRQKMFYSSLICKECGNVFKVPRKRANKREEGHIKDIYCIKCCKTTKHIEDNRSEAERRWDAIQEELTKDN

SEQ ID NO: 605 - protein, 69 aa, Unknown
  Description of Unknown: Bacteriophage F44/10
MSKHIEITMSSGAKYFLVSTDEKSYNRQDIDYMLRGMDETSIKVYTESAITSPQVYINPNRIESFKIVF

SEQ ID NO: 606 - protein, 110 aa, Unknown
  Description of Unknown: Bacteriophage F44/10
LDKEINNLVSQVETIKSKIQEGNYIDRGTFKDLEVEVAELRKMIVSIDKDVAVNSEKQSAIYVQLERLDEKISELAGSTKTKDTKKKDTTEKVLLLVLGAILSFVFNKFA

SEQ ID NO: 607 - protein, 108 aa, Unknown
  Description of Unknown: Bacteriophage F44/10
LTKYKDILKLEFKDALAHFKRDRRYFHVYRIDRVLINGSIIYFDYYYLPSDDPNIVIKELDLQSFGKLRFEIDTKTSYGKVVTDNYMEIINDFLENYDIHSESETVRP

SEQ ID NO: 608 - protein, 128 aa, Unknown
  Description of Unknown: Bacteriophage F44/10
LNNNIAIFIFKTLVIIIFLLLILSVINSLSLIYSIRPSVVMTYFIFGGIVSNVALTVTDKFLLKKEDPLPEYVLKKVEINDKEIRIIKKIIESNYGITAEEIKVRAKAQRRIEEDSKKEDYDENKERN

SEQ ID NO: 609 - protein, 92 aa, Unknown
  Description of Unknown: Bacteriophage F44/10
MKTKKEIKEQRKELKDGATSVSLVKKGDKRIASPSRICSLCGQQLSGMNYTKGKALSKVNHFHLQYSKYIYFDICADINNCYKNLRKRGEMD

SEQ ID NO: 610 - protein, 136 aa, Unknown
  Description of Unknown: Bacteriophage F44/10
LSAENIRDIINKKKLEEEDTRKYIADGFMNGIGKLMYEFNKKVDNKEIEVKDPNDLYKLFVIFSQMQNMVNETSEGGAIPQLSRPQQELFDEITTEDSNGESTVDLQKISEMSAEDITAMISEKEKVMNEENSETF

SEQ ID NO: 611 - protein, 605 aa, Unknown
  Description of Unknown: Bacteriophage F44/10
MDGKELIKIAQETFQTEKITREQIDHIINMLNPSTYMLKYHTLRGHPITFSIPNRDRSKAQAHRPWQTRIVNDTHPNKAVIKSRQLGLSEMGVMEMVHFADMHSYANAKCLYTFPTNEQMKKFVQSRLNPVLEKEYFRDIVDWDKDSLGFKKIRNSSLFFRTSSKASTVEGVDIDYLSLDEYDRVNLLAESSALESMSSSPFKIVRRWSTPSVPGMGIHKLYQQSDQWYYGHRCQHCDYLNEMSYNDYNPDNLEESGNMLCVNPEGVDEQAKTVQNGSYQFVCQKCGKPLDRWYNGEWHCKYPERTKGNKGVRGYLITQMNAVWISADELKEKEMNTESKQAFYNYILGYPFEDVKLRVNEEDVYGNKSPIAETQLMKRDRYSHIAIGIDWGNTHWITVHGMLPNGKVDLIRLFSVKKMTRPDLVEADLEKIIWEISKYDPDIIIADNGDSGNNVLKLINHFGKDKVFGCTYKSSPKSTGQLRPEFNENNNRVTVDKLMQNKRYVQALKTKDISVYSTVDDDLKTFLKHWQNVVIMDEEDEKTGEMYQVIKRKGDDHYAQASVYAYIGLTRIKELLKEGNGTSFGSTFVSTDYNQEGNKQFYFDE

SEQ ID NO: 612 - protein, 273 aa, Unknown
  Description of Unknown: Bacteriophage F44/10
MNRGEIDLTDKLFYGTISNEEINKSVLNLLLGEELSLDYVSKNSDTLDVKYEHVYKSLGFDNFFDCFLYANREPEIVHKGGDKNLGGLNKVKRTVIRNGKEMEMTVYEDGNKENDSKEKQEGKEEVSRSAVGARAISNGEEGKVNPKKVANSLSNLSKKGVDVSHINTNSSLYKEFVDDNGDTLGITSFKRTENDIILESYASSHDSDGVGARAIMELLRLSIKENKNAVVYDIELPEAVEYLKTLGFKPNKDGYILRKKDVKQFLGDYSDFI

SEQ ID NO: 613 - protein, 60 aa, Unknown
  Description of Unknown: Bacteriophage F44/10
VIIVILFSTIVIYSIVFILYIVLKTIYIKSNMSRIDNTTELLKILQEDIEGKIKKEGRNK

SEQ ID NO: 614 - protein, 159 aa, Unknown
  Description of Unknown: Bacteriophage F44/10
MTLEENKLTLEESITPLSKEEKEDSIKEFSSLLCEMVNRLYKSYNVFRQDPMDETQRLDGSLMVFQSRLNDPLTGDLHDKMYKLAFSKRIDIFEANKQFRKDVEAGKAIELGDVAIIDTALSNILSGNEFQGSISFMLRKDFEEKERIRKEEEEKLNNL

SEQ ID NO: 615 - protein, 108 aa, Unknown
  Description of Unknown: Bacteriophage F44/10
LKKKPQGNEVIITIITVMIAVFVVIMTIFFNKYQDAKEDKDRYQRLVEIYKKADDNDGETKKKYVKRLNKAEEELKKVKKKQIIKIIIRSQVKKDKKKIKKLERKYMM

SEQ ID NO: 616 - protein, 34 aa, Unknown
  Description of Unknown: Bacteriophage F44/10
VDEEDKNEDTTDDKQPTEQPDDNNIDNEDKTEEE

SEQ ID NO: 617 - protein, 113 aa, Unknown
  Description of Unknown: Bacteriophage F44/10
MNIITSLSVVFTCLSLLTLMIFVHSKFSSKNVFVLYVIYAIIGIGTYIVLTMFQTTSVLIKNDVIDSIENTEHYIGFNDPIIIFTISFIGAILGGIWYKMMKIIKKSNFKDKK

SEQ ID NO: 618 - protein, 123 aa, Unknown
  Description of Unknown: Bacteriophage F44/10
LIFSKDKKWDEAKDFIKGQGMQDNWIEIVDYYRQIGGKHVAVFIALNKVKYMILEATKDNKVILVDKDNNILLEDYDIVMESKKMFYYIEEPFEVKINIPQHIRDVTYNNTVVLTTVRGSRGD

SEQ ID NO: 619 - protein, 563 aa, Unknown
  Description of Unknown: Bacteriophage F44/10
LADLFKQFRLGKDYGNNSTIAQVPIDEGLQANIKKIEQDNKEYQDLTKSLYGQQQAYAEPFIEMMDTNPEFRDKRSYMKNEHNLHDVLKKFGNNPILNAIILTRSNQVAMYCQPARYSEKGLGFEVRLRDLDAEPGRKEKEEMKRIEDFIVNTGKDKDVDRDSFQTFCKKIVRDTYIYDQVNFEKVFNKNNKTKLEKFIAVDPSTIFYATDKKGKIIKGGKRFVQVVDKRVVASFTSRELAMGIRNPRTELSSSGYGLSEVEIAMKEFIAYNNTESFNDRFFSHGGTTRGILQIRSDQQQSQHALENFKREWKSSLSGINGSWQIPVVMADDIKFVNMTPTANDMQFEKWLNYLINIISALYGIDPAEIGFPNRGGATGSKGGSTLNEADPGKKQQQSQNKGLQPLLRFIEDLVNRHIISEYGDKYTFQFVGGDTKSATDKLNILKLETQIFKTVNEAREEQGKKPIEGGDIILDASFLQGTAQLQQDKQYNDGKQKERLQMMMSLLEGDNDDSEEGQSTDSSNDDKEIGTDAQIKGDDNVYRTQTSNKGQGRKGEKSSDFKH

SEQ ID NO: 620 - protein, 257 aa, Unknown
  Description of Unknown: Bacteriophage F44/10
LEEIKFNAFVPMDLKKSVSTASDTNEYSIVSGWASTPSMDLQNDIVNPKGIDIEYFKSQGYINYEHQSDKVVGIPTENCYVDIEKGLFIEAKLWKNDENVVKMLDLAEKLEKSGSGRRLGFSIEGAVKKRNINDNRVIDEVMITGVALVKNPANPEATWESFMKSFLTGHGTSPDTQVDAGALRKEEIASSITNLAYVTKIKDLKEFNDVWNGVVEDLSKSNSMGYEESVLTLQLAKGLSRKDAELAVMDINKQKLE

SEQ ID NO: 621 - protein, 316 aa, Unknown
  Description of Unknown: Bacteriophage F44/10
MSKEMQNILEEYDKLNAQEAVSKSVEDDEKNTVESTEEQVAETTEEPAKEPEKVSEEDAKEAQEQGEKVESEEVAEGNEDEEVEKSAKESKDPVDQKDTKTENKDNEKRKNKKDKKEDSDDEDKDTDDDKDKKEDKKEKTSKSISDEDITTVFKSILTSFENLNKEKENFATKEDLSEVSKSINELSAKISEIQAEDVSKSVDTDEEAVEKSVTSTNGEQEKVEGYVSKSVDTEEQAETGEAKSEEAEEVQEDNTFKGLSQEERTKFMDSYKAQAKDPRASKHDLQSAYQSYLNINTDPTNASEKDIKTVKDFAQI

SEQ ID NO: 622 - protein, 463 aa, Unknown
  Description of Unknown: Bacteriophage F44/10
MTIEKNLSDVQQKYADQFQEDVVKSFQTGYGITPDTQIDAGALRREILDDQITMLTWTNEDLIFYRDISRRPAQSTVVKYDQYLRHGNVGHSRFVKEIGVAPVSDPNIRQKTVSMKYVSDTKNMSIASGLVNNIADPSQILTEDAIAVVAKTIEWASFYGDASLTSEVEGEGLEFDGLAKLIDKNNVINAKGNQLTEKHLNEAAVRIGKGFGTATDAYMPIGVHADFVNSILGRQMQLMQDNSGNVNTGYSVNGFYSSRGFIKLHGSTVMENELILDESLQPLPNAPQPAKVTATVETKQKGAFENEEDRAGLSYKVVVNSDDAQSAPSEEVTATVSNVDDGVKLSINVNAMYQQQPQFVSIYRQGKETGMYFLIKRVPVKDAQEDGTIVFVDKNETLPETADVFVGEMSPQVVHLFELLPMMKLPLAQINASITFAVLWYGALALRAPKKWARIKNVRYIAV

SEQ ID NO: 623 - protein, 98 aa, Unknown
  Description of Unknown: Bacteriophage F44/10
MLYYKKLLDKKMATVYGTVEIDKDGVVKGLTKEQEKEFANVPGFEFEEEKKTTRKQSASTSKEEEPKEEEKKASTRKTTSTTRKSTARKTTAKKDENK

SEQ ID NO: 624 - protein, 302 aa, Unknown
  Description of Unknown: Bacteriophage F44/10
MVNSMFGGDLDPYEKSLNYEYPYHPSGNPKHIDVSEIDNLTLADYGWSPDAVKAYMFGIVVQNPDTGQPMGDEFYNHILERAVGKAERALDISILPDTQHEMRDYHETEFNSYMFVHAYRKPILQVENLQLQFNGRPIYKYPANWWKVEHLAGHVQLFPTALMQTGQSMSYDAVFNGYPQLAGVYPPSGATFAPQMIRLEYVSGMLPRKKAGRNKPWEMPPELEQLVIKYALKEIYQVWGNLIIGAGIANKTLEVDGITETIGTTQSAMYGGASAQILQINEDIKELLDGLRAYFGYNMIGL

SEQ ID NO: 625 - protein, 292 aa, Unknown
  Description of Unknown: Bacteriophage F44/10
MEKPYMIGANSNPNVINKSTTYTTTTQADEQDKPKYTTRLEFDTIDMIRFINDRGIKVLWEEAYFCPCLNPDTGHPRVDCPRCHGKGIAYLPPKETIMAIQSQEKGTNQLDIGILDTGTAIGTTQLEKRISYRDRFTVPEVLMPQQMIYFVNKDRIRKGIPLYYDVKEVTYIATQDGTVYEEDYEIKNNRLYLNEKYENHTVTLKILMTLRYVVSDILKESRYQYTKFNQPKSKFENLPQKLLLKREDVIVLQDPYKVNDGIEEDLEIQVDDPKASASNPSNLGGFFGGAFK

SEQ ID NO: 626 - protein, 206 aa, Unknown
  Description of Unknown: Bacteriophage F44/10
MPVHGKRPNLFKNKNYKQVGKRTIDGMRSEVLDKLQATAQQVENTSIKRMPTYLQITEKKLEKEGVVDLKKAFAHSSKKKTSKDGGWYLTVPIRIKTSRMNNSTYQDMRTLKVDKGTGSVSKITDYLEGRRKNVSHPSMKPEPMTHNMTKVKRGKQSSYFIFRTVSSKSPASSWILNRDKVNEDNFSKTTLKTVKQLMNWKMKNLN

SEQ ID NO: 627 - protein, 278 aa, Unknown
  Description of Unknown: Bacteriophage F44/10
MAITSVDSYLLSEIKPRLNTVLENCYIIDEVLKDFDYQTRESFKEAFCGKNAQHEVTVGFNFPKFKNNYEAHYLIQLGQGQETKNSLGSIQSSYFEATGDTLVESSTAIREDDKLVFTVSKPIGELIKVEDIEFAKYDNLQVEGNKVSFKYQTNEDYENYNANIIFTEKKNDSKGLVKGFTVEEQVTVVGLSFNVDVARCLDAVLKMILISMRDSIEEQQTFQLQNLSFGDIAPIIEDGDSMIFGRPTIIKYTSSLDLDYTITQDINKLTFKERKDWK

SEQ ID NO: 628 - protein, 71 aa, Unknown
  Description of Unknown: Bacteriophage F44/10
MARKKTPENNTPKFNGYVHIDTFLDTAKTLFNMKDSQVAGFKAYMEGSHYLFSEQEFLPSLEKYLGRKLDI

SEQ ID NO: 629 - protein, 587 aa, Unknown
  Description of Unknown: Bacteriophage F44/10
MAVEPFPRRPITRPHASIEVDTSGIGGSAGSSEKVFCLIGQAEGGEPNTVYELRNYAQAKRLFRSGELLDAIELAWGSNPNYTAGKILAMRIEDAKPASAEIGGLKVTSKIYGNVANNIQVGLEKNTLSDSLRLRVIFQDDRFNEVYDNIGNIFTIKYKGEEANATFSVEHDEETQKASRLVLKVGDQEVKSYDLTGGAYDYTNAIITDINQLPDFEAKLSPFGDKNLESSKLDKIENANIKDKAVYVKAVFGDLEKQTAYNGIVSFEQLNAEGEVPSNVEVEAGEESATVTATSPIKTIEPFELTKLTGGTNGEPPATWADKLDKFAHEGGYYIVPLSSKQSVHAEVASFVKERSDAGEPMRAIVGGGFNESKEQLFGRQASLSNPRVSLVANSGTFVMDDGRKNHVPAYMVAVALGGLASGLEIGESITFKPLRVSSLDQIYESIDLDELNENGIISIEFVRNRTNTFFRIVDDVTTFNDKSDPVKAEMAVGEANDFLVSELKVQLEDQFIGTRTINTSASIIKDFIQSYLGRKKRDNEIQDFPAEDVQVIVEGNEARISMTVYPIRSFKKISVSLVYKQQTLEA

SEQ ID NO: 630 - protein, 134 aa, Unknown
  Description of Unknown: Bacteriophage F44/10
MASEAKQTVHTGNTVLLMIKGKPVGRAQSASGQREYGTTGVYEIGSIMPQEHVYLRYEGTITVERLRMKKENFADLGYASLGEEILKKDIIDILVVDNLTKQVIISYHGCSANNYNETWQTNEIVTEEIEFSYL

SEQ ID NO: 631 - protein, 309 aa, Unknown
  Description of Unknown: Bacteriophage F44/10
MGKNQYTFNIKENKNKWYEWCKLQNVKPLVEYENAQQIFYFEFLEGKFKGLIGKTYWASINRGSNMRMSCLTSESKDKYLKNLGKRKGIEVVEDYKGGRKLKHKFIVLEGKYQGCEGYITLNDLENLGRVDNRSLSEKGRKQYFDKQARLRDCIILEYPKDYRIKTKDKIVVKDKEGHVHNIIVQDFFEKSSLLELSCASEGEKIVKEILTKNSIKFEKEKSFRNKEGKVQRFDFYINENNKEYAIEYNGAQHYIDSTGYLKDTLETTQKRDKLKKEYSKDKGINLLIIPYTITDKKEMEKIILNFLNK

SEQ ID NO: 632 - protein, 52 aa, Unknown
  Description of Unknown: Bacteriophage F44/10
MNNRQAKLKGYNQFHYYDFPTTKGKFKDIMKRKSRTELKKDLQKERKYYLDK

SEQ ID NO: 633 - protein, 46 aa, Unknown
  Description of Unknown: Bacteriophage F44/10
LTNKRKTIGKMSNTRATWNINPVTKVKKDKTKYSRKNKHKGLDNYN

SEQ ID NO: 634 - protein, 96 aa, Unknown
  Description of Unknown: Bacteriophage F44/10
MRIYISNDYNKELLDKCLSDINKDKGNINYSINYGEGNIKEADVEIIKLDKNLLETESRAFAYSKFVEDCIFLFPYKIALLRGGKIELRFDWNEIL

SEQ ID NO: 635 - protein, 152 aa, Unknown
  Description of Unknown: Bacteriophage F44/10
MSTFWSERRTTNKDRQVKKHYTQMSMYERKKCVELLQETITENRIINFTRHSAKKVKGKPTTNIPKLIGFIFKNKFAYENIIEYNNTDYNGNIERRIVVKHPKVITVEGKLSYQFLTISLEDARVITVWYNSVDDTHRTLDLNYYSKDLTIQ

SEQ ID NO: 636 - protein, 64 aa, Unknown
  Description of Unknown: Bacteriophage F44/10
MGLTIVNGYFFLSSIIFIVVSILNGKGTVTRESLAMSQALVIITSIQFLAFLIINGIYYSLKYM

SEQ ID NO: 637 - protein, 50 aa, Unknown
  Description of Unknown: Bacteriophage F44/10
MEIYIVIDLRGSTEEETSMDFKAFRKLQDAITYVDGNGNRDLHIIPLELE

SEQ ID NO: 638 - protein, 103 aa, Unknown
  Description of Unknown: Bacteriophage F44/10
MSQDKLRAIYTEMKVELHKFPKEVDVTSKSTAIAINQILDKFKTLTEQAGKITRKYLEGQEILTIDYEYYDSLQEYYIYLLRNSEKIEQSLQEITKRTGEYVK

SEQ ID NO: 639 - protein, 152 aa, Unknown
  Description of Unknown: Bacteriophage F44/10
MAEEIKKEQDVQETTKEEKKDVSKMTPEEIDKLKYQDKQEKEQVINKVIKGVNDTWEKEYNFEELDLRFKVKIKLPNAREQGNIFALRSAYLGGMDMYQTDQVIRAYQMLATLQEVGIEVPKEFQDPDDIYNLYPLTVMYEDWLGFLNSFRY

SEQ ID NO: 640 - protein, 178 aa, Unknown
  Description of Unknown: Bacteriophage F44/10
MESIVKQPLSRNLWAIMKEFNVLPTEQRFKDLDDYQIEFIIGNMNRDVYEHNKQLKQAQKGGKFDSQFEDDDSSWWNESHEDFDPVPDFLDADDLAQQMEAKLSDRDKEERAKRNDAELNDETEGLTTQHLAMMEYIRQKQQELDDEVGNGKTSEDDATISQDSVNKALEDLDDDWYM

SEQ ID NO: 641 - protein, 1352 aa, Unknown
  Description of Unknown: Bacteriophage F44/10
MMAMNDDYRLVLSGDSSDLENSLKAIELYMDSLESKNIDAPLDNFLKKLKVIAKEVKNVQNAMDKQDGKSVISSKDMDESIKSTQSATKNINELKKALDDLQKENISKGIAPDPEVEKAYAKMGKVVDETQEKLEKMSSQKIGSDASIQNRIKEMKTLNQVTEEYNKISKDSSATKDYTKRLRANRNMTRGYMERSEGTGRLTYDQGARVRSELGKVSSYESQRKQNQRNLGQAREQYSNYRNQQQDLTKRRASGQINKAQYEQELASIKQEMKAREELISNYEKLGAELDKTVQYYKGSVQKDFQSRDVDQQRGTFGRMVQERLPSIGSHAMMGTTAMATGLYMKGASLSETNRPMVTSLGQNSDNMDIDSVRNAYGDLSIDNKLGYNSTDMLKMATSYEASVGHKSDEDTMAGTKQLAIGGRSLGIKDQEAYQESMGQIMHTGGVNSDNMKEMQDAFLGGIKQSGMVGRQDEQLKALGSIAEQSGEGRTLTKDQMSNLTAMQSTFAESGSKGLQGEQGANAINSIDQGLKNGMNSSYARIAMGWGTQYQGLEGGYDLQKRMDEGISNPENLTDMADMATQMGGSEKEQKYLFNRSMKEIGANLTMEQSDEIFKDSKEGKLSKEELAKKAKKMEKEGKKEGEDNATDYKESKSGKNDQNKSKTDDKAEDTYDMAQPLRDAHSALAGLPAPIYLAIGAIGAFTASLIASASQFGAGHLIGKGAKGLRNKFGRNKGGSSGGNPMAGGMPSGGGSPKGGGSPKGGGTRSTGGKILDSAKGLGGFLVGGAGWKGMFGGESKGKGFKQTSKEAWSGTRKVFNRDNGRKAMDKSKDIAKGTGSGLKDIYNDSIFGKERRQNLGEKAKGFGGKAKGLYGKFADKFGDGGKNGILSQSPKAGGSGIGKLGKLAGGLGKGAGVLGVATSALSLIPALASGDSKAIGGGIGSMGGGMAGASAGASIGALFGGVGAIPGALIGGAIGSFGGGAVGEKVGDMAKKANTKEGWNLGWTNGDKDGKNKFQDSLLGKPISKAWSGITGLFDNDAEASEENSKDKKKGVKGVKGDTKKKEKMTAEQLREKNNQSETKNLKIYSDLLDRAQKIIESAKGINIDGGTSDSGSDSGGSASDVGGEGAEKMYKFLKGKGLSDNQVGAVMGNLQQESNLDPNAKNPSSGAFGIAQWLGARKTGLDNFAKSKGKKSSDLDVQLDYLWKEMQSDYESKNLKNAGWSKGGSLEQNTKAFATGFERMGANEAMMGTRVNNAKEFKKKYGGSGGGGGGGAMSSTYQEAMSNPVLTTGSNYRGSNDASNASTTNRITVNVNVQGGNNPEETGDIIGGRIREVLDSNMDIFANEHKRSY

SEQ ID NO: 642 - protein, 400 aa, Unknown
  Description of Unknown: Bacteriophage F44/10
MKRLRRPKVRIEIVTDDNTFTLRFEDTRDYNGDEFGAKLLGFQTKNSMEDDSSVFQINMAGDTYWDKLVMANDIIRIFITPNDDPNDKEGRQERLIQVGMVSQVSKVGSYGNDQTQFRITGQSFVKPFMKFGLGVIQEVQAVLPEVGWLIDGDGDNEVKFTGSSAHEVMTGIIRRFVPYMKYNYTEKTYNTIDSYLDYDDLSSWDEFENLTEVSAFTNFDGSLKQLMDMVTARPFNELFFKNSEKTPGKAQLVLRKTPFNPTEWRALDMIKVPTEDFIEEDVGKSDVETYSIFTATPAGMLKELNGDVFSKPQFHPELTDRYGYTKFEVENIYLSTKSGSATEDSDSSGDDNGTERGTYSKIMKDLSNYGRDNISKGIDKYTSKLSSKYKNLKKPKLKKL

SEQ ID NO: 643 - protein, 36 aa, Unknown
  Description of Unknown: Bacteriophage F44/10
LTKDKLKSILKEKFKTQDDFNNSKKRKKLKQMHLKN

SEQ ID NO: 644 - protein, 338 aa, Unknown
  Description of Unknown: Bacteriophage F44/10
LTTKYRFGNKTHATTLLDEYIKYKGEPPNDEAFDKYLKAIEGVSNIATDTGSDASDSPLVMFSRMLFNWYHGNPNFYAGDIIVLGDPKYDLGKRLFIEDKQRGDTWEFYIESVEHKFDYKQGYYTTVGVTRGLKDAILEDGKGSPHRFAGLWNQSSDFMGGLMGEDTSKELKEKGVSEKQSSGDKDGGSDSGGAQDGGSLDSLKKYNGKLPKHDPSFVQPGNRHYKYQCTWYAYNRRGQLGIPVPLWGDAADWIGGAKGAGYGVGRTPKQGACVIWQRGVQGGSAQYGHVAFVEKVLDGGKKIFISEHNWATPNGYGTRTIDMSSAIGKNAQFIYDKK

SEQ ID NO: 645 - protein, 295 aa, Unknown
  Description of Unknown: Bacteriophage F44/10
MATDKEAKDVIDKFIDNVFNFDVLTMERVKEKDEEIKKITTDDMYEKVVYIRPYVGVIQSLNPQHVQYESFSNNGYDIEAELSFRKVSYLVDKGSIPTDSLSTLTVHLVERNQELLIDYFDEIQDVLYGEYMEEEYVFDEDVPLSTILALDLNDNLKSLSNIKYMFKGAPKENPFGTDKDVYIDTYNLLYWLYLGEDEELAYPMNINYFFTEGRFFTIFGKGHKYKVDVSKFIVGDILFFGRSDTNIGIYVGDGEFISMIGKFPKDETPIGKYKLDDYWNEFNGRVMRFDEEVYI

SEQ ID NO: 646 - protein, 848 aa, Unknown
  Description of Unknown: Bacteriophage F44/10
MVVRFQSSMGRSLKRVDSDDLNVKGLVLATVSKINYKYQSVEVKVNNLTLGSRIGDDGSLAVPYPKSFIGRTPEGSVFGTKPLITEGSVVLIGFLNDDINSPIILSVYGDNEQNKMINTNPLDGGKFDTDSVYKYSSALYEILPSLNYKYDDGEGTSIKTYNGKSFFSMTSGEEEKPQATDFYTGTEYQDLFTSYYGNKTLIEPRIQKAPNMLFKHQGVFYDDGTPDNHITTLFISERGDIRASVLNTETQKRTTQEMSSDGSYRVIKQDDDLMLDEAQVWIEYGISEDNKFYIKNDKHKFEFTDEGIYIDDKPMLENLDESIAEAMKNLNEIQKELDDINYLLEGVGKDNLEELIESTKESIEASKKATSDVNRLTTQIAEVSGRTEGIITQFQKFRDETFKDFYEDASTVINEVNQNFPTMKTDVNTLKTKVDNLEKTEIPNIKTRLTELENNNNNADKIISDRGEHIGAMIQLEENVTVPTRNYMPIPWSKVTYNNAEFWDSNNPTRLVVPKGITKVRVAGNVLWDSNATGQRMLRILKNGTYSLGLPYTRDVAISTAPQNGTSGVIPVKEGDYFEFEAFQDSEGDRQFRADPYTWFSIEAIELETETMEKDFMLIGHRGATGYTDEHTIKGYQMALDKGADYIELDLQLTKDNKLLCMHDSTIDRTTTGTGKVGDMTLSYIQTNFTSLNGEPIPSLDDVLNHFGTKVKYYIETKRPFDANMDKELLTQLKAKGLIGIGSERFQVIIQSFARESLINIHNQFSNIPLAYLTSTFSESEMDDCLSYGSYAIAPKYTTITKELVDLAHSKGLKVHAWTVNTKEEMQSLIQMGVDGFFTNYLDEYKKI

SEQ ID NO: 647 - protein, 263 aa, Unknown
  Description of Unknown: Bacteriophage F44/10
MPQSDGISNLHRIALRFPKEGGGYDMYRFKVNPENYTIDSPQRTTAIKTKSDIVIEDYGKDIEVINFTGTTGFRPVREADGLKTGKQKMEELQSRVSEYAMQGGSGNVSGSYLQFFNFTDDSYYKVHLAPQGLKITRSKDEPLLFRYEITLVVIGSLTEADRSAVTTEEFGNVKPNASQRVDEGIKELDKNARKTRDRNNQEISKRENTIPKSTGDNTNEGNRLKQSFPSSSIYNPRQSTNGLKGNIDNMALIIGYGDGGVSS

SEQ ID NO: 648 - protein, 174 aa, Unknown
  Description of Unknown: Bacteriophage F44/10
MNNFIPQPQGLLRFLNALDADLTSSHMNLLDEEVSFVSKFYTPQLQLSELAKKVLTNIKTDDIPVLEREFNDNTIIHKANDTLLKVQAPRMYMILQSIVLEAYAIVNCFVENPSSLKYLTEEDVSITRENLNYVADYLGNYDDYNSVVLDLRDLDLCFSAIELQLPLIKKEANV

SEQ ID NO: 649 - protein, 234 aa, Unknown
  Description of Unknown: Bacteriophage F44/10
MRFKKHVVQHEETMQAIAQRYYGDVSYWIDLVEHNNLKYPYLVETDEEKMKDPERLASTGDTLIIPIESDLTDVSAKEINSRDKDVLVELALGRDLNITADEKYFNEHGTSDNILAFSTNGNGDLDTVKGIDNMKQQLQARLLTPRGSLMLHPNYGSDLHNLFGLNIPEQATLIEMEVLRTLTSDNRVKSANLIDWKIQGNVYSGQFSVEIKSVEESINFVLGQDEEGIFALFE

SEQ ID NO: 650 - protein, 348 aa, Unknown
  Description of Unknown: Bacteriophage F44/10
MKTRKLTNILSKLIDKTMAGTSKITDFTPGSASRSLLEAVSLEIEQFYILTKENIDWGIQEGIIEAFDFQKRQSKRAYGDVTIQFYQPLDMRMYIPAGTTFTSTRQEYPQQFETLVDYYAEPDSTEIVVEVYCKETGVAGNVPEGTINTIASGSSLIRSVNNEYSFNTGTKEESQEDFKRRFHSFVESRGRATNKSVRYGALQIPDVEGVYVYEETGHITVFAHDRNGNLSDTLKEDIIDALQDYRPSGIMLDVTGVEKEEVNVSATVTISNKSRIGDTLQKHIEGVIRSYLNNLKTSDDLIITDLIQAIMNIDDVLIYDVSFDNLDENIIVPPQGIIRAGEIKVELK

SEQ ID NO: 651 - protein, 854 aa, Unknown
  Description of Unknown: Bacteriophage F44/10
VANFLKNLHPLLRRDRNKKDNQDPNFALIDALNEEMNQVEKDAIESKLQSSLKTSTSEYLDKFGDWFGVYRKTDENDDVYRARIIKYLLLKRGTNNAIIDAIKDYLGRDDIDVSVYEPFTNIFYTNKSHLNGEDHLMGYYYRFAVINVSIGDYFPVEIIDVINEFKPAGVTLYVTYDGASTIRGGAIIKWLDGLPKIETYQEFDRFTGYDDTFYGHINMNQSKDTDNSTSDIFKTNHSLINSLDVLTGSSSVGRQYVNYGYITSYVYNPGMTSSVNQISASTEGRGQEVPTDYYMYTSTKNNNTVELSMQTTSGVSYLYNNFNFRDYMSKYRPQVNLQSDEARRIVSDYIKELSIDYYLSAVIPPDESIEIKLQVYDFSINRWLTVSINNLSFYEKNIGSNIGYIKDYLNSELNMFTRLEINAGKRDSVDIKVNYLDLMFYYYERGIYTIKPYKALVENYLDISRETYVEAFKISSLSNGDIITKTGYLPIGYLRVSGDIDNLSNHIEIITIDNNTNSITSTLLEDDSNSLILSYGNVKTNIHSFELNSDASISNIKFEYSYYGDAWEELTVLTEISEGETIVPNILIDLYGLQTVDYSNINPMSKVSLRSIWNVKLGELNNKEGSLSNMPNDYFNAVWQDIDKLSDIDLGSMRMIKDTEGGVFDGATGEIIKATLFNVGVYTDLDMLAYTLTNYTEPITLGSSRLISELKEELLTSESFNVDNRIKVIDSISEQLPNNNILSNSYQTQTITQNGFAKYNLKEPIEQRKQYNLRIHGDFKEGLERLAIGNSNGSFNEVFVYPENIKDGIVDITYTSRDDNYAEGKQRLNNDYRVYAQPYDSEVVTIYSLELIKV

SEQ ID NO: 652 - protein, 173 aa, Unknown
  Description of Unknown: Bacteriophage F44/10
MAIATYNSHVELAKYLVSKADSVYLTIGKSTPWSNETNPPQPDENATVLQEVIGYKKATKVTLVRPSKSPEDDNKNLISYGNKSWVEVTPENAKDEGAKWVYLESSIVGDELPLGTYRQVGFVMDLVAKSGISKFNLVPSEVESTGTLLFFDNKQFQNRSEQTTAKERFIVEV

SEQ ID NO: 653 - protein, 1152 aa, Unknown
  Description of Unknown: Bacteriophage F44/10
MAINFKGSPYLDRFDPSKDRTKVLFNPDRPLQQAELNEMQSIDQYYLKNLGDAIFKDGDKQSGLGFTLSEDNVLTVNPGYVYINGKIRYYDNDDSVKITGVGKETIGIKLTERIVTPDEDASLLDQTSGVPSYFSKGADRLEEKMSLTVNDPTSATIYTFMDGDLYIQSTNAEMDKINKVLAERTYDESGSYKVNGFELFSEGNAEDDDHVSVVVDAGKAYVKGFKVDKPVSTRISVPKSYDLGTAENESTIFNKSNNSISLANSPVKEIRRVTGQVLIEKERVTRGAQGDGQDFLSNNTAFEIVKVWTETSPGVTTKEYKQGEDFRLTDGQTIDWSPQGQEPSGGTSYYVSYKYNKRMEVGKDYEVTTQGEGLSKKWYINFTPENGAKPIDQTVVLVDYTYYLARKDSVFINKYGDIAILPGEPNIMRLVTPPLNTDPENLQLGTVTVLPDSDEAVCISFAITRLSMEDLQKVKTRVDNLEYNQAVNALDDGAMEGQNPLTLRSVFSEGFISLDKADITHPDFGIVFSFEDAEATLAYTEAVNQPKIIPGDTTAHIWGRLISAPFTEERTIYQGQASETLNVNPYNIPNKQGVLKLTPSEDNWIDTENVTITEQKTKKVTMKRFWRHNESYYGETEHYLYSNLQLDAGQKWKGETYAYDREHGRTGTLLESGGQRTLEEMIEFIRIRDVSFEVKGLNPNDNNLYLLFDGVRCPITPATGYRKGSEDGTIMTDAKGTAKGKFTIPAGIRCGNREVTLKNANSTSATTYTAQGRKKIVQDIIIRTRVTVNLVDPLAQSFQYDENRTISSLGLYFASKGDKQSNVVIQIRGMGDQGYPNKTIYAETVMNADDIKVSNNASAETRVYFDDPMMAEGGKEYAIVIITENSDYTMWVGTRTKPKIDKPNEVISGNPYLQGVLFSSSNASTWTPHQNSDLKFGIYTSKFNETATIEFEPIKDVSADRIVLMSTYLTPERTGCTWEMKLILDDMASSTTFDQLKWEPIGNYQDLDVLGLARQVKLRATFESNRYISPLMSSSDLTFTTFLTELTGSYVGRAIDMTEAPYNTVRFSYEAFLPKGTKVVPKYSADDGKTWKTFTKSPTTTRANNEFTRYVIDEKVKSSGTNTKLQVRLDLSTENSFLRPRVRRLMVTTRDE

SEQ ID NO: 654 - protein, 52 aa, Unknown
  Description of Unknown: Bacteriophage F44/10
MPREVRDPYSQAKLFIPTVEEKSIKELEKTYKEKIDEATKLINELKKERGEK

SEQ ID NO: 655 - protein, 639 aa, Unknown
  Description of Unknown: Bacteriophage F44/10
MAFNYTPLTETQKLKDMYPKVNDIGNFLKTEVNLSDVKQISQPDFNNILASIPDSGNYYVTNSKGAPSGEATAGFVRLDKRNVNYYKIYYSPYSSNKMYIKTYANGTVYDWISFKLDEGNLYNEGNTLNVKELTESTTQYVTLVNPPKENLNTGWVNYKESKNGVSSLVEFNPVNSTSTFKMIRKLPVQEQKPNLLKDSLFVYPETSSSNIKTDNWNTPPFWGYTANSGRSGVRFRGENTIQIDDGSSTYPTAMTNRFKMGNELSVGDTITVSVYAKINDPALLKDNLVYFELAGYDMVDRTDNPYTGGRREITASEITTEWKKYSFTFTIPENTIGASGVKVNYVSLLLRMNCSSSKGNGAVVYYALPKLEKSSKVTPFITHATDVRKYDEIWSNWQEVISKDELKGHSPVDIEYNDYFKYQWWKSEVNEKSLKDLAMTVPQGYHTFYCQGSIAGTPRGRSIRGTIQVDYDKGDPYRANKFVKLLFTDTEGIPYTLYYGGYNQGWKLLKQSETSTLLWEGTLDFGSTEAVNLNDSLDNYDLIEVTYWTRSAGHFSTKRLDIKNTSNLLYIRDFNISNDSTGSSVDFFEGYCTFPTRTSVQPGMVKSITLDGSTNTTKVASWNEKERIKVYNIMGINRG

SEQ ID NO: 656 - protein, 124 aa, Unknown
  Description of Unknown: Bacteriophage F44/10
MAVKYDIGNNEIVLHLREGKYITGFTTVGGYDKELGQVKVNREILPAYFFDNFAYERYLYYSKPEEVIENKNYVPPQINNGDEESQQNTVPKEQYDSLKEELELMRKQQEAMMEMLQKLLGQKG

SEQ ID NO: 657 - protein, 458 aa, Unknown
  Description of Unknown: Bacteriophage F44/10
MALNFTTITENNVIKDLTTQVNNIGEELTKERNIFDITDDLVYNFNKSQKIKLTDDKGLTKSYGNITALRDIKEPGYYYIGARTLATLLDRPDMESLDVVLHVVPLDTSSKVVQHLYTLSTNNNQIKMLYRFVSGNSSSEWQFIQGLPSNKNAVISGTNILDIASPGVYFVMGMTGGMPSGVDSGFLDLSVDANDNRLARLTDAETGKEYTSIKKPTEVYTAWKKEFEPKDMEKYLLSSIRDDGSASFPLLVYTSDNKTFQQAIIDHIDRTGQTTFTFYVQGGVSGSPMSNSCRGLFMSDTPNTSSLHGVYNAIGTDGRNVTGSVVGGNWTSPKTSPSHKELWTGAQSFLSVGTTKNLADDISNYSYVEVYTKHKTVEKTKGNDDSGTICHKFYLDGSGTYVCSGTFVSGDRTDTKPPVTEFYRVGVSFKGSTWTLVDSAVQNSKTQYVTRIIGINMP

SEQ ID NO: 658 - protein, 582 aa, Unknown
  Description of Unknown: Bacteriophage F44/10
MRLRIKNLYTYVEFEEDDKYLKDIFLKRVHTTIGARQEGFQYSPAYKRGSWDGYVDFYVYEEDKFPTGLLFKIELLLGELQSRYNFQFETIDERDESFLSEEDIDDEITLLDNNVGQITLRDYQYEAVYNSLTFYNGIAHLATNGGKTEVASGIIDQLLPQLEKGERVAFFTGSTEIFHQSADRLQERLNIPIGKVGAGKFDVKQVTVVMIPTLNANLKDPTQGVKVTPKQNISKKIAQEILPKFEGGTNQKKLLKVLLDNTTPKTKVEQNVLSALEIIYQNSKTDAEVLLNLRNHNAHFQKIVREKNEKKYDKYQDMRDFLDSVTVMIVDEAHHSKSDSWYNNLMTCEKALYRIALTGSIDKKDELLWMRLQALFGNVIARTTNKFLIDEGHSARPTINIIPVANPNDIDRIDDYREAYDKGITNNDFRNKLIAKLTEKWYNQDKGTLIIVNFIEHGDTISEMLNDLDVEHYFLHGEIDSETRREKLNDMRSGKLKVMIATSLIDEGVDISGINALILGAGGKSLRQTLQRIGRALRKKKDDNTTQIFDFNDMTNRFLYTHANERRKIYEEEDFEIKDLGK

SEQ ID NO: 659 - protein, 537 aa, Unknown
  Description of Unknown: Bacteriophage F44/10
MATKTQRKLYQYLEENATENKFHISTKKELADSLGVSISALSNNLKKLEEENKVVTVSKRGKNGGVIITLVREYDTEELKEFNNSTDNIITSDLQYAKALREKHFPSYRYERKEQRRRTKIEMAQYNAIKDEKRRIIADMNFYSEGLPYPSKDIFNMSYDPEGFYKAYILCKLYDQYAISHMDAKHTSHLKAMSKATTKDEYDYHQHMSEYYRNKMIQNLPRNSVSDNFFGSKMFNTFYNFYLKIKDKNINVFKYMKNVFKNVTFYYENGMQPNPIPSPNFFSSDKYFKNYNNYIKGIKKGINSTNRHLGDTDSIINSSDYVKNPAVLHLHQLYTTGLNSTLHDIDTMFEQALDLENASYGLFGDMKHIILLQYNSMIEEEIKNLPIEEKDIINKYVKQCIINNYSPTSISPSARLSMFTMQKEHIVYNKQLNKGIKREDLLPLSLGGIVNKDSLSSMDIQNLEQNGNEYLYMRQHTSTYYILRMFGDYLGYEVNLREVKYIVEKYNLIDKIPLTKEGMLDYNKLIHLVEEEVNNYE

SEQ ID NO: 660 - protein, 480 aa, Unknown
  Description of Unknown: Bacteriophage F44/10
MSKKIKELILHKSMKDIHFAREVLDNLPKNLFSAESEDMGYLFTAIKRTAHISDKMSNEALAIKVEQLMGNNKEDEEKVTKTLTYLEDLYKVDVNEKDESVNYEIEKYIKTEMSKEVLVKFIAENKQEDSDNLHELVDKLKQIEVSDISGGNGEFIDFFEDTEKKQELLSNLATNKFSTGFTSIDNHIEGGIARGEVGLIIAPTGRGKSLMASNLAKNYVKSGLSVLYIALEEKMDRMVLRAEQQMAGAEKSQIVNQDMSLNNKVYDAIQNHYQKNRKLLGDFYISKHMPGEVTPNQLEQIIVNTTIKKDKNIDVVIIDYPHLMRNPYAKYHSESDAGGKLFEDIRRLSQQYGFVCWTLAQTNRGAYGSDVITSEHVEGSRKIVNAVEVSLAVNQKDEEFKSGFLRLYLDKIRNSSNTGERFVNLKVEPTKMIVRDETPEEKQEHIQLLSDNGKEDTSKFQNKDNKIEAINNTFGGLPGV

SEQ ID NO: 661 - protein, 341 aa, Unknown
  Description of Unknown: Bacteriophage F44/10
MKFVFFTDSHFHLFTNYAKPDNEFVNDRFKEQIEALQKVFDIAKKEEATVIFGGDLFHKRNSVDTRVYNKVFSTFAKNNEVPVLLLRGNHDATTNSLYTDSSIDTFEYLPNVNVIKSLNTILKDNVNIVFTAYGDETKEIKTYINSNYDKDMVNILVGHLGVEGSLTGKGSHRLEGAFGYQDLLPDKYDFILLGHYHRRQYFQNPNHFYGGSLMQQSFSDEQEANGVHLIDTDKMTTEFIPIHTRRFITIQGEDIPDNFEQLIEEDNFIRVIGTANHAKVLEMDDSMKDKNVEVQIKKEYTVEKRIDSDVSDDPLTIASTYAKQYSPESEQEILECLKEVL

SEQ ID NO: 662 - protein, 125 aa, Unknown
  Description of Unknown: Bacteriophage F44/10
MKKYREYLNKTDAENLAEDWEKVTEDLWKVFKDMKPKINTLDISNVGSKDLDKSKPILQFQDSDGVIENICNVEGLEDGLSKMKKIFDDSNFEKHYYNRVVDHDGYYWIDYGSHHCFFRVTKGDK

SEQ ID NO: 663 - protein, 639 aa, Unknown
  Description of Unknown: Bacteriophage F44/10
MVVFKQVEVNNFLAIKEATLELDNRGLILIEGENKSNESFHSNGSGKSTLISAITYALYGKTEKGLKADDVVNNIEKKNTSVKLKFDIGEDSYLIERYRKDKENKNKVKLFVNEKEITGSTNDVTDKQIQDLFGIEFNTYVNAIMYGQGDIPMFSQATDKGKKEILESITKTDVYKQAQDVAKEKVKEVEEQQNNIRQEIYKLGYQLSTKDEYFQREIEQYNQYKEQLVQIENSNKEKDRLREQEEKQIEAQIEQLASQIPTIPEDEFKHSEEYNKASQSLDLLSNKLTELNQVYSEYNTKEQVLKSEIATLSNSLNQLDINDHCPVCGSPIDNSHKLKEQENISNQIENKKQEITSVLEMKDTYKEAIDKVKDKSQEIKDKMSQEDQQEREHNNKINSIIQEASRIKSDISSLENNKTYLKVKYQHQSVQGLEREEPSKEKHEEDKKELQESIDKHEENIVQLETKKGKYQQAVDAFSNKGIRSVVLDFITPFLNEKANEYLQTLSGSDIEIEFQTQVKNAKGELKDKFDVIVKNNKGGGSYKSNSAGEQKRIDLAISFAIQDLIMSKDEISTNIALYDECFDGLDTIGCENVIKLLKDRLNTVGTIFVITHNTELKPLFEQTIKIVKENGVSKLEEK

SEQ ID NO: 664 - protein, 198 aa, Unknown
  Description of Unknown: Bacteriophage F44/10
MKLKILDKDNATLNVFHRNKEHKTIDNVPTANLVDWYPLSNAYEYKLSRNGEYLELKRLRSTLPSSYGLDDNNQDIIRDNNHRCKIGYWYNPAVRKDNLKIIEKAKQYGLPVITEEYDANTVEQGFRDIGVIFQSLKTIVVTRYLEGKTEEELRIFNMKSEESQLNEALKESDFSVDLTYSDLGQIYNMLLLMKKISK

SEQ ID NO: 665 - protein, 355 aa, Unknown
  Description of Unknown: Bacteriophage F44/10
MRFEDFLTQELGEPKENTIGELRYCCPFCGEKSYKFYVKQALDSSNGQYHCKKCDETGNPITFMKTYYNITGKQAFDLLESKNIDIERAPLLTTNNKDLTESEKLILMLRGVHQDKGTTSIKPPRLPEGYKLLKDNLNNKEIIPFLKYLKGRGITLEQIINNNIGYVINGSFYKVDGESKVSLRNSIIFFTYDNNGNYQYWNTRSIEKNPYIKSINAPAKQDEVGRKDVIFNLNIARKKKFLVITEGVFDALTFHEYGVATLGKQVTENQIKKIIDYVSIDTSIYIMLDTDALDNNIDLAYKLKTHFNKVYFVPHGDEDANDMGTRKAFELLKQNRVLVTPESIQSYKIQQKLKL

SEQ ID NO: 666 - protein, 112 aa, Unknown
  Description of Unknown: Bacteriophage F44/10
MSNSKKDILEFVDEYITALRVGNEQRQHQLEEMGKEETATLTDVAKAITNLMLGVNEQMTDLEYNNELNLNILIDALYKAELINEDVLDYIQESIDKSQEEPKNEEEKGEQE

SEQ ID NO: 667 - protein, 150 aa, Unknown
  Description of Unknown: Bacteriophage F44/10
MEKNISTHTKGISQADMEKWIEAVVQGTVDGKQVDEKTAKQLDRIGSRSVSLEEATRIAKVLNAVTAQEVTGDFNDAFNAIDLMMIIMEDELGVTQEKVGKAKDKLNEKREAYLKEKQEELRQKQQEEAQKETESDSNEKVIQLKKNDEQ

SEQ ID NO: 668 - protein, 202 aa, Unknown
  Description of Unknown: Bacteriophage F44/10
MTNSKKKGDTFERKIAKELTAWWGYQFNRSPQSGGASWGKDNNAVGDIVVPQEANFPLVVECKHREEWTIDNVLLNNREPHTWWEQVINDSSKVDKTPCLIFTRNRAQSYVALPYDEKVYEDLRNNEYPVMRTDFIIDNIRKDKFFYDVLITTMNGLTSFTPSYIISCYDKKDIKPYKKVESNLSEVSKHEDELINDLLSDI

SEQ ID NO: 669 - protein, 130 aa, Unknown
  Description of Unknown: Bacteriophage F44/10
MTSKERPLIVYFSGTGQTERLVNKININNSFETFRVKSGKEKVNKPFILITPTYMKGAIPKQIERFLEINGSPKEVIGTGNKQWGSNFCGASKKISEMFKIPLIAKVEQSGHFNEIQPILEHFSNKYKVA

SEQ ID NO: 670 - protein, 704 aa, Unknown
  Description of Unknown: Bacteriophage F44/10
MATYGKWIELNNEITQLDDNGKNKLYKDQEALDEYLKYIEDNTRKFNSEVERIRVLTKEGTYDKIFDKVPDTIIDEMTKLAYSFNFKFPSFMAGQKFYESYASKQYDENKKPIFVEDYEQHNVRVALYLFQNDYVKARELLVQLMEQTFQPSTPTYNNSGQANRGELSSCYLFVVDDSIESLNFVEDSVANASSNGGGVAIDLTRIRPKGAPVRNRPNSSKGVIAFAKAIEHKVSIYDQGGVRQGSGAVYLNIFHNDILDLLSSKKINASESVRLDKLSIGVTIPNKFMELVKEGRPFYTFDTYDINKVYGKYLDELNIDEWYDKLLNNDSIGKVKHDAREVMTDIAKTQLESGYPYVFYIDNANDNHPLKNLGKVKMSNLCTEISQLQEVSEIYPYSYSNQNVINRDVVCTLGSLNLVNVVEKGLLNESVDIGTRALTKVTDIMDLPYLPSVQKANDDIRAIGLGSMNLHGLLAKNMISYGSREALDLVNSLYSAINFQSIKTSMLMAKETGKPFKGFEKSDYATGEYFVRYIRESNQPKTDKAKKVLDKVYIPTQDDWDELAKAVKVHGLYNGYRKAEAPTQSISYVQNATSSIMPVPSAIENRQYGDMETYYPMPYLSPITQFFYEGETAYKIDNKRIINTSAVVQKHTDQAVSTILYVESEIPTNKLVSLYYYAWEQGLKSLYYTRSRKLSVIECETCSV

SEQ ID NO: 671 - protein, 349 aa, Unknown
  Description of Unknown: Bacteriophage F44/10
MDITQKVKQHNKNAVLKATNWNIEDDGMSDIYWEQGISQFWTPEEFDVSRDLSSWNSLTESEKNTYKKVLAGLTGLDTKQGGEGMNLVSYHEPRPKYQAVFAFMGGMEEIHAKSYSHIFTTLLSNKETSYLLDTWVEENDFLKVKAQFIGYYYDQLLKPNPTVFDRYMAKVASAFLESALFYSGFYYPLLLAGRGQMTQSGAIIYKITQDEAYHGSAVGLTAQYDYNLLTEEEKKQADKETYELLDILYTNEVAYTHSLYDPLELSEDVINYVQYNFNRALQNLGREDYFNPEPYNPIVENQTNVDRLRNVDFFSGKADYEKSTNIKDIKDEDFSFLDSKEYNTAKEFL

SEQ ID NO: 672 - protein, 109 aa, Unknown
  Description of Unknown: Bacteriophage F44/10
MDRKEAMDLLSKAEILFKKHDEFSCVSDINDPMKLFSSSKDAKADDTSKSFQLEFMHDMTMYTLSYGSGQLKLIDLAEGYEAQKATVVNSFPEIIKTLEKDDSEDGKNE

SEQ ID NO: 673 - protein, 106 aa, Unknown
  Description of Unknown: Bacteriophage F44/10
MEKMNSLVDLNTAIRQKKDVIVMITQDNCGKCEILKSVIPMFQESGDIKKPILTLNLDAEDVDREKAVKLFDIMSTPVLIGYKDGQLVKKYEDQVTPMQLQELESL

SEQ ID NO: 674 - protein, 198 aa, Unknown
  Description of Unknown: Bacteriophage F44/10
MDELISKSRRYIMRDENHYMLFNEKYNNDRLIEKVCKHGGKVTYYTDSVLPYYVLKDLSSHPDSEVVYRMRNGFTAKEVDNIALSFMGTKVIIDISVVFPYVNPYDIIRSLHDIKTNVDEVHLSFPRILEVDEKQEKFYFFDGEAYDLKPEYKVDFADKIRVSLSVWKMYIYILTSSRDFEDVDNVITKLKQQRKIKI

SEQ ID NO: 675 - protein, 101 aa, Unknown
  Description of Unknown: Bacteriophage F44/10
MSTANRRDIARKISENTGYYIQDVEEILSAETDAISDLLEEGYTKVKNHKFMQIEVIERKGKKAWDGLNKEYFHLPNRKAIKFKPLKELEEVIDRLNEEEK

SEQ ID NO: 676 - protein, 290 aa, Unknown
  Description of Unknown: Bacteriophage F44/10
MKVLILFDHIREEHFSVSKDGSVKSNVLNTPNGKTLKKLLEKCSNLKRDKTNRDYDIDFLYNAVPTPIRNDYGKIIKYQDVKQAEVKPYYERMNNIIIDNSYDMVIPVGKLGVKYLLNVTAIGKVRGVPSKVTIENETSSHDVWVLPTYSIEYTNVNKNSERHVVSDLQTVGKFVEQGEEAFKPKEVSYELVDNIERVREIFNKEVKNDNYDGVDITAWDLETNSLKPDKEGSKPLVLSLSWRNGQGVTIPLYKSDFNWENGQDDIDEVLELLKNWLASKEDIKVAHNGK

SEQ ID NO: 677 - protein, 170 aa, Unknown
  Description of Unknown: Bacteriophage F44/10
VYQLNRGGTVKKDYMTSVKNNKKVCRRCNEELDLSNFKTYKKNDKIYYQSMCIPCRKEYNKLDKTKNTIKKCYDKNGDKYRKQGNEYNTSDRGRELNKKRSRKYRENNSLKAKARNSVRTALRNGSLLRPSKCSECNKECIPEAHHPDYNKPLEIKWLCKSCHEDTHHKK

SEQ ID NO: 678 - protein, 776 aa, Unknown
  Description of Unknown: Bacteriophage F44/10
MSTENFKDFESIQDTKVGWYLAVTQEVKESLRLSDLAYEVTDVGGYDKPLEDFKLWFVTKLLRFFSDKIKEIQKENKKIAKKEYDVKAPEYKEWLENKLNETVVELDDTEKKFRVSELEKKYIQLGLSPEIVNMNLVMNNDEFISIAEQSPEYMGLSDYAKSYTLNTAINLINEYRDVKDVVNDIDGGNFNYDWFPIELMHPYASGDTDVCRRIHCDVVKKLKEQDRPKSMHLLEVNYPRLTKSLARIESNGLYCDLDYMKENDESYESEMAKNHATMREHWAVKEFEEYQYNLYQMALEEHEKKPKDRDKDIHQYRDKFKDGKWMFSPSSGDHKGRVIYDILGIQLPYDKEYVKEKPFNANVKEADLTWQDYKTDKKAIGYALDNLELKDDVRELLELLKYHASMQTKRNSFTKKLPNMINKQKRTLHGSFSETGTETSRLSSSNPNLQNLPAHTSDVNKFDYKHPIKRSFVSRFENGVLLGADYSALEMRIIGLFTKDPDMLQSFLNGEDIHKATASIVYNKPVEEVTKEERQATKAVNFGLAFGESPFSFAGKNNMEVSEAEEIFEKYFQTKPSVKTSIDNVHEFVQQYGYVDTMHGHRRFIRSAQSTDKKIKNEGLRQSFNTIIQGSGSFLTNMSLTYLDDFIQSRNLKSKVIATVHDSILIDCPPEEAKIMAKVTIHIMENLPFDFLKAEIDGKEVQYPIEADMEIGLNYNDMVEYDEEEIDTFNSYQGYIKYMMNLQTLEDYKESGKLTDEQFEKATNVVKSEKHIYQEI

SEQ ID NO: 679 - protein, 80 aa, Unknown
  Description of Unknown: Bacteriophage F44/10
VNTGEIRFNRSMDEWIITSMYQDELGDMNIVVTFYNREENKHGSTVLPTESSTGEVTEELANLEEEYPLALPLSSISVNI

SEQ ID NO: 680 - protein, 160 aa, Unknown
  Description of Unknown: Bacteriophage F44/10
MEIHIDSLDFTNFTIKDRNGNSQEFDITDELRITEYTIQEDFMQQSAKYAFWASILEKVRAYSEMEQRNLETIGSKLNLTIRQEYEQQGKKPTKDMIESSVYIHDSYQQQLKVVEAWNYKVKQLQYVVKAFETRRDMMIQLGAELRQTNKNGGITNPFSH

SEQ ID NO: 681 - protein, 423 aa, Unknown
  Description of Unknown: Bacteriophage F44/10
MDFNQFINNEASKLESNNSSFNNNVESYKPKNPVLRLGNIKDANGNKVVKENAFVRVLPPAQGTNVFFKEFRTTGINYSKKDGSQGFTGLTLPAEEGSSVLDPYIQDWITNGVQFSRFPNKPGVRYYIHVIEYFNNNGQIQPKTDAQGNVMIQPMELSNTGYKELLANLKDTMLKPSPNAPHSFISANEAFLVNIVKAKKGEMSWKVSVYPNAPLGALPQGWEQQLSDLDQLAKPTEEQNPNFVNFLINNVNNTELSHDNFKFNRETNVLGEEPSEPKQAPTQQDVDSQMPSNMGGQPNQPQQGQVGQYAQQGQSNGQGQQLQGTQQPINNTQFGQGTPSGQQPSNTGSVDWDNLAQQQSQPDSNPFNDFDVSSVDDSQVPFETQPQNTQQAPEPHQTTQEPPKQKQTQSIDDVLGGLDLDNL

SEQ ID NO: 682 - protein, 418 aa, Unknown
  Description of Unknown: Bacteriophage F44/10
MARAKKGKEVDLTDLNTIDLGKELGLTLLSDTNRADIKNVIPTMVPQYDYILGGGIPLGRLTEVYGLTGSGKSTFAVHLSRIATQLGVITIWIDIEGTADNNRMEQLGVDVSKLFSIQSGEGRLKNTVELSVEQVGKELEYWIDTFNEKIPGVPIVFIWDSLGATRTQKEIDGGIDEKQMGLKASATQKVINAVTPKLNDTNTGLIVINQARDDMNAGMYGDPIKSTGGRAFEHSASLRIKVHKASQLKQKSELTGKDEYHGHIMRIETKKSKLSRPGQKAEADLLSDYMVGKEDDPILLNGIDLEHTVYKEAVERGLITKGAWRNYVTLNGEEIKLRDAEWVPVLKDNRELYLELFSRVYGEHFPNGYSPLLNNKVIVTQLEEYQALENYYKEWATDNKQEEQEEELKGESQEKDSE

SEQ ID NO: 683 - protein, 117 aa, Unknown
  Description of Unknown: Bacteriophage F44/10
MDNLIDKNMSQVKESLGNANSSDVLPLPYKDIAKKFEEVKEKGESIIIEEGGFPYTDSTVMYIEHVTDRWAGGYSLIRHEGEEVKVPKTIHFSDIYVKDKSHKVRIIFEGANPYEES

SEQ ID NO: 684 - protein, 220 aa, Unknown
  Description of Unknown: Bacteriophage F44/10
MKKANNGNRYVIDIDGIPVDFERDLDSLLNRYKNLRWSLYHRYAGILSNDFERQELREYIDEQFIKLVKEYNIRSKVDFPGYIKAKLTLRVQNSYVKKNEKYKRTEIIGKKDYTVESLTEDLNEDFEDNQIMSYVFDDIEFTEVQSELLKELLINPEREDDAFIVSQVAEKFDMKRKEVASELTELRDYVRFKINAYHEYYAKKELNNHRVNTENHIWEN

SEQ ID NO: 685 - protein, 210 aa, Unknown
  Description of Unknown: Bacteriophage F44/10
MAKKNVNDVLQQESVTVADKYLQVKVNRDGYTRTHEGQYAYKVVSEGEELFLYPVQTDGKGTLNVMKKSPIAYTDGDNIHFVVNTVVDPYNHSFIRTEDIKGLDKGKQLIQAFLAFVEDRFKFGVYNVFVANNKEDVLSIVDPTDNDADEVKDSLEHAHEDVIADFPASPARKDVKGVDSGEGQGDTSEPSAPKNVQVTPKEDGADVSAE

SEQ ID NO: 686 - protein, 170 aa, Unknown
  Description of Unknown: Bacteriophage F44/10
LAKLNLYKGNELLNSVEKTEGKSTITIENLDANTDYPKGTFKVSFSNDSGESEKVDVPQFKTKAIKVISVTLDVDSLDLTVGDTHQLSTTITPSEASNKNVSFESDKSGVASVTSEDLIEAVSAGTANVTVTTEDGSHTDIVAVTVKEPIPEAPADVTVEPGENSADITV

SEQ ID NO: 687 - protein, 75 aa, Unknown
  Description of Unknown: Bacteriophage F44/10
MEKTLKVYSNGEVVGSQVANNDGATTVSITGLEAGKTYAKGDFKVAFANDSGESEKVDVPEFTTKTPTEEPSGDA

SEQ ID NO: 688 - protein, 86 aa, Unknown
  Description of Unknown: Bacteriophage F44/10
MDIPTILFRNPYDYTKVKKLMENKEQYIVVKFDSVSVHNLNVQGMMNVIQDYLHIYGYRVKEYGQENSSKDDERDVKGYLYERVGE

SEQ ID NO: 689 - protein, 251 aa, Unknown
  Description of Unknown: Bacteriophage F44/10
MGIIVNSNHIQSDTLYEYDSFFDIEKVDTFEEGLLSIQDEPTVLAGFIYDDITFNKVINSNSDIDDYIKNNDIYYVSDIGLLPDTFITVDSDRKYYSLLQQITELSKDPFPKWVEDDAKGLTKYYNFQDFEDVFDLNSFYKKEVDMVREKCYNNGNVYLLYEVLPDYKLPLAYSLLSNKEHGIVIIGSQTRSNNDILTFYVKGMDAKAIASMFNVEHDYDSNIFHTFVNSHINILGNQITKFIREKGSSYE

SEQ ID NO: 690 - protein, 416 aa, Unknown
  Description of Unknown: Bacteriophage F44/10
MSNYKTIEEVQAVIIGVLFKDEGKIITSKFNKITKEFGLDRIGKDDLKEIVEDIRQDAYLNELKNKAIKGKVTLGDLKDVADNQVFEGNNYHEEVSTYVVAKEKELSHLREQRKHNRHTAYPQIMFDELKEHMVKELQGETLVEHHGSKANINDTELIVLLSDFHIGSIVSDMTNGKYDFEVLKARLNHFINTTVKEIEDREISNVTVYFVGDLVEHINMRDVNQAFETEFTLAEQISKGTRLLIDILNVLSNVVSGELRFGIIGGNHDRMQGNKNQKIYNDNIAYVVLDSLLLFQEQGLLNGVDIIDNREDIYTIRDTFGGKSIIINHGDGLKGKGNHINKFILDSHIDLLITGHVHHFSVKQEDFNRMHIVASSPMGYNNYAKELHLSKTKPSQQLLFINKENKDIDIKTVFLD

SEQ ID NO: 691 - protein, 122 aa, Unknown
  Description of Unknown: Bacteriophage F44/10
MDTIFIIGVAFITFATFNIVFRLFDLWTTEKKMVSQGQPPLSNFEYYHVIVPYLVGVIVIILSIIFRDSLYSAQSGFGVIITSFIYMLVYVIIGLVGSFVLTIFQARKARQYQTQEDNNEVQ

SEQ ID NO: 692 - protein, 103 aa, Unknown
  Description of Unknown: Bacteriophage F44/10
MKFNDIYEQLIKNDTVQNIHESQDDKGNIYTIQFDKGNDKYLFNVINDGFLKEMTNGMVDHPEGQPYSVSLINKETPSMSVKQYLTDVEDIVPTIRKMEKDFL

SEQ ID NO: 693 - protein, 178 aa, Unknown
  Description of Unknown: Bacteriophage F44/10
MDFNFSAFDNSSLAMRISEGVYYFNDTPYYFIEHVEEEMSEYVIVYDIHDREEKENPQKKYRIEPYQRTIPGGTPLSNLIKSMMPQRKYPKKVTEDPIFVANVIPLGTDTVTGKTGKGFFERDKDRTIYSQKEPTKVVHGQYTGVFIGLTSVKWNRTYTPLESVVEYYKRVKGDRLNV

SEQ ID NO: 694 - protein, 255 aa, Unknown
  Description of Unknown: Bacteriophage F44/10
MSNDVVKFYEKDIKDLIRTKKHMFKDDEITSDINDIRIFNEKVICQGKCRTDCLVLDRNGTVMGIEIKTERDSTQRLNNQLKYYSLVCKYVYVMCHDKHVPKVEQILKRYKHNHVGIMSYISFKGKPVVGKYKDATPSPHRSPYHTMNILWKTNLMTILRLIRDPHTYRTGYSYNASGRYSGGEGNFSQTTQSKRMKKPAIINQIIHYVGVDNTYKLFTRGVIYGYNNRWEVIEEDFFNTMKNGVRVINEQRQTK

SEQ ID NO: 695 - protein, 148 aa, Unknown
  Description of Unknown: Bacteriophage F44/10
MSKDKPNRRKEIQHQPVNFAPTNTLTGANNSFFAKNPSEPKDATSVIEYRILFIKRFDNVTSTDVKLQKKYALNLISEALDVKETYLSLKQKGKKTESILHTDRVYYVHRGKKLIGKCSIREQRTFKGKHLIFIFKTRHRVKAERKDK

SEQ ID NO: 696 - protein, 287 aa, Unknown
  Description of Unknown: Bacteriophage F44/10
MLKGFSEHVDKPTTSKTLYKTLTSGKVELLGVSYDSDYFPSGVTVQSYIEDIGNEDEGLQFVNKVNVVESMKQAVVGMNNQLGSSGLGYVRTEQLKKELEETGLMTDLLARGTNLTSTKKVDIVSTFIEPEVTYQNITIAKDIKLRLYKVEEESPLNGYTHIVYLLTTEKLYDGQTLFGMLSKKDKLSKGDTDKLLAFFRNNSLISKSVFCVKLLSKDYYFNLYNTHETGIFFLEDTDVITIACGQSYVKVNTKDIKSSYVKIEDKTHKLTELVINLKGDDTLTILF

SEQ ID NO: 697 - protein, 243 aa, Unknown
  Description of Unknown: Bacteriophage F44/10
MARKKNLRNKNSDIKVVPDKEKESILSKLYHNKLLRSKVDNALDEDMSYDDIIELCKEYDLELSKSAITRYKSKRKEAIENGWDLGELIDKRKKTSVKDIKEKETPILEEEQLSPFEQSKHHTQTIYDDIQVLDMIISKGAKGLEFVETLDPALMIRAMETKDKITGNQLKGMSFIGLRELQLKQTAQDTAMSEVLLEFIPEEKHEEVLQRLEELQNEFYKNLDLDEESRKLKEALDRVGYTI

SEQ ID NO: 698 - protein, 152 aa, Unknown
  Description of Unknown: Bacteriophage F44/10
MADEISLNPIQDAKPIDDIVDIMTYLKNGKVLRVKQDNQGDILVRMSPGKHKFTEVSRDLDKESFYYKRHWVLYNVSVNSLITFDVYLDEEYSETTKVKYPKDTIVEYTREDQEKDVAMIKEILTDNNGNYFYALTGETMLFDENKLNKVKD

SEQ ID NO: 699 - protein, 147 aa, Unknown
  Description of Unknown: Bacteriophage F44/10
MFISLNQEEKELLTKEESKYTPLETSREFNTPKEEFIVTSYNEGKPLDYIAKEAKVSMGLIYTVLNYYKVGKRNKKSPVEERIAHILKDKNLVKEIIKDYQYMNLQDIYSKYNLHKNGLYYILDLYHVERKSELKDKALEEDNIVVE

SEQ ID NO: 700 - protein, 234 aa, Unknown
  Description of Unknown: Bacteriophage F44/10
MRNKKSFQEQLNDMRNKEKWVSEEEFTEEVAPSEEPEVEEEKLYTLNELKENLLDAQGLKDVVADFPASKDLYEPNKLYICTIPKGYRSTEVQPGQYIGISTGLLSESEDFSHLRGQMPRNLYETSHVLKPLVRINNTNLEYQQHELLEDIKDDKKIYDVELEDLRLVTGEEISHLEIVDSKFFESRINEILDRYTELTDSDDLLIYYSKLRELVGSDKMIYCSLLDKCVKIID

SEQ ID NO: 701 - protein, 132 aa, Unknown
  Description of Unknown: Bacteriophage F44/10
MSRKASIFYILVVIVLAFSISSYYISSFMYHDKAKNEVSTELSNTGKIKEEKNVEFVGDYTLKKVENNKAYFMETLPTYLPGRTGDNSIDMRYYKTSRFKEGVNFKLIRVYTEDGEDNPIHKYRFEAVPTKK

SEQ ID NO: 702 - protein, 80 aa, Unknown
  Description of Unknown: Bacteriophage F44/10
MEMADLERFDTFVRLVSDDELSEERALELSVDLLNPILEGGTAYQAKKRIRSKFGKIEAKNFKRNYKFLLKSIAQIDQRR

SEQ ID NO: 703 - protein, 185 aa, Unknown
  Description of Unknown: Bacteriophage F44/10
MIEREKLVKEIEDANRDIQLRLKEVDDYKDSIRSKGTRNYVSTKVLDSVMVGLIISFFILVMLRVLEYFVTGNAVYSPLAPAVIIMFVLALGTWKVSKMNKIVSYRGTIKMYWELSNAEQNQAKVFKYPNDEVDIVSKHNLRQITFSEINILHLKYMRYNKAVEQHTKLSKELFKKDKETVDKNK

SEQ ID NO: 704 - protein, 58 aa, Unknown
  Description of Unknown: Bacteriophage F44/10
MVIPSIKAQNKFKNELEYYKQGHISESKMLELAFDYIQELEQNNEYVTNLLEEERYGE

SEQ ID NO: 705 - protein, 82 aa, Unknown
  Description of Unknown: Bacteriophage F44/10
VSKFIGVYLFNLLVVALIYTVGFLFFYGVASLVIILTHATIDPFVLATFLGIGFLVIRTAHRIMARVINDAVAKAIKDKENE

SEQ ID NO: 706 - protein, 77 aa, Unknown
  Description of Unknown: Bacteriophage F44/10
MNKGEFIMDKTLPKFSVYEVIVKTVIMTPTEGSSDLESFYFSTRELAERFVEENTVETKNGKRVSFAVKERKVNQPG

SEQ ID NO: 707 - protein, 162 aa, Unknown
  Description of Unknown: Bacteriophage F44/10
MKVSEEVKQSYLENRANTKMDKISWSELRSSPLGITLGDIIFYSVVIIDNIIAIILTLTLIGTITDSIESTLAQIIVGMFIIITIYGILSALIPILVHKAVSPGWSYTEWNESYYIRLPGEENYKYYSKWYLDLLGVKEFYYKRDNGEEVKEKIYHGLFKLK

SEQ ID NO: 708 - protein, 39 aa, Unknown
  Description of Unknown: Bacteriophage F44/10
LLTNRPLTILEYKKLKKLDKESEIRKQEDLEEYKQYNSN

SEQ ID NO: 709 - protein, 82 aa, Unknown
  Description of Unknown: Bacteriophage F44/10
MISSFDSILLVIYIIIAFAVAMAIIYLVFKGMTILLDKLMMLLLSKTTLDVEACSMIMAVISTIVFGIIVLLIWLAVNNILL

SEQ ID NO: 710 - protein, 58 aa, Unknown
  Description of Unknown: Bacteriophage F44/10
MDFNDFINSESDRVGKPKQKKKVENKLPSSTPIEDKEKKLKEIRKKSLYIDLRRKRND

SEQ ID NO: 711 - protein, 98 aa, Unknown
  Description of Unknown: Bacteriophage F44/10
MTKETNVLYKDKYRDYTIVVRLAGNIIVTEVDKKHKTAFTPIIFDNGVEGVELVMRIGSVELSMTDLREFTKEVSTAQKALEYFNKKLYIKGLTDEAF

SEQ ID NO: 712 - protein, 60 aa, Unknown
  Description of Unknown: Bacteriophage F44/10
MLLGILWFIWGFVSYFVLMFGIEFWKDRWMPGVIGAGALLLFLFWIMKSIHNAMTVVYLY

SEQ ID NO: 713 - protein, 123 aa, Unknown
  Description of Unknown: Bacteriophage F44/10
MIDILVIHYEETNKRVLKETIQTIQNHLNDEHGLVKMTATKLSRENIEKRFNNYNIVIAEDDPDNSYHYGEAVEDADFIIDIPISYLDIHAGIEWDVDNPVDMLDRNPDFIEAVNKLNEDLML

SEQ ID NO: 714 - protein, 115 aa, Unknown
  Description of Unknown: Bacteriophage F44/10
MLNEKLKNLEDTKVYMINSIASLLSASTGKSSKVFFDEGTIKIVSGETKAVEVIDNLVHPHSGRLPIKTTERIALGRLTDSLQFVISEIEVVKDQIIDEENEAYIDFVMEDWNWD

SEQ ID NO: 715 - protein, 92 aa, Unknown
  Description of Unknown: Bacteriophage F44/10
MPMDLLTIASVAFIAVVIIDLINDDMSYMLTGTAILINIWAGFYGWFFLLQAGMLLFLLLARKVKDDKESILYSSASLICALGMIINLLSFS

SEQ ID NO: 716 - protein, 101 aa, Unknown
  Description of Unknown: Bacteriophage F44/10
MSKETIRRQFSNAIEIMATTKEWWNFPKSFDTNKEFKIKTFKNDTLVFEVREGSRNLGSFVVFTNIDFDYDKLEGTSTQYMINYFAKKLTKDMFNYHKLQL

SEQ ID NO: 717 - protein, 116 aa, Unknown
  Description of Unknown: Bacteriophage F44/10
MREELKPFNRKQVNVKGYLDDVKYSKRRRHKGNQHGCVKITVTDVKINGIPIDHVNIEVGISFYEKLKELQGKRIQFVGTVYKYVKHARGRKGRIKGFYKEDYSVTLDKKLQKEEK

SEQ ID NO: 718 - protein, 59 aa, Unknown
  Description of Unknown: Bacteriophage F44/10
MTEWYALCYYDKVGKKKIPRQVRAHRDISVLEELKERLEERNPNTEYSIKTTKEFDEER

SEQ ID NO: 719 - protein, 136 aa, Unknown
  Description of Unknown: Bacteriophage F44/10
VKLEDKVLERIDSLGGKLGDISQHAWEALVKYQIIYGIIDLIVGIVVIALTLFLWKVFINQHKKVNDMDRDDDYSLLFEDCEDLSGIGLFYVIVTSLISLFAFIYLIYGIPMDIIKILNPEVFAVKDLIEQAKGGN

SEQ ID NO: 720 - protein, 97 aa, Unknown
  Description of Unknown: Bacteriophage F44/10
MKQRDFEFEEDFVLTYECEDCKHFEDWGHDEEPEECSECGSSDLINNTSHEDTECDMCKGYIDMWQDGYRYMGDNKAYLEKEDSGLICEDCYEKLDI

SEQ ID NO: 721 - protein, 95 aa, Unknown
  Description of Unknown: Bacteriophage F44/10
MNKAVEQASNAVGQGFSAMVWHQVLVGLGFILLGLILSLLVWVLVKKFHVPFNHPTAFVVYSIMLVSIVASFIWGGLHVINPEYYAILELKGFIK

SEQ ID NO: 722 - protein, 37 aa, Unknown
  Description of Unknown: Bacteriophage F44/10
MTKEELEQRVKELEAENKELKKQIERFEDEGGKTKDE

SEQ ID NO: 723 - protein, 88 aa, Unknown
  Description of Unknown: Bacteriophage F44/10
MNSRQKKILTLTVSNFLILALDTVALIRYKKGKIKQENYNTGQITRMIATTANSLGILYLEEQERKEVKDIKVGTFEIGALKRFTNNK

SEQ ID NO: 724 - protein, 101 aa, Unknown
  Description of Unknown: Bacteriophage F44/10
MKGIIIFYKEETKEDLGYFLGFINFKLEGLSYTTEGTLVDNDVVVLKDNQINEDNLEQFSMSNNNLVIGILGHSSLSVRIYEKGIRQEFDRVEEYLEELRQ

SEQ ID NO: 725 - protein, 133 aa, Unknown
  Description of Unknown: Bacteriophage F44/10
MIFILIFGLLFILSLLGIFIYSIVLRKKKQLIEERESFGIYNRTKEKLGDVTRLGYEEDVYKLIHNQSNKTIIEDKKSKVVDTIKKMYELELTSVDVSKVEGLSPLDTEPMTNMKLLSYKLDREGLYSLSKFI

SEQ ID NO: 726 - protein, 78 aa, Unknown
  Description of Unknown: Bacteriophage F44/10
MEFIDKNNVIKAYDIPNVYLKGYVLQACDKNGDTTAYDGYDQIHYKEGRVLTFPFDKPLRKINVLSGYYKLFKKEDII

SEQ ID NO: 727 - protein, 175 aa, Unknown
  Description of Unknown: Bacteriophage F44/10
MIYFVSDLHFGHDNIREFEAPTRSHWNSVEEMNEGLIELWNNTITNNDIVYNIGDFFFNMKPSKVEDILNRLNYKEMILIAGNHDHKKLIKLYERNGITVKYADMIKKDGKRFYLSHYPTLIGRKNMFNIHGHIHSQLMGTEYHINVGYDVEGKIAYSFDDIISRAGEYNGEIQR

SEQ ID NO: 728 - protein, 103 aa, Unknown
  Description of Unknown: Bacteriophage F44/10
MEKFKGKDLYKTRIRKQTIKNLVIKTEKLHNKHGKYRPIGHVYYYPKTKEFTLSKPEQKIFIEYMKALGFSVKHKRRKKIIIVYKNVLDEYLSMYQEAIESTC

SEQ ID NO: 729 - protein, 59 aa, Unknown
  Description of Unknown: Bacteriophage F44/10
MKHFILILGIVILVIALGIVLPAWILQLVLSAFGVKVSIWVCIGIFILISAVGSMFSRN

SEQ ID NO: 730 - protein, 87 aa, Unknown
  Description of Unknown: Bacteriophage F44/10
MAKYESNINGENYIATPSQALREALAELIREEKNFAEYQTKGEEQYESQLQLRHFDSMISQYEEAIRVLEDRYSPQIFIPKDNKEEK

SEQ ID NO: 731 - protein, 105 aa, Unknown
  Description of Unknown: Bacteriophage F44/10
MKAESIARFFQDKVLQIEGYKVRFTQASSSYILDIDTMDESVLFLDTVVFTLSGKYLLDTHITINKPETLSSNELYTEISNKLQEIVGDQTKTDIELSKYFKEVK

SEQ ID NO: 732 - protein, 226 aa, Unknown
  Description of Unknown: Bacteriophage F44/10
MSSEAITNHLLNLNQIKIKEYNIHAYIKKSVCSGIENADFEVRINYIADKDPNYIRTINSIIFVDYSNRNPKEILLQFKEKILSIVKEQVEIDNDFIEAIKDINTNHELEKLEPFINKEYYSMFKSSIEKEVPVALSSEVLNRCTGKTSTLAYLAIEKDLPLIVSNNSMMKMLKKDYPSVKVSSVEDFSNYNIKGEIVLIDEVDVDQLYSADRVSVDALLVGIIKN

SEQ ID NO: 733 - protein, 52 aa, Unknown
  Description of Unknown: Bacteriophage F44/10
MVGIIILIVGLILFLASGYKLVLGKYYDDIDLKMLFTIFGIGAILLLTGFIL

SEQ ID NO: 734 - protein, 74 aa, Unknown
  Description of Unknown: Bacteriophage F44/10
MNYKEVLEVIKKNKPCKVRFTGSILAIVNKEFNADTDKGILQIDVSNINKNDYIKLQQYCLERDDYTVAGAILF

SEQ ID NO: 735 - protein, 66 aa, Unknown
  Description of Unknown: Bacteriophage F44/10
MNYRDFITDCISCGYKVHISVTEKRVHIISEMTSASYPKKEINLDELQAYVYYMNNFGSQITTEGL

SEQ ID NO: 736 - protein, 96 aa, Unknown
  Description of Unknown: Bacteriophage F44/10
MELVINIIAVLIGMYGIYFYVTKFSTGLSGILIVLGMAVGLYFYLDYLNVRENVIRLVSVMFGAFLFSIEMIYNKIMFEIKKSKYDKTVRTYRGDQ

SEQ ID NO: 737 - protein, 117 aa, Unknown
  Description of Unknown: Bacteriophage F44/10
MNARKARKNTKNHKDSSVVTKEQHLTYIYNKINYLIANSSSQGKTYVVMNLRTGYPDEFSLSKLKYLKEIKQHYKDLGFTVQTQVRKSRWSEKSIIRYYFNLGYIDSVLVPIIHISW

SEQ ID NO: 738 - protein, 57 aa, Unknown
  Description of Unknown: Bacteriophage F44/10
MDNPNLNKKTLRAVIREMDKDIEERAEALRREETRLSIARDNRKRLYIELESILEEE

SEQ ID NO: 739 - protein, 74 aa, Unknown
  Description of Unknown: Bacteriophage F44/10
MDFNLKDYAVRPITDKEGNMVVRTVYVCLKREYSDWVVDKVYGRQESSETWLKFMQEIRNIERAKLRVEKWQVN

SEQ ID NO: 740 - protein, 52 aa, Unknown
  Description of Unknown: Bacteriophage F44/10
MSLSELLEYHKNSGKERAEYISDNGNCRVAIMHYDKWAVVGDLENAVFTIEK

SEQ ID NO: 741 - protein, 33 aa, Unknown
  Description of Unknown: Bacteriophage F44/10
MYLFAKIIIISIDVIPLMSIIVVQLITDYNDRH

SEQ ID NO: 742 - protein, 56 aa, Unknown
  Description of Unknown: Bacteriophage F44/10
MIIPLIILMMTFGTFAFSYVAHDAYRVDEKGIMYAMVVGIVVINVIGLEMIIVECL

SEQ ID NO: 743 - protein, 97 aa, Unknown
  Description of Unknown: Bacteriophage F44/10
MIDIYLHSEYDKDKLKFILKAIRDFSPRELTYDFRNPKADVSIQELLGDDIDIFESIALDYPNDINILVGDSGYSIVYQNDFLTISGLSTAMKEVIG

SEQ ID NO: 744 - protein, 61 aa, Unknown
  Description of Unknown: Bacteriophage F44/10
MIGFTILSTIMVILVIAMYTQVLVDMIQSIRYDRFDKVLNIVTFIVMTVVLVSGILIMFDI

SEQ ID NO: 745 - protein, 104 aa, Unknown
  Description of Unknown: Bacteriophage F44/10
MKAIVYCAKRYSKHTLKHILEELEAENSDLTFSTEISDLGEVDIVVQHTKLPFSELMDLCSKVSKGSDRFYVFVGNHSGYYINGDLYINEIGKFITSRETNVMM

SEQ ID NO: 746 - protein, 105 aa, Unknown
  Description of Unknown: Bacteriophage F44/10
MIEIRLVEGYDKSQLKFMLKKIKRVAPRELTYDIEAGIDSVDVNIEDVLPHKSPQEYERYSMLLEEDLWIVILESGYIAYWDGKKYGGEALDDIIYNMFKGRGRL

SEQ ID NO: 747 - protein, 98 aa, Unknown
  Description of Unknown: Bacteriophage F44/10
MIEVFLSKDYDKDLLKAYLEYIRKSASRELKYNTNHTKGTDVNIENIISYTNQEVHHFSSYGMYRDDLCVFIDNTRVSEYLNGEPVGVDTIYKYIKEM

SEQ ID NO: 748 - protein, 85 aa, Unknown
  Description of Unknown: Bacteriophage F44/10
MFKVYYTVYHRQSMKTIKDKLDRSGLIYFLYETWYKDINNVCPSNYNPEFGSLNKDIDIDRLIEAVNEEGILLINHGNYVTVEEW

SEQ ID NO: 749 - protein, 202 aa, Unknown
  Description of Unknown: Bacteriophage F44/10
MIDIEIKIWDETLRMQVEEEDVLSFLSKFKNKTTGDKEESYGVGLDESKWKVHPFYTRYEVHPEGYVRLKDTKTPVIFTKYRKELHHKPQFISSNIMDDEGKHTVALHKLVADTFIPIPWYLQGYNYTDLSVGLKDGDYENKEAVKAYNLAWYVGRIRGNAPMIKLMDLEDDRVLYFASIPQIENFIRDNKLDPKRFNYKTE

SEQ ID NO: 750 - protein, 84 aa, Unknown
  Description of Unknown: Bacteriophage F44/10
MEFKFEGTKEELNKEVHNLLKKVNYVYQVNIFENELRNLIDVKEKDYLFSLSVDYNWLMEEKQKDGYNDLASAIYEEYIETYLN

SEQ ID NO: 751 - protein, 102 aa, Unknown
  Description of Unknown: Bacteriophage F44/10
MDVKEIANTIMELWQMDGYRCTEPPLYESTLNHTRTYTALIVSIKGNYDTVQMFRKTPIMSMRGQAQPASMLVNVIDDVIIIVYENVVYGVQNKEIKFIEEI

SEQ ID NO: 752 - protein, 95 aa, Unknown
  Description of Unknown: Bacteriophage F44/10
MTNKNYLYEEAHTVQGNEITAFRIPNDANGNPRYVVHFMDLNIKLADYDNINKLYGFNKYRAKWFGGGVVFQSYNIEDTLNFALDKVKEIEAVKN

SEQ ID NO: 753 - protein, 63 aa, Unknown
  Description of Unknown: Bacteriophage F44/10
MKFKIEKNNSDIKTLWNLAKNGYMSYQTVHNIFKNESDEFIIFNSKQTYNKFMELRYNRSAIQ

SEQ ID NO: 754 - protein, 52 aa, Unknown
  Description of Unknown: Bacteriophage F44/10
MLKFKWKNKTIKSTQKTDNILLLIIGGLVATITPKLVNWFLLLQDNINIFLR

SEQ ID NO: 755 - protein, 43 aa, Unknown
  Description of Unknown: Bacteriophage F44/10
MKKITTTLNLIGMKNNERFTEELKNYRQDVTFLKANKIVKYSK

SEQ ID NO: 756 - protein, 107 aa, Unknown
  Description of Unknown: Bacteriophage F44/10
MKFIKTIENLLTKAENKGQAILNGRYYDGYRNGELEEKYAIEIEGNKLVMRHWGTQTIEIDLGMKEIVSYYGESNSDRDSLNTLVYCLGIAPNFRYLPSKDLFIYEN

SEQ ID NO: 757 - protein, 133 aa, Unknown
  Description of Unknown: Bacteriophage F44/10
MFKLQNKVEIIVPKYTNSGKEISSPAIKEAVNNATKICGGCTITEIKGQWWSDDEQRIMEDDNLNLEWYYDKGMQDMNDQQGLLQALSKIARQLIVFYEQEAISIKINGTLYIIDYEDLDLLSYDLYELMFKN

SEQ ID NO: 758 - protein, 73 aa, Unknown
  Description of Unknown: Bacteriophage F44/10
MNRLEIVKDTAMEYILMMDNSVMDGVMTQEEYNEAVSFEKVYDYTLSEANQECKFLGGKVLTFLVHEAIEEYA

SEQ ID NO: 759 - protein, 45 aa, Unknown
  Description of Unknown: Bacteriophage F44/10
MRYEIVTLVNGELFMFATFKKAEAENKYQEWCDLYGQENVSMEKN

SEQ ID NO: 760 - protein, 54 aa, Unknown
  Description of Unknown: Bacteriophage F44/10
MTKTIKQLESQLERLERKSDEQLANGYYEAFERTCAQIRELDLQIELKKNSETV

SEQ ID NO: 761 - protein, 78 aa, Unknown
  Description of Unknown: Bacteriophage F44/10
MKLLNRDNEIVISIATLESVKQALIWEYIDHIDNNILDSEIYDQEAVVVTSKTLQSIKFADTMEDLQEYIADINWKLV

SEQ ID NO: 762 - protein, 157 aa, Unknown
  Description of Unknown: Bacteriophage F44/10
MTNTIKGFLQTEEASTVKDVATHGVQSGAIGRLIYTSDVVKFFDRHYSDIEAVVLDFLEGFTGQRYYDLLDYDLMRELEEHANVEFEDEDEYNNIQFDLAENIASDEIEGFEDMDEAEQADAVIEAMDDVELEILDTDKVQFVNLAVEIVAQQMQEA

SEQ ID NO: 763 - protein, 54 aa, Unknown
  Description of Unknown: Bacteriophage F44/10
MTIKEIINQLQAVENKELELFVCDKEGNNISIKDITLFDSEAEHTENNPLGINY

SEQ ID NO: 764 - protein, 89 aa, Unknown
  Description of Unknown: Bacteriophage F44/10
LNIREVHNVVKSAKSKLLQEQNNINNVMIDDYITEELHRRTQRSGTIQMNNNTASYSNGSYGSLEEIREAYDLSSLSTNEIKELLETFV

SEQ ID NO: 765 - protein, 73 aa, Unknown
  Description of Unknown: Bacteriophage F44/10
MRDLQERKRELKTLLFNLAIEKNRATDETLRSVLEEAHQEVGNQLRKVRKEIEILVEEKEREFWNDFDFNGLD

SEQ ID NO: 766 - protein, 759 aa, Unknown
  Description of Unknown: Bacteriophage F44/10
MPHLKAYDKEGNILAIGYNVYTEQGSVIIPNLKPHTKYPQGEFYVSWEGDNYESEKTVVPEFTTLESSYKEITFYAKDILTVKPKTAYDIAVDNGFTGTEEEWVKSIKGEPGEPGKPGEPGKPGEPGKTGEPGKDFTFDRFTEEQLDSLRVFVNPSDSNLQEVNKTMEDSLIVYPDNGEDIRLYPSTVDKTYFSNITIRNSIPENTMNPDGSFTLNSNGWLFYTVKAVEKLAPGKTFSAKIITDDVPDPKASFEYSIQDSDGSYIQTITQLNKINDTTFAINNINIPENSSKISLRIDTRQVTSPVNIKQFLLFDGSSTKKIQTVNNEEFIKGLIKEIDNMKISMKKETSYKIPVFTPVDYLIKDHPLVNNIFTDGLGKFSTSLNMENFKLRGGKSYYVDGENGNDTNDGLSQSTPFKTFKKAQGIINNGDTLYVSDGDYFRVGGTLLPPISNKSINIIGLGSNVNLFMADEPTWTKTSGRDSTYEFTRSAVRRVVDFNNDREFTNVTSLDKVDTTLFSWYSDGTKVYVNNGSIEPNKKVVPLLSSQHLIVSSVPTDFYIENLNLYGGARPARFELNQDNSVYINNCVLSYASQVNGNGLEIVGGKEVIVNNSVANNNYMDGFNYHIGADSSKPLVIEINCTALENGFEKGTAGTKSNNGSTTHDGLKAIRVNGIYARNDGGNVADVNEGTESWNLGCTAFESYQGKDFQTSSGSHMWLDSCIAYGSTNSINSSDPNSKIYTRLGSYQNKLILGEEIKY

SEQ ID NO: 767 - protein, 85 aa, Unknown
  Description of Unknown: Bacteriophage F44/10
MKLYQVEHDNCEPYEDNFHFREDNVYTNKEKLIKRIKEEGYREETNYRGEQEFIKGDPRGFDGMDMITIHELNIVDCDINIKKGN

SEQ ID NO: 768 - protein, 81 aa, Unknown
  Description of Unknown: Bacteriophage F44/10
MEFFIDRTSTINKKPIEGAYIKKLELVDQKGNPFTLERWCVEINSLEELTEISKHEGEVIINTRGDSPFSPYLEIYDYYRE

SEQ ID NO: 769 - protein, 56 aa, Unknown
  Description of Unknown: Bacteriophage F44/10
MERFKVKRIITTEEVRYIDAETEEDAWYSVEYEDEGTDTAHFNAEYGEWSYEKEEN

SEQ ID NO: 770 - protein, 160 aa, Unknown
  Description of Unknown: Bacteriophage F44/10
MNKTFFKAIGKNTLEYSKQGLGFLVALLIMLIILSVFLAFIIGIPAGIIYGLYALDINNYFITMLVTVEWFIILYGIVRTQDNKKPFVKLKLKDYLLTILYLTTITATSVLESVLLFKVLPFTGDTRAVITLLSFLLFLAVNRGICKIVIKSYKEYKEEN

SEQ ID NO: 771 - protein, 83 aa, Unknown
  Description of Unknown: Bacteriophage F44/10
MIFKKHKEEEVKKDINFIRIHDVSGTSTIIKQKDTKTNLNSFIGGLVFNGVKFLESNKGDTSIWFKDNIIHIDTVYYKEVADE

SEQ ID NO: 772 - protein, 81 aa, Unknown
  Description of Unknown: Bacteriophage F44/10
MAYEYKNKIQDIITDNENYWCIDNEKELEELQEVYQKAEAFDEIVNEFHYQLQNLESWNTLDQKDCQTLKQILEENIKEEE

SEQ ID NO: 773 - protein, 138 aa, Unknown
  Description of Unknown: Bacteriophage F44/10
MNIKYIDLVLENCDVVRLEPKDVKRFHVDGITEGIDYYGTSHISRTRRCTYFGILIDNPKEISQVGFAYPDNTNAYEMITAYSDITAIDIIYDDDTNEYTYVDFNEYNDYYNINQKNEYYNNMLEVTITESNSIEEEG

SEQ ID NO: 774 - protein, 164 aa, Unknown
  Description of Unknown: Bacteriophage F44/10
MKETKEYIMFWGKEDIYSNFYPITFKHKGRTFNNSEQAFMWRKAQYFKDWQIAGEILNAKHPNHAKSLGRKVRNFNEEQWNKVRYDIMVEVVKDKFMTTHLKQKILDTDLRKDFVEASPYDKIWGVGIKANDPKILDESNWKGQNLLGKVMEDVRVHCVYNRFK

SEQ ID NO: 775 - protein, 132 aa, Unknown
  Description of Unknown: Bacteriophage F44/10
MKKRYFKGLKLNDFEKEVFGLKKNKKYKKMNKELGRNEPKYWNYDMSFFIQLYADLNAFVESSNHVDMEYHTFTDIEGKERTQIDMIKHILSLIQFYHESMDSFDVDNEDEIEQVQNKILDNFKIVLPSLWN

SEQ ID NO: 776 - protein, 235 aa, Unknown
  Description of Unknown: Bacteriophage F44/10
MAIYVVPDIHGEYQKLLTIMDKINNERKPKETIVFLGDYVDRGKRSKDVVNYIFDLMSNDDNVVTLLGNHDDEFYNVMENVDRLSIYDIEWLSRYCIETLNSYGVSTVTLKYSSVEENLRSNYDFIKSELKKLKESDDYRKFKILMVNCRKYYKEDKYIFSHSGGVSWKPVEEQTIDQLIWSRDFQPRKDGFTYVCGHTPTDSGEVEINGDMLMCDVGAVFRDIDLPFIKLEGNS

SEQ ID NO: 777 - protein, 183 aa, Unknown
  Description of Unknown: Bacteriophage F44/10
MVNVLPSVYDAEKGEWVTLLAKPIAEEVFKIMKADYLEHKGNIGFFISKYKDGDSSIEQHNVVVFYNEKDYDTMELTESELTDALNEYIDYTLDGKYKPFSLNNFINYLEDYGYRLPVNFEVDVTIILSDGQKFTYPRTSSITNNASIVDALKSEDQYIEVKYIYNDHAIDDKKLAHGNDTLK

SEQ ID NO: 778 - protein, 105 aa, Unknown
  Description of Unknown: Bacteriophage F44/10
VERTLNLYDSKGKLLKSSEKITGASAKIIIEKLTPNTVYSQGSFKISWTINGKESILTDVPEFTTKSNEDKQEIVFNTLNIDSNSFVVSETEPSDKSKLWFKPIN

SEQ ID NO: 779 - RNA, 39 nt, Unknown
  Description of Unknown: Bacteriophage F44/10
ggacucuuagcuuaaagguaaagccaaccgcucauaacg

SEQ ID NO: 780 - protein, 26 aa, Unknown
  Description of Unknown: Bacteriophage F44/10
KYLLKHSKEADIRSTSKIMDSIDKLT

SEQ ID NO: 781 - DNA, 166679 bp, Unknown
  Description of Unknown: Bacteriophage F387/08
cgttagcacctttataaccgatggtgaagtaatcctgacgagcatactggtcgatgtatacacggtagcgaccacccagaacaccagcaaatactgctttagtggtgtcggtattataaccacgacccagaccctgagctgccggagatacgttggtatcaacagctgccagtacgttaactacgttacgggaagcgataatgaagttaccttcaccgcgaccggtctgacgagcgatttcagcggattctttgtcaatctggaacagcagagctttaaagctttcacctgcccaacgagcaccgcggatatcaatcgggtcttggaagtcgaatacaccagctttagaaccaacagtctgggtcataccagatttaccaacctgagcggagtagttaatccagtcaacaacttcacggttgatttccagcataatttcggtagccaggattgaactcaattcagcatcagcgtccataccgtgaacagcacggaggtcctgagccagttcgatggaatactgtgctttcagctgacgagatttcgcttcgatagtttgtttatcgatacggaagcccatttcattccacgggttatctttagaaccgttaaatgcttcttgcagttcagcaacggaagtagccataccttcggcgatttctacaactttaccagcttccagagcagcagtaactgcagcgtccagtttagcagcatcggtagcaccagcgtctacagtgaaatcttcaacaacctgcagatgagcacgaccggtctgtgcgaaatcgtgaacaacgatatcaccaacagtcagagcagcaccagctttaactgcttcaaacttctcggttgcaccctgaccagagaacattgcatccggagcgtacatcggatggaaagcttctttagcaccagcagccagagggtctttgccgtaaacagcgcggagagcgaatacctgaccggttgggttagacatcggctgtacaccacagatatcgaaagcaatcaggttagggatagcacgacgaaccatacccataactgccgggccaatctgggttacagcaccagaggtctgaccagctgcgatgttctgtgcatcataaccgtggtcaccgccaatttctgcttcagacaggaaagaaccaaatgcttcagcgattttttcatcgcggtattctggagcctgattaatatcagcttcctggttttcaaaaatcttagcgatcagagcttttttgctagcgccaacaatttccggcagagcttcgttctcaagcagcggctgccatttttcgataagtttattctttttcatgtgttgtataaccttttaaattaagaaagacgagccgcttgggccacataagcatccataacggatggggttttagtcgcaggagtttcttctactgcttcagttgtgaagtttaaaccgtctgcttctttgtcgatagtatttatatcggcagattccgttacagactgctctacagaaccctgcaccatttcaacaatagctttcagcttagttgaaaatgcgtcagaataatccatgccctctgtcagagaaactactttctctttttgggtatcagtcagttcacgggttgcttcttggatagcatactcacgttgggcataattgatatactcatcgcgcttagaaacttcttcaaataaacgagcagtttctgctttttgctcagcaagttcttcttccatctcagctactacgtctactgattcttcaggaattacaacgttgtgctcaacaaacagctctttcataccgacaaacatggattcaaacaggtcagctttaataccgcggtcaaccgccagctggttttctgccatccattctgcagcgatatggtcaaagtatttagaagcagcttctttcagctcttcgcgagcttcttctttagctttttctttttcttcttctactttttcttctgctttctcagcaatcttttcaatgtgagattctgccagagctacggcgtgttttttgactgttgcttcgaatacagtgctgaagttagctttagcttccggagaaagctgaactgattcgaaaatactgtcaagagcgacggaagcatcgatagttttagcttcggtcattaaaagttctttaagcatttttgatgtcctgtgttaagttacataattatttataacgcttttaacttctctgcgagagccataaaagcatcatcagcactattggcaacttgtgccgaggtattttccgaaatttgtttcggttgtacccatgcatccggagcactaggaccccaaactgcgtctacaccaacagtcaggcgaaagccttcttgtacgatgttatatccttttcctgagtcttttaaagaaccgagcccgcggcttgatacaccaggaatccaaccagcacggatgttagcggctaatttatcacctggaccgtggtctccttcgatgattcttgcacgcccataaacatcgttgcctttccaccacatatcttcgataatgattgcggcttgcatcgggtcaacatttgcgcgaggtggatggtttaattctcctagagcctgacgagtagcaacctgttccttaatataacgacttaccgcagtctcaagaatgcgttttggataaagacgtttattacggtttactacttctgcctgcataaaaacaccttcaatatacagaccaggttttaagccagattcattttcgccttcaacgataatagattctagcatgggtttaccatcaattacatcgcccggttgaccccaatgctcaattaaaagttgttcattgaggttttccattaacttagccccagagcctgacggcgtttaagtgctttcttacgtttacgtaatccacgagtttgagccgatggattagcacgttttgattttactgctttacgcgcgatttgacggcgtttagctttagaaagtccagttgtttggaacgcgttacgctcacgtgttttacgatccttagtacgtgtaatagtacctttagaatcaacatgtttaacgataaattcatttagttgtagagattcattgattgaacctaaagcaattgctaaatcaggctcagaaacaacaagattctctacaattttatttatatcatctttagagagcgctgcggacaacttatcaaaacgcgcctgggcttcaggaagaagagcttcgacagtgtcgataactaattcatgattttcaggcagtataagcattactcgtcctcttcgtcgtcttcgtctttatcagacttatcttcgtcttcgtcgtcttcatcttcgtcctcatcgggctcttcaccctcaatcatgacagacgctgcgataaattttttgcgctcttcaattaaaccagatgtccgttcagccataattgcaccaaaagcttttttggctgctacgaggtctctggattcaattgcggaaatataattttccattagaaatcctcttcattttcttggtcttggaagcgagcctctttagactctaattcaatttgcttggcttcttgttcaatttcttcatctgacatctgaaggaagtctttcattgctgtcttatgagaaatatacttgccgataaacggttcagccattgtgagcatattgattctacgctccataacttcagcatctttcaactcggtgaaatatgaatctttatggaacacaatcttaatattatttatttcgtcttcccactcatctttagacaaaacttttttaagaattagattagtgcgaagtggatcaagcataatctcttcgaatttatgctgtaatctacgaataaatttagcaaaatcaagctcatcgcgagtaattgctgtgccagcatcaaactgcacaccgccttgattatttgcatccggcatgcgcgaaagaggaactcgcaatgccatgtataacgctgttctaaagtaacggacgtcatccatatcactcatacctgacataccaggaagagtatctacttcagtaactgctttaccatctctacgctgcaaccaatagtcttctgtcattgacatattatgttgctgatttttaatcttaccggttgatgcatcatatacaacgcgatttttcatcgtgttcataatatgttgcatatgagctgccgctttacgagaaggcatattaccagtgtcaatgtaaaacacacgacggtcaggagcacgagtaatacgataaattaccaacgcatcttctaatagctttaactggttggcgggtttaacggctcggtgtaaataaccgatgatgttttgacctgaacaatcaactagtccagaatgtgcatatacgatagcatcgcgtggaattttaattttcgttccggcggaatataatctgccatctgcataataactttctttgccagtatcgtaaatgaaatactctttgtaccccttaacgattttagtaccagcgtcatcagcagtaacgatttcacggatgaattgtaagttgcgcgggtcaagacgtctcagttcctgaattccgtctttcattttcttggtgttgacgattttatggaagaatattcttgagtcaacataccaacggcggaaatggtcagcgccctttcgctcgaaattaaggcatgttaaaactgtattaaactcttcaagaatgcggtctttaattgcttgactgaagtcagtagaatctaaatcaagagaaactactggatgaccgtcttcgtatacaactgcgtcagaaactatttcttcaacagcattgtcaacttcgtagttattcattaaactacgataagtgttgattaaatcagcagttgttttcattccaggttcattggaaccaaacatcatttggttgaatgaattgtactggatttcgttttcgtttgattcaacttcacgagctccatcatcaaattttggagcagtgattgactctaggtcattgttgatttgttgcttatattcagcttcgtcgcgtttttcccacggagcgaataagtccaaaatatgaaaggccattggagtctccgaaattatctataagtatatttatatcgaagataaacatgctttatgatatctcataattgcactacgtgttgactccactccgcatactggacaagtcattcgtggctggtttatcttttttcctttgttagggtgctcttttccgaacataggatttctttcacccgacattgctttagaatggtcaggtcgttttcttccggataatttaatagagtgatctggacgttttattcctaaccgctgatgacgttgtttttctttagactcttcactcatttttcttcctttagttgacatcccaaagaaaccgtttggttgtgctaaagccatatttatatacgaactggatttaactacgtcgtattttatttgcaactcaagttcagctttagaagcttcctctcgagtttcatatgtgtttaatatccgggttttgaataaatgaggattatcatgttgctcactcttccagaggtctttatatttcttggatttaactgagccatgataattttcatcaataattcgtgatacactagtagaaccgatgtagcgacggggaagtttattccccgtgtatattgtcaaataagtacagaacattaatacctccacttcgttgttagaggtatttattcagcattattcccaccaatcgatagcaaaggtagtttcaaacgtttctatctcattattcgaatcccaatccatctgtacttcaccaacgttagttggccacagaccagtaatggtgtgttcatttgtgatagttttgccatcacgactaaactggcgtaccgtagcaacctttttgtaatcggctggagtcataccagagatatcattgccttgagcgtgggcctgagcctgccaagcaataattgccttacgtacttcgtgtttatcatcgttatagatggtaacagtccagtcgtcataagtacggtcaccagcgacgttaatcttacggttcatgtacccgactggaactttttctacgatacctgccggcatcggtgctgctttacatttgaaactgaagttacgacccagataaggaatttctacctcaaacaggttaggacgcgcaaagtcaccagattcaaacgcacgagtgatgtctgttaattccatcgttgtttcctatagatatttatatagcctctcgattgactacatcatcgtagaggctattaaagtgtgcggtaatataatttatcatctaaagattagatgaccccagaatgtcctggggttcatattactgtggtccgattaactcatcgaaatctgcaccagttgccgtagcaacgaagttcagagtgatatagttaattgaacgtgccggcttgatgtagaagctcgctacaaactcgttgcggtcgataactgctggagtgttattcgtggtatcacatacaactcggaagtcatatacaccacccagagctttaatacctgcgaggtattggctggtttccatacggaaagaactacgggtaaagttatcgtttaattcaaacagctgccacttagaagaatcaccgatgttgttcttcagcatgttaaacaagcgacgaacgttaattcggtcaaacggtgttggaacagtggttgcagtcttatcaccgaacagaatgaaaccttcacctgtaccttgaccagtcactgggttaatacctgcttggtacatgcggtcacgatgtgcctgacgcggttcaattgccaatttgatgcaatttaaaatctgaccacgacgatatccagctggtgacatccaaggctgagcaatatcatcagtacgagcacacaggcctgcaatatcagcagctaacggaacccaacggtttacgtcgttatatttatcatactgatatttatagttaccatcaattgctgcgtacgtagtattgatgttcatgttagcagaatcataagttccatcgccttggcgccagtcgattaaattatcaacagcacgagtcagaggaatatttacaatcgttgaccttggaggcgaaatgagtgctaagcagtcttgacgctcatctgcaatagacgaaacgtgtttttgtactgtacttgcgatttcatcggtttcaccagcacaagcaccagcaatcagaaggtttacacgcaatgcttcacggtcaccaaataaatcccagccttgaattaaatcgccagccgtaactgattcattagctgaaaccccaccacccagacgaataacgccggaaaatccttcaggccatccttgcgcagtagcaaatacatagcgtgaagaacccttggagaaataatcgtccataaagatgttgtttccgtagatatctttatcttggcggcttgttgataacaccgctgattcaactacagcaccatctctacgaacaatgatagcgtactgagtatcggtctgaggaccatatccaaatacggcttttgcggttgatgcacgctgtccaccactcggataaatcgtcagttgttcgcctttatcaaaagcggcttttgatacaatttcaatttccagttggtttccgagctcgccaggatacgcagctacaattccaggcattttatattgcgcaagcgcagtctggaattcagtttttgtcatttcttcatgggcagtttcatgttcagtcagtagaactgtagactcagaaataattttacctaaagtaatgacagcggaaacaccagaactctgtgaagtaatggtagttgtccacgaagaccctaaatcaggatattgattaatgctttttgcatatgcaataatcttcgatgtcggaatgaacaccgacttaatttttccgtcactatctacttcagtaactgaaccggtgtcatctacggtttggtctgcatatttaaccgtaattttatcaccaacttcatagttactaccagcagtagtgatagtccattcaatattatcaaccaatggagatgcgtttttagcagcttcacggttaactacacggacggtgcgtagatcattaccatattgcagaaagttcattgctgacataaagtaatcagcagtttggttattagggccgccaaacatatcaaccagttcaacttcattagtgatttgagtaacttgatatgcaggaccccattggaacttcccgacaattgcggcacgacctgtagcgttaagtactaccgtgctctgtacgctcgtttctttgagctcaattccaggagagactaaaggcatgatatatcctcaatgttgtttgctttttattatttatacaaatgaaagaccatgttcttgaggcgcatattctgcgctattcacggcgtcaacgaacactacaggagcgtaatcgtcgttcatatcttctaattcgcgtttaaaaacttcagatgctaaacgcatttcatctttatccacgaaatcagcaaatttttgctgtgttgttaaccatgcgaaaattacgagtgacataattaaatcgtcatgatatccatcttctgccgcccaggatactcctttctcagagaaagtacgaaattcttgaacagtagcacgatggtgaataatgagtttatctttttcgataaggtcttttagtgcagaacatccaacggcttttgaccttttcgtctgtttcattcctaaatcaactattgaatcgcaaatgacattctcatattctaaatccatataaagactcttcgctacagaaacacctgtagagttaagttctatatagatcggagcttcgttgtactccattagatatttaataactatatccgggaggattaagtgagaaattgtattagaatgtaatactccaacttgttcccattcagatgtagtaacgtcaataatatttagtgcatggtaatcctgaccgcgtccttcagcagagtcaagagttgcaatatatttgtggtctgcttccgcttctttaaatttataaaacccgtgcgagtcaggagtaacttcaatccaatccatattggcaagtttcataccggaaatgagagtaccggatgtgccatgaaattccgcacagtgctcttgtttaaactgttcaagagaagaagcactgatagtttgaagtgaccattgccacccatcatcaaacatatcttcgtcgttatatagacgttctttaaccgagttccaaattgcagtataaggcgtaaagccggatttaccttcaacagctgcagtccaaatatcatagaagtggtttaatccacttggtgtagtcgtgataataattttagaacgacgacctgatgaaataacaggttggatagcaagccatgcatctatgaagtttggaataaacgcacattcgtcaatgtaaatcattgcaaatgagttaccacgaacggcatcaggactcgaagcgtatgccccaatagatgagccattatctaattcgattgagcctttgttccattcaacaataccaggctgaagaaagtcaggaagtaattcaattgcttgcttagtacggtcgagaacttccgcagacattgagcctttatgcgcaagaatacctactgctttatccttattaaaacacacgaagtgcgcaagaaagattgctactacagtagttttaccgagctgacgactgaggttacaacaagtcatacgtttggctgccatgatttccagcatgtccctctggtaatcacgaagctggactttaatggtaccatagtcaatgtgagtaattgcacagtaggtctctgcgaagtacacaatatcgtctcggcatttcttccattctgcaactatttcacgggttagttgcattttaatatttgctcgtttaaggtttggcaatcccatatagcgggtgcgcttattatttttgtccttaaacgtttggaaatgagctgggtcttcaccttgcaaacgaattttaactatcccatgcaacttaagatagtcttcaaatttctcaggataccacttatcatcccattgcgatttaaagaaacgaactccgttttcaattttcgtttccatttcagacgggtgacgaataaccgtcagtttcccgtcatttaaaggatgggcatcactcagaacgttaaacggttgagtctgttccatttactattttctctcgagcttcttgtgcttcataggcatcaccgaattcatccatcatatcagcggtagaccctacaaagactgttgcattttgaatattcattccttgctgaggattagctccctttccggtgccaacctgctcagaagtaatgtctttcatttctttatgaagcttaagaatttctttgttggttgtagtcatctgacccataagagttgcaaatacttccatatgtctaggagaatcagcattcttagcagtttccaaaaatattttagctgcgtccattaacatctgttgttggaagtgcatgttcttgcgaacaaccgaataatcatcttcgaggtcaggtttacggtcatttggattagatttaacttcaactaattcaagtttttcataaactggaatttcttgtccttctattccaggaattccttcgatgtctaataatttagccatatctaattgtaattcactcatttttcacctctcggtccaggagcctccggatttaccggaataggaatatcgtgagaataagtttgtttactagaaccatcccaattttcgtgttgaacatctcgtggagtgacttcgctatctactgattcaaagtttccttctggagttaactccttgctgttagcgaagaaatctaaataaatggttctaatttcgccatcaatttcagctacaggcggatacaaccagccattgacttcaaacatcagcgaccattctaatctacggcgagtgatattatctccatcaacagcttcatcctgagaaaatgactgtaatacaattctaacatcacgattaaagcttgtgtctttgtcgtaaagctcagttatagtcgtgttaaaatgcggctgaaaataaggaacgatttgctcgatgatttgatacatatcatcttgattgcgtgtataaattcccaattcaaaaatcatcttaatcggagtaggattatactgagatgtaatttttgaaggggttttatatgatttggttctattcaactgtgatgttttatacatcgcattgtattgcatatcaaccaagtgcaaattcattcttggcaaaacagtttctatctttgctttattctcggtagactgaatagcagtccattttccgagttgagaaaggaacttttcctttgaagcataagtgataggtactttaatatattttagtccagtgtcttcacgccaacgagcaatttgtacatgagaaaataaatctccaagcaatacaatgtatcggcgtaaggacgaattataccaatgtccaaacatgatttctcctaagggacccaaaggtcccatctttattttatttattcgaagaacccgtcatcaaacgaatctgctttaggaggggactcaagtcctcttccgttattaacataatacggatgaacatattcagaggcttctttattgatttcatcactttctgcgtattgtatatcagaaatatcagcaagagcatctatatttttgattggttctaaatcaagctcagaaaattcaggaatattaatgccttcattacgttgcaattctggctgaagctgctcaccagaataaatgtatttttgtgcagtaatcttgcgttgaacattttgacctaactgataaaatggatcgtatggctgaacccagttaatttcgaataatgagttatccataggaaaataaattaggtcaccggcttttggttcagaattattagtttgatgcttgaataggttgggattaatagtcaaattgacttcatcattaaccatcataccaaatttactaaagaatgtgttatcgccagaatatccttcaaatgaatctaaataagcagcaaatttccaagctttggtgaatttacttgatgggtcttctccaaaaagcaaatcaggattgttatattcacgaggaaggaaataaaactcaattcctctcatttgaatagcctcagccgataaagcatctgctaacgtttggctatttctgtgattataaaaattcacataaggattgagaatttcagtctcattagttttattatatcctcgataatcttcgagtttagcgaagagcctagaatcaaatgtagacatcttttaccccaacagaataggacaacccgggtcaagtaaatcaagttcctctcggagcctctcgatttcttcttgggcctctaccttaagtgtttgaccatcaactgtaactccacctgccaattgcagaccctgatgtttaaaaagaatttcaccccacagctttttagttaatgctgtagcataatcttttacccaacgattattatatgcgccttctctatttgtattaccttcaccagcatattgaccattattacgaaggtcaggattctgatatctatctcctaatccccaatgatcagcagtttgcggcccagcaaatccgtatcctgctgtattgcctaccatcgcatctgtattcataaatgatttggtccagcattcacagacaatgatgtcacccttcatgaagttgcccattactttaagcatttcattatcagagttataccaataatccgggagaggagcaagtaaatcttgcatcattgaccagtaagtcatcaattgagtaaaatagccaaggtcagcaccaaacgcatttggcccatagcttttattacagcttgaccccattccgccattaattcctgccattcccattagaaagtcggtaaaccatgggtatgtcgcattaccatccattgaagttaatgaacctacatttgttctaacaatttgggtgacagcaaatacattacggccgcgcaaatcaaatacgccgttcaaaaatcttgcgttgtcagcttcgtcttttccaatataaaaaacttgataacctttattcaatccgttaaagtggtattcaccatacaactctaatgctcgttgaatacaatcataaatttggtcttcagttacttctacattaattaccggcgctcctagacgtcgaagtatagcgtctttaagcgtttttgggttgtacgtgttgtatgacatatgaactcctctttatattcctatttatacgaaaaagggacccgaaggtcccttttgttatacagctggatgaatagtaatatccaaagatttaattttaacaagaacctgtgattcttctgaagcagctctatacacgattttgattgcatcaccagatgaaaactcaatgagtttcttggttttaatcaactgttcgcccgttacagccttaacaccgagcccgtaggaaaacacctcgatgttattaacgagaataacaattttcacgcctttatctgaatcagaagcttcgataaccgtatcagtttctacgcaaaatacgccatcgtcatcaacaacaatgtcatcgacaatacgaatgccagcattgaatggagcagcgaccaatgagttaggatttaccaatgcatcagaacttaaatcaacagtgaaatcttctttactgaattcacctattgatgaaggttttttaaaccattcgccctgtttacggaggtatgctccagcttgttctacgtcagtaactgcagtcacgaatttatcttgcaattctactacagtagcgtatacaccatcacgttgaactgggttttctgacgaaaagtcaccattcatttgagtctgtaatgtaaatacagaaccctttaacccttcattgttattgccaagttctacttgaatgtcctgaatagcagactgttgagagttttgcataccttcaacattggtcattctcgctaaaattgacccaggaggaatcggctgctcgctaggaacaataccaacctgttggtttatccatgctacttgaccctgaagccctgatgaagtatcacgtcctacaacatcagaaatgtacccttggtcagttgaaagagaactaatttttccttcaatagtatcaggcttatcagaagaccctaaacgagcatcaatattattgacacgaggaactaacccggtttgtgcaaagttaagtgttgcgtcaactatacgataatcgttttctaatctagtagtacgagctccaatttttactggattggtaaaatcaatggcttggttaatagcaaagatttcattattagctgcggaaatagcatcagcgttattcacaagccttgcataaattgaagctgacgtagctccggatttaggaccaacttctttacgcaggtcgtttacttcaatagtcagagaacctacgtctgaatcattgtatgcatcctctagcgcctgaatacgctcgtcatgttttactatagctgacgcattattgatgattcggtatttcataccagaacccggagagtcttgcttcggctgtccgttaatatcttgcccaggatacgcaccaatttcacgtttaacccaaactatattatcacgaactgttctgtaatagtcatctttactagaatcataaacacctacatcctcttcgagaaaatcaaggtcagttcgaagtttttcggtgtcttcttctaatttaagaatttgtccatcatgcttttcaatattctttttattgatataaacctgctcaatggcgtcagaagaacctgtaatttctaacgattttttgatttggtctacatctacttgaatattttctacagcagttccaacgttgttcaaatcgttatgtacctgaacaacgtttttctggatttgaacagaagctctattcagttctccatcatttccatagcgggttgaagccccattaagaggctctgtattttttatccagttaattctctgttgaaaatcgtctggaattccgtctacgaacggaagcgaatctactagtttggtcatattgttccttacggtctatttgtacagaatgtaagcatgcagtcataaaatataatacgactgtcttctgttggtcttatttgaacagtggcatttggaggaatgttattgaagaaaaagttgctagatgcgtaagcttcaaatctccatgaatgaccatttcgtccgcctttagtattttcgatgttaagagtaagttcaccgccccattgggaaccgttaactattacaacaaatctgaaaatacgattgtcatatccgtcgttgttacgctcaaattttacattaacatttagagctaatctactagaagcttcccatggtgcattacatgtaaacgttgcacctcgactaatccaagattgaccttcaacccaagtaacattacctactctggttccagctggcatgtaacgcccgtcagattcttgtcttgtataacaattaatatcattgttagtaatcgttatgtcattgtcaagagtttttccgtttattctacgggttttaaagactgcatctgttgcagccgctgccaatgaagcatcagtagttggagaacctgataatctggttaatccatatttatccttggtggattttagcgcttgaagactttttggagtaacagccaaattgttagaagtagctgaagccacatctgagtctttagcaaattttactataccaaatacgctgtcagacgcttttgatgccatgaaggtttttggagttactgcgtatccatcgtgaacagcacctgctgctacctgggcttgggttgcgacacgaactaatcccaagttgctttctgtcgcagaggtataactaggaggactgacactgaactttccaatcatttctacaacacgcttaggagttactgcggtagtttcgtcagttcctgcttgcgcttgagccgcagtagttaacctaacagttccatctacgttttcttgggctttcacagttttaaacacatgaccgagagccgccgcggtaatagttctatttcctgcggttaatgctgcggcttcagtattagtagcataccgtgttaagccaagaactgttgtagttgcttcaggacgggtaactgtggattttaatgtagcaggagttaccgcagcattaccaatagttccagcatcaacttcagcctgtgttgctgtgcgaattacaccggctactgtaggagatgctacaggtaatccggtatcagttcttgcccagctaccaatcagctctaacgctgattggacgtcttttatagcaacaggccattgtgtatttgttgggtcaaatatcgtatatttggccaaatcactgtagtgattatagttattctgggccattatcccatccttctaaaatagtggaaagtaaatgtgttcgcgccgaaggttttagattcgttgccgatagcatcccattgcccataacctgctttagctggtgaagtaatagtaaattcaacagttaaaccatactttttatatgtttcaaaattatggttctgataatctaaatgaataatatcaacatactgtggtgttgccggcgattgagtaacctgttgaacaacctttccaacagcttctaattcttttactttatcataccaacgtgttgctactgctgcaaagtcatcaccgtttgcaattctaattggtaagccaagaatatgaattattactgggtcaccgacagagccgtcttcttttggctctaacgcaacgacacctgaaaaagtagcacgcgtaatttgctgtgcgggctgtggagatattccagtgtcattgcaaataatagttccaatttctgctgactgcaatgacatcaaatcattaatagcagcttcagtatttggataccaaacccctaaatccatttgttcaaaggttaggctccctataggagccgtatttcctaccgcaatattttgcgggtcaacgcgatattctgaaaaagcagctaatcttgaattaactttagctccttcacgagttttagtttcaatcgtcattttaacctaccctaatccaacgataaacggtgattgttggctgaattttagtgatgtcatttggaactacaccgttgtttaccgcaacagtgtcttcacggtatttagaataacctggtccctgcgcgtctgggtctaattgacatccaccgataactacgcttccatgttcagggtctgaaattagaactttatctcttgacattagttcaggaatgtgttcttttcctaacgtaaatgtcaaatctccaaccgttccacctgctgttaatgatggctgaccattttcgtttaagttattgttgttacgcgaaaaataaggatcagatgaatcattattccaaccagcagtaacacggccttgtgaataaagcttccacaccccaaatcccatatagtcagcagggtttgcgtggttgtgagcgttttcataaatcgtgccaatcggataaattacgtcaaaaaatgctgcaatattattgactttaatcataatatcgtcagcaaccggacgcatatttttctgattaggttcatcataatttgtgtattcaatgcgattttttagagttactaattgctcagcattcatatacacttggtcggtttctgccatgatatcgtcaatatccatagtagtaccgatgttattattgaaccaacggacggtaagaaggtctttatcttcaaacgcctcaccaaaaataatagcttcgacgttagtaccagttgagtcaaattccagtctatagtcttggttagaatttacccattgaccaccattgtttatacagtcttctgcgtatccaccttccgcaccttcacaataaaataaaggaagacctgcagttccagcttcgagtaattcctttccgttcaacgaaatttcaagcgaattgggattcacacccacacctggaagtacacccatatcatctagagtgattcttcgaagagcagtaaggttatctactataattgacccaggaatcgtctgggatgtagtctgggctgaatctcgtatctggatagccaacttgttgtatgaagaccgataaacaccaattccatctaggaaggtttcaaatgttattacttccccttcaacacatggaacttttaaacgaatgtctttaccgtttaattctaccaattgacctgctactgttccaggagaaccgtaatcagcattggctttatccataacgctggtttcaccgtaatataaaatattaccacgacgatatacattaagcgagtcttcgttatattctacgccatcaaaaatgttaagaaagtcagtctgacccgcagtagcaataattgattttttcgctacagtacttaagttaccattagttagcttatctacagttttattttcaatatattcccagcggccaggggcgcaataaaccaattccaaatcttggaagttagtattgaaaattttaggagaagctgaaccctttaatgtatcgccttgagcaggaataactgtgattgggcttaatcgccaggttgaccaaacatcacgaagtttaataactttgttatagtcgttggctgtaccctttggaagctgaacgttaactcttgctgcctgggtattaatagcaaaggcctgaccaaacttagcatttaaagtagttccagtagggctagctttaaaagttttccatgcacctgctgcgaatggaactgaaccatcacctaactctgaatataaatcatcaaagttgttattaattttaagaccacctttacggaggtaatcaccagacccatcatctactgattggcctactatcaaattttgtttcattattgagatacccctacggtctgtgtagcaataactttaactgccaaacgtgcgtttccataagatgttgaagctgtgcatattaaatctttctgcgcgttaatagagtatgaaatagaatacatcttttcattttcagatgattcaccacttcttaacactgcatattcagtgtcaaatactcttccgtttggcgctgatgaagtaatagtcgggtcaatcataagcatgacttcagatgattgccttttgatggtttgaccacctggatttgcgctgaagcttaatagcaatttaacagtagagtaatcatcattatatccaagtcgaatattaataggagaactcgttaaattatatgtagcttctaacggcgaatatgtgctgccaaacatacttgaaattgaataatcccaaacagcagcaccgttagcttttacctcaacacaccacaattcaattctacatcttggtgtgttgataatcaattctcgcgatccgtctttaaatgcatctgctacgccttcgccgtttgttgttatttttatggatctagcttttgatgctgagccattactatttacaacgaatacagcttctcccgctttaccttttgaaagacgtatttgaactgcgccttctgaacaatcagcatctatgcatgaccccattggaactgtccctgcagagttagcatctccaaattttatcttttggtaatagcttgttgcatgaattttttggttcaatgctccgccgccagctgcaaataatcgttggtcggcgaaggcgttgtaaatggcgtcgaagttatcattaattttcacaccgccatcatacagaatgtcgccggtagaagcattaccaatctcaccgacgtcaattatttttttacccttatctgtatacataggttaacctcatatcaaagtatagtcttatttatataaaatggggagccaaaggctccccataattaaaactcgaaaattaagtttaattcttccgtttggtccattgaacgaataataggttgccgattttccatgtaaatcatttcacctgactgtctttcaagaccagaagcactataccagcctttttcagccttaacattaggtgaatttggcattggcttaacttcaagcggattagttataattgacagctgtctaaatccagtatttcccggaagactgaactccggaaaataaaccgcatcaagatacgctttaaacctgatagtattgcatttcatgcgataaatcaaattaaagtcgttttgttgccaagttaagttgttttgaaatccccaacgggctggagattcttcaatctcttctggccaaggaactacgatatattcatttgtacatctgttaattgatacgtcggctggaatttcatatagatattcccaaagatatccatcgcccaaatcgacggtaccatttgcatcaccacgacctcgaggagctgaaccagaaatagtggatggtgtccatttacccccaagcttaatacattcttctttgcttgtaagattgccaattgaacacattccatcctttggaacatcaatacatctatataccatccatccaaatccagcatcagttctgttatatggcgcagagttagcaacaacgatatcgccaattagaaatgtgcgtgggttaggatatcttgtatctccccagtctcttcttggaacaacacagtcaagcattgatgattcaattttgaccgcgcccatcatatttgtccaaacatcaactaccccatctccattatcagcgggatatggaggtgcaaatccgggttcagattcgttatctgaccacggagtgcttttgccaaatgaaacatacagtgtgttttggtccgttcccggaccaatcgatttataaaatgtgtacatcttttcagttctaaacttagatgtaatgatagcacgataaatcgtgctacgcgttgaacttgctcttgttgaattactcatcaatttttacctgtgtcggattttcaggatcgcgaggattacctgcatcgtctttaagacgttggttaactaaatcgcgataattagcaaacgttactgctgattggtcaaacgtaggacttaacggtttacgtcgttgtccagggttttgtccagcgataatgctgttattattttcttgattgtagttagcaggtaacgggaaaggttcaccagcttgagcacgtgaagaatacctaggctcattggttattgggtctctttctattgtatcatctgaagcgataatagcaactctatcaggataaactgatggcagtcctgcatcccatttatagttcttgagtttatttatgatagtctcaacatgcttcatatttaagccactattgataaacattgtcagcaatgttataccaatgaaaccgaaacctaccggatgaacaaaccttaatacatcgtcgcggaaacgagaagtaggaagctgagacttaattttcataacatagtaagaacggctgcggtttatataatcaatgttattactcagcatatcctttccacgaacaccttgaactataataccctcaaagtccgtacgctctgatttaatttcctggccttcaatgaaccgtcctgataagttatgaatagtaatacgccataacagacgaccatcccggtattctctctcgatataagtcacattactacgaccggaagcagtataaatcgtacgaccaactaaatcgtcagaaatatttgtactttcaacaataatgtcatattcggtagtgttctttgactcaatatcgatttcaacatcttcattataaagaagtttaaacaagaatttgtatgagtcttcaattcctttggtagcatagaaatcattcttacgggcttcaaagaaacggacaacagcatcgcgagcgtctttactcagataaatattgcgtttataaacttctgaccacaggtattcccatgcattttcttcacgaggatatttgttcttaacaagattaacgagactgttgtaatgcgttccatttccgtctgaaaggaattggagatagtacttacaaaattgctcaaaattactatcttgtagcaagtaactatccggcatcattttagtaagatacggacgcaaatctgggtcacgtaagcctggagtatgttcaggtgtccagtcttcttcccgtgtttggttctgcagaaacgctttaaacattacatcagtcggtttccagttaagcgttacctggtcacgaacacgataatcaaatgcgtaatagcctatcagttttccgtctggttcgtgaaacatgatgccagaagcatactgcaaaaatccattaaatgaaactggagggcaataaaacgttgcgtcacctttatcccacacttccgaaagaacacgctcggtagttccctgcgccgctgcatctactcttttttgataaagaatatcattataaatgacaactgcatggtcagctgtacttatccagcatctgttaccttcacgagccatccagacaaaccaaggctcagcataaaacctcatcggtccaggaacaaatgtttcccatcttgaaaattcatctgctctgaaactcatcatgtgataatgcttatcagagtgatactgaattggattaacatttttaactgcagtagaaattagttctggatatttcgtctcaagttcaatatcctgggtgtactctgttgtcttaaaattagctgatgaaaagaatatttcctttccgtcagttgacatagacgtccataaatgctctatacgacgtttttcttcatctgtattaccgaatacacgtttccatgtatttgtgtcttcttgataaacatagacgcctttagtagcagaatccacaacattccgcgggtctgttgggtctaatcctaaggttttaacttctccggtaataagagcgaagattttgcctccgacagaatccattttaaagcatacagatttaggattgcctgttatatgagatgcttctttttcgaacactttttcaccaaatgtagggcttaaagggtcagtgtctattggagcatcttttaatttaactctgcgtactgtatcctttgcaactacatataagtggtcatcattgcatgtaaaggcttctgcatatttggtaacatcagcaggtagtgatgcatatgtaccaaataactctacttcaaatcccagttttaactggtctcccaatttagcaaatgtaacttcgttatcgctaaatttaacctcatttgatgaccagcgtacgtcagatgattttcttccgtaaaagattttatcatagcctaaaacatatgatgtggtacttgattgataaattaccactctagaaaccggatttcctacacggtcattaaataactgaacgtattgccagttctgtcctttatcgtttgatactttaaccatatgttggaatctttcaaacagatacaaaattccgtctatttctcctagcatggttctatttttatcaacacagactgcttcaataggtccctgaatttcatgatatccagattcgcctactacgaaattttcaatagctgacaaatgagaatattcaggactaaattgaaaagactcagtcatcaaagatgccatcatggcagatgtgttgaagttaacatacgacatgttatttaaagaaaacttctgcttaatgaattctttcactaaactgaattcttgcatatgctcaaacgtgtacgcgttttcttcaaaagtttggaactcttctgtttcaacccattcagacggttcaaatcctgctgacgtagtttgaacacgcattttataataggtaagcggttcaatacgattttgttcgaaccaatcattatccgcggtataacccagtgaagaccaactcaaattatcagcggggataatttcccccgctctgtttcgagtttcggccagttctacaaaatagtagaagtttgcaccaacgtcatcccaacgaatattgacctgattcgcagatagcttatgaattcgtaagctggtgacgaacggtgcaattgtcattgagtaataggctccaatttaatagttgtgtattgaggacgaaggtcattctcaaatacgataagtgttccatcgcgggcgaagacgatatcctgggtaggagtagaataaagctcaatactttggtcttcaaactgaagaggatcggctccaatggctccaagactccagtaaatgttatcaccataataatctacttcaccgattttataccagcgagttctttcgccgatggtagttctatcaaaatcgttttcagtatatggctggatatgagtattctctttaatatcacctggtttaaatggtccaataaccatatttcctttgccatttttatctgggtcagttccaacgatattaactgaatacggttcagcagttggggtaacagtaaagaccaaatcaccagaacgtaacgtccgcggagtaatagtattatagtatttaatacctgcgctaggaagagtgaaatagttgacaatttcacgaaccatctgaatatccacagaagaaccgatgattgagtggtcagtgtcatcaatgtaagtcaacaacttagatttactgaaatttttgttgaacatttcaacttcatcaacgtaatatctattaatcgagtctataatttttgactgtaaccactgctctgattcttgcaacttattcaatgcataagaagctttaatattatgacgaatgaataagtaatctgggctcattaccgaaggggtaatcggagcaagacagaaaggttttagataatcctgaatgtcttcccgttgaaccgcagttaactgcaacccagattttggtttgattgcgataaatgcatatccgggtttgtcctgatcagtaaagcattgtactgcttgtacgatagaaccaaagcgtgaactaacgaatgattcatagtcagttttagacacgcatcgcatttgagattcgcgcttaatctgtgcgagctcacgaatacgctcgatgtcttcaggttcaccaccgccatcagcgccaacataatcaggagaatctgaccagttttcaatgattctatttactacgatatattgcagagtatccgcataactaaattcagtcgcgccattagcagcttcaccgtcagtacgaatatattcaataacgacttgcgcacccttagtaggcttcaatccaccgatgaagttgctttcaagaactcctcctgccacagatgcttctgccacaccctcaccaaagaagaattctgtatttccatcgacagtttcacgcatataataaattgttgaaatagacgaagcatgaaccattgatcggtctgtccagttagtccattcagcgccatccacccacagcttaacttgcttgcggtcaattgattgatcgcgaataacaataggtttcttcgggtcatatgacaactgagtacgaataatacgtccctgcgccaaattgacaataggccaatatttttggtcattatcacgaatagccacaacgttttcagtaacaacgaagttatatgggttggctttatcggattttgagtatgctaaaaatttagttcctcgtggaattacaactctcaacgtgctgctcgggttcatgtgagttacctcaagcataatagatgcagtagccgctgatttggaacttggcaaatacccgttttgctgagctgcttgaacaacggaacttctcaagttagctgttccaataaagctttcgtataaagcagtattactaaattgctgtatgtaaagcgtgttatatgctaataagtctaatagcacgtttaaacgcgaaccagcaaaatcaaagtcctgaaactctttttgaccgctaagccagttaataagctgatttttaatttcgtcgaatgttgctccagtaaatgcgtctgggatagcgtttgcagtacgcgttaactgataatttaagggttctttaatagccattagtgtatgaatacctttgaacttgattgcgcgacagtgtcgccacaagaaattggatcggccatttgaacagcttttttgcctgttacaaataccttggatgtgcgaggttgaacaactcctccatgcgtatcatgagggtcaaccgtcttggtgtgtggggtaattgagtcgccatcaactaataccgctattccaccagtgaatactttactttgtgtagcatttacttctgtcggaggatacgcactatgcccggcagttaagcatttattaaatgatagtccagccatttaattccccgcatatacataagcacgaagttggtcgccccatctactccagttgcctttaacggtttgagagtaaatcttttgctttttatgttctgttatgattggagcgctagaacctccggatgaacctccagacgattcttctgtcactgtatatattatctcaactgtataggtaaatgtcttctctagtgttctgggggctttccatagatacaaatcagcagttttgggattaggtaaatcctcccacgctgaagcggactttagctcatcaccttcacggtatttaagcacatcgtttccaaaagtaaaaactgagttataattacctttataatgagtttcagacacagagatatcagatactggttgatagtcgataatatttattgattttaatgtttcgttagtagataattgagcagtaaagtactgctcaacatattcaccttctattacttcacgtaacgttgtattaataggaagtatatcagccatgattaacctacatcaattcgtgaaccatcaacagtgtattgaccttgggcgattgagctcatagaagccattgtttcagtccaagccccaccaacattccaattcacagtacctgctacttgccaagttaaattaccaccgacggtcacgtcgtggttgccatctactttagtagtggcatcaccattgacttggatatcagcatttccttcaacgactatcttaatgttacccttgacaaaaatagtaccattgccttcaatcgttttagtttcatttccacgtacgtaaagcgtgttatcgccatcaatttgctgtcgacgattatacatgttataataggtctcgttccctccaacgttaaccttcttatcaccagagattaaaatatttccatcaccctgagtcatgtcatataaatcagctacagtttttctggtacgacgtccatcaggagcaacttcttcatatgaaccggttggatgaacaatacgatagcgttcatagccaggcgtatcatcaaattcttggatatggcctgattctgtttccatcgtatgtacatatggatattgaccattatatgaagactcaggttctttgaaaagaattcttgaatcctctggggtccacgggtcttcaggattaccaccagacttcggttctacataagccgcagacaggttttttccttctggctttggagcaggaactccatatgattccatattacctgttagaataatcatggaaacacgagaagcacgaccttttgtctggttaaaccacacggagtttcttgcttcagtataggctgttttccaatcaccaatgagcatggcatcaagcattttaccaaattttgctaatccacctacacccatttgaaaactcatattttctaaagccatttgccttgatttgttgactttagcatataccggtcctacgcgtgaattcgttttaatatcagaaagcattttatcacgatctttcttaaatagtgcaactgcttcgtccattgtaatgataccgggatttcctgtaacagtacgaccaacctgattagataaagttttattaatgacagacatatcacgtactttttgtgccatgataaggtgtccaatacctacagtaggatatccttctgtatcccaatagactttcaatctaagaccttcatccctattaagcatatctgttattgtaattgcaggatttgggtcttcaggaatatcgcttaggtcagcatcgtcaggattaatgccaatatccaagtttctatcttggatgatgtttggtatagcactatacccagtttcatcgccttgaactagtgggttggtatctgacccaacctgtctaggatattgacctgtggggtcagaaaaaccttccgtgtagtttggcttagtttttctgtgcgcagaatatgttcctattactaatcctgctgttttgaattcatcaagccataagccaaataccgatgttccttccaccattccagttatagacgagccaactccggaaattccagctgagtttgtaggctgaatcactgacatccaaggaaggtcttcggtaggaagaccggttatagctccttgtaccttttcaaacggatgaagcccgtaaacacgtactcgcactcttccttgctttaacgggtcttgtctgtcttcaacaacaccagtaaaccattttaatgaatcgttcatttcaatcataaaacttctccgatggtagtctgggatttgtatcggcctgattcgtattcgctgtcaggtgctttttccatttctcgtataatatcagaaagaaatgcctcaatatcactaggattgataatgtttatttggcgcagtttttcattttctatgatagagtcttcataaatgtcaacaccagccaaagcaccagtatattgaggatactgatgattaaagtcccctttatcataccaaacacctgaattttcaggatattgctcgagattgtaatagcgattgccatacgcatccacgtgatagagtatttggtctccacctacatctgcatatttttgctgcgcaaattgatagcatgcatcttgggttttaatccaatctctgaatgggtcatatacattattacacattaaaagaatccagtacagctgactatttccataaagaatatatgctaattcttctggtctaggagctccacttatgtaatatgtttgtaaaagatagttttctgccacagtgtcaaaatatttgcgataattacgaaatatgtcagcggttgggatagcttttgccttagcaccttttacggtctttgcagaataatctatcggactaaaaaatgagaagagcatagtttatcctcttataaatattaataacagtatttataaggaggccactatggcatattccggcaaattcatgccgcagaatctccacaaatataaaggcgacttcagaaagattacttatcgttctacgtgggaacagtacatgatgagatggcttgacaatcatccagatgtagttcaatggaacagcgaagaggtagtcattccatactttagtaatgcagatggaaagaaacgccggtatttcatggatttctgggctaagttttctaatggtcaacagttcttttttgaagttaagccgaagaaagaaactagacctccggtcaaacccacaaagttgacgacatcagcgaagaaacggtacattgatgaaatttacacatggtctgtaaacgttgataagtggaaagcagctcaagctactgccagtaaaatgggtatagaatttaggttaattaccgaagattcacttaaaaaattaggatggaaaggctgatggctatatttgaatttatcactgaagctgcagaatcgcctaaagctaaatcccgtagtgaaaatcaatgggtagcattaggagttgaatactctgctgctcgtaaaaaaggcatgacatcaaaatcatttgctgaaagtaaaggaataaatcctgctacgttcagtaaagctatggctcgtcatgcatcaagaattaaaacggcaattaaagtagcagaaattgagaaaaaacctgctaacaaaatgaccaaacaagagcgtgctcttgtgatggtaaattcatttcgaagctctatcaaagataaaattcgtaatgaaggcgcagcagtaaacaataaatctgctaaatggtttgcagaaactataaagaaaaatatacgtggtcattctgtaaccaagcctcaacctggaaagctatatgcttacatgtatgacgctaagcacaaagacactcttccattctgggataaatttcctttgatagtttatcttggtcttggaaagcaaggtacaaccacattgatgtatgggttaaaccttcactacattccgccaaaggctcgtcagcagtttttagaagaacttctgaaacagtatgctaatacgccagtgatatctaataagaccagattaaagataaactggagccaggttaaaggatttgctggcgctgacaaaatgattaaagcatatattcctggtaatataaagggtgctttaattgagataaaaccggctgattgggcgaatgtagtcatgttaccactgcagcagttcatgtcgaaaggcaaacgctactctgctacttctgtatggaaatcataatgtctactggactgtttaatcaaactaacacaactaactttatattagaggtccctgacgggggcctcacccaagcgtttaaagctaatcttcaaacagctgtagttcctggaattcatattcctgctactgatactgtgggttcgccgcaaggcatgcaccgtgctaaattgcctgggtctacctttgaatttgacgctgttcctgttagatttttagtagacgaaaaccttgattcatgggtacaaatgtacaaatggatgttaagctgtcaaaactacattgaccgagacaagtctggatggaataacggcggtgaaggatttcctggtgcagttttaatgcatgttcttgataacgataaacatgatatagtattaactgtccgctacatcggaggttgggtgagtgatttatctgaaattgagtattctttaaccgaagaatccgacccagcaatggtatgtgtagcaactttgcagtacaaatacattgaagttgaaaaagatggtataataattactggtagaccttctgtcaatgatactcgcgaatcccagtatcaacagaaagttatgggaatgcatccttctatgaggtaataatttgaagcttttatttttgattggtaaaaaacgtagtggcaaagatacaactgctgactacattatggataactataacgcaacaaagcatcagttagcaggtccaattaaagatgctttggctgatgcaatgcttactgagtggtatcgcgatacgtctcgtgagtttccgcgcattactcggtctatgattgagggcattgattacgatcgcgaacaagatttaaatctgtctactaaagacgtgattcgtatcatggcgaatgcgattgaatatgttcatcatgatttgcctttacctggcgtggtttatgataacaaacgtaaaatacttgacggcgatacgatggaagtcatccgtaaagttgtaataaataaacctgttgagccatggtcaattcgtcgtctcatgcagacccttgggactgacattgtctgtgataagctcgatcgcatgtattgggtaaaacgattcactttggttatggctgatacttttggtgattatgattatttcattgtcccagatactcgtcaagaccatgaacttgatgtagccagggcgatgggtgctacagttattcatgtagttcgtcctgagcaagaaggttctaaaaaagatactcacgtcacagagcgtggacttccgattcgcgaaggcgatatcgtaataactaacgacggttctctagaagaactttattcaaaaatcaacactatattaggaattcaaaatgactactgaacaactgcaagcccaagtcgatactctgaaagttcgtgtatttgacctgtctgaaactatccaaggcctttctgctctgcgtgcacaatatgaagaagtactgcagaagctgattgctgtatccggcgttgaaattggcgaagacggccaggttaaacttgatgacctggttgcaaaaatcgaagcacagttcgcagaagaaactactgaagaatctgagtgatgaaattcagtgattttagcactggcttatatgtagctgctaaattctctgagaaaactcttgatgctattgaggaccttcagcgtgaattgaaggtccctaatcctgtacctcgtcataagattcatacgacgatatgctattcaagagttcatgttccatacgtttgtgcttcaggaagttttgaagttgctacatcaggtaaacttgaagtatgggacacacaagacggacgtacgctagttcttaagctagattcagaatacttaaaattccgtcaccaatatgcaagagctttgggagcaactcatgatttcccagattactcaccgcacattactctcagctacaatgtaggtccagctcacttcgagggtgaagttcaagtacctgtagtgcttgatagagagtaccaagagccactaaaactgaactggtcagaggaccttaaatgaagtcataccaagaatttttaatggaaactgaggctcttttggagtctactctgccagattacatgattgtaaaaagctttaatgtaaaaaatggctacgtaattaaatttcctatcgctagtgtcaagcctggtgctgacatgtcaaatgatgctggcattagtgttaaagttaatgtacagtttattaattacaactctgctaaaaagtcgtatgatgctaaaatgactttttccggtggcgaaaaggtagttaaaaacattaagttagattacgatgaatccgcagaaagtgtcaagaaacgctttggtgataaactggtaaaatctatcatggttcatccaactttcaaacgcgatttcacggaactttataaataaaaagttgtttactttcctcgagggctatgatactatagccctatcaaaacaaatgaggataaaacatgaaacgctgtgaactgataagaaatgttgcttctgctatttgccttactgctgtgggcactagcattttcggtgccatctttatgggtgcaaaagaaataatggttgtgttagtagctgcatttcttatgggttcaatttcatttattatggataaaatttctcatgaaaaagattaaacaatggtttgttaagacctatgatttaggccgtgaagaagtaactaagtatgattatgttactttgggtgtaggactaggtgcactactggcagcattgcattcatcattacttgccattgcagtgcttcttattttggctcactacagctggaaacgtaagtaatgtatgcacttttaacttggtctaattattatcctgctcctggctctgaccaaatcagaggtgtttactctacagtagaagaatgctatgaagccctccagggaacgtatcaggactattttgagatactgaactctcggtttgagaccgttgctaaaggttcaactgaagcatacaaagattaattgtgaggaaattgtgatgaatatcagagctgcatttaatactttctaccaagagaattataagcttctttcccatgaatactatgatgcacaaggcgttccaattcctagtgatttagttacgcctaagcatgtcaaaaccgattctcttgacaatgaaattcaacctggtgatttggtatcatactattgtggcgggtcactttctgcagcaagcgttggtattttgctaggatttacgcctaaaggttatcgtgtggttcctttccatacaagtccaattcctgagcaccgggtattgctctctcatatggattcaccgcatagggtattcctggttaaatcaaagagctcaccgattgtgtaatatgctttaggttttctttgttattattaatctatcaactgctctgattaatttcagggcagtataaataaaattacccaatggggagttagaccgtaggggtagcgggacagactgtaaatctgttgctcaaaaggctcgagtggttcgactccattactccccaccaaatttaagggatactagctcagttggttagagcaccggacttttaatccgggtgtacgaagttcgaatcttcggtgtcccaccaaattcgggtcgttggctgagagggtaagcgacggactgttaatccgtgtcagaaatgactaggcaggttcgatacctgcacggcccgccaaatgaagaagtcagaagacgttctgataaatcgtcggcatagaattccctggcatggcgtttgtattaaggagtatgatttcatcctgcttaatacttgttcatgttataatttcttacggcgttgaaagttcgctttcagggatacatcttagaacagagtgctaaacaagattcatctggtaccaaggtgatgagagtcctgttcccctttgcttcggcatagtgccagagtatctctgaaagcgaattatagtgctgtagtcgagatggttaagacactcccctgtcacgggagagatcgcgggttcgacacccgtcagcactgccaaatacgagagcaacatgaaagattatgaaaagtaccgcatgcaaaaagtgcatgccaaataaagaggtattgaatttaaattgacatttgatgaatggttatcatggtggaaagctactggcaaatatcatttgcggggtagagcatcagataactattgcatgtgtcgtaaaggagatgttggaccatattctttagataacatctattgcgcaactaatgcgcaaaacgctaaagacgctggcgctaacggaagaataatatctactggttttactggacataaccattctgatgaaacaaaaataaaaatatcagaaaaccatgcacacaagttaaatgcagacgaaatttctttgcgaatagacctgtataattctatagattttacacagcgtggtgcactagtaaaatttgcaaataaacttggaattagtcatactcaagctagaaagttcataaataagtttataaagtaacgtggcagttcttgaagatgagtttgagtcctgtaagataatgccgaggacgaagcggtttgttcccacggaataagctctatattcgtaagattatatctttagcgtgttctacatcaagctacttgttagtacttcaagaacccggataaatgcggagtaacttcagttggtagaatgttgggctcatatcccgacacgcgcaggttcgagtcctgcctccgcctccaaacaattgaatcatagccaagttggtaaggcagtaggttttgatcctacgatccctggttcgagtccaggtggttcagccaaattaatattcattcaacgcgatgtgtaggcagaagtcatgaacctgctttagctaccgtatgaagtcctcatgatggatggagtgaatattgatgtggtcgtagttcagttggtagaacccgaggttgtgatcctcgatgtcacggattcgaattccgtcggccaccccaacaatgaaggaatggtggaaaaatacacggcccgcaaaacgctgtggctgtcgctaagcgaattgtgtctataatggcacttccttcaccaattaatggagagtagcgctagtggtagcaaaccggacttgaaatccgggccaccggaaacggtgagggttcaactcctttactctccgccaaatttatgaaagttaaacgctgcccatagcagtggtacatcaacaattagatgattagctttccatgggagtatagctcatttggtagagctctcgaccgataatcgagcggtgactggttcgagtccagttactcccaccaaataacaggttcttagtataatggctattatgctgggctccaaacccagtgatgagggttcgattccttcagggcctgccaaatttgcatccatcgtatagcggatattatgtctggcttccacccagaagatgggagttcgattctccctggatgctccaaattactccgtatagctcagcctggtagagcgctccatttgggatggagaggtcgaatgttcgagtcattctatggagaccaaattaacggtatgacacaatacaagatggtgtaagctgagtagcgggattgcagtctcgttcagatatgctatcgagtatgggtgatatattaaacacacggattctgcaaagtccatgtgactcggttcgagaccgggcataccgtccaatcacttgccattgagaattatattatgaaatattacggcttcaaaacatcccatttcgggaaagcatatcgtacagaaaacattgatagacgtcgagcatattacgaatcactgcataaagcaggacgttctcgtgcacgacaagaaggccaaaaacaagcgaaggaaatagaatgaatatttttattggtgttgcaaataacgtaaatgctattacggtgaaattacaatggaatcgtccaactaattttgctttaggattatgtaaatctgaacgtgatttaatgcttcatgctgattttgcatacacttttgatgaacgcaaaggtatgtgggtatggattaaatgcagatacgaagcattaatcaaatatgagtacttcagtgagcgtgatattcaagaagttattgcttatcattctggctgtaaagtaagtaaactgcgtcaagttattccgtttactaatgcttcaaatgtagaagagctaattactgattttaaacgaatttatcaggcgaaatatgatgaaagattctaaaggtcgagacgtacaagttggtgatatcgttttctatggagaacgtacatacaataaaggcggtcgtggttctatgcgctgtggtcgtattactgatattgcttcaggattggctaaagtagataacgactacgttgcaatgcgaagcaaatcattcgttaaggtttctcctatgttcgcaacaatgtgggaaaacggaacgattttcgagatttaatgctacaagaataacctgttattattactacatcaaaacaaacaaggaaaaagaatgaaacgtatcgcactgattgttgaccaagaagctatgttcgctgctaccggtaaatttcatccggtgagtaaatttgttgctcgcagcgagaaaatcgttggtctggtagaaactgtcgcaggtgatgtaattgtttctattaaaacgtctgaaatttctccagtagttaaagtagcagttgaaaatgacttctgggaagtagctgattttatgtgtgagtaattctgcctagcaggtggataagcccgacaaggcgccctcttcggagggcttttataaaagtcataagatttctataaaggccctgtagctcaattggtagagcgttcccctcataagggattggttgcatgttcgagtctttgccagggtcaccaaattaatgaggaaaatattatgatgcgattagttaaagtagttgtagaagaatctgaatacatgggcgatagccgaatgattgaagaattcgttactgttgaggcagattctgaatctgaaatcgttgataaagtttatcgtcattttgataatatgtctgattcgtatggcacaatgtatagcatttatcgtttagatgtaatagtacatatcaactgaggaaattgaaatgcatattagatttggacaagttattcctaaaggcttagcaatggcaattaccacttgggaaaacgatgctgatcggtattctacccaaatggtttatggcttagaaaaagaagagattaatcaagtaattcacgttcttgaatggttctcttctaatggtcggcgtggtgaataccttggaaataatgattacaaccatgaagcaattcttgaaaagcttcatactgaacagaagtatgtaactcctgaattttccaagaaattctttggcgttgatgttcctgcatatgattgcacagacgaagagtttgatgcttatttagataaccactattcttgttcaaatgaagttatgtatgctattcaggcttggttgggtaatccaattgaatatgattatgatttcatgcgagtatttgagaaagtagaaatctttgacattaaagaagaaattcgtattcctgatgctccagttgcattccatgttggaattacgtataaacaaaaagaaagtccattaaaagttgattggttgaaatacgtgaaggaaaagtaatggatattggttcaggcagttcatatccatcatgtgctttgagcaactttgctcctcataaatttatctatgatggcgtagaatgtgcctcaatggagggattcttgcagtccctcaaattttcttcgcctgaaatgcaagcacatgtatgtacactagtcggaaagtccgctaaatttaaaggtaagaagaaacgttggtggccaactcaaacactttattggaaaggcgtgccaatccatcgtgcttcagaagcgtatcagaatttactgacaggagcatacgatgcacttagtaaaaatgaaggattcagaaaagctttggctgctacccggaatgctacgctcactcacagtatgggtaaaaataaaatttctgaaacgattttgactgaacgcgaattctgtaatcaactttatcgtttgagaaatgctataaataatcagtaatataattatcttgttcagtgttgaaatcggtagacatggtgacgggcaccttttgagctcgcatattgcatcatatgctggcgatggtggtaaatcgccgacggaatcagtcgtgcaggttcgagtcctgcctgaacaaatatttgcgtcgatgttggaattggtagacaaaggagacttaaaatctcccgggattaaacccgtacgagttcgagtctcgttcgacgcaccaaagcccttatagtgtaatggatagcacacgatcgttctaaggtcggtagtccgggttcgagtcctggtgggggtaccacgccgatttagctcagttggtagagcgcttcacttgtaatgaagatgccgcgggttcgactcctgcaatcggcaccaaattcgaagggaaacttgcgtataccctcgttgagtcgtcagatagaagagaatggttcgtccattgccgcaagtcggttgttccctgtcgcaagcataacctcctgacgctatacttctttggatgagactgatgcctccgagtccaaagaaatgaatttcgcaggtcatctgccagtgggtgatgctgtcgattattagagccctgtcttcggacggggctttttagtataaatagtaatttaatcggcactaaggatttttttgcaatgaaatttaaagattttttaaccgaagaagagctttttgaagcagctcctggccgcatgactaaatcgaaatggcgtgacgctctggtattggttccacgtggtgaacgccatgattttagcaaatttgcggcttctgtggaaaagatttatggtattgggattagcgatcctaaagactatgctaaggtagcagctgcctttgaaagtttaggcggaaaggttactacacctgcacgtggagcttctccggcacaagcaccggccgcaaaaccggctccggttaaagcgaaacctaaaaatattcctggccttaaaattagtggagaccatggagacatcattggttcaggtgaactgtttaaagctattgataaagctcttccactagtaagagataatggtcctctttataaagcagttcaattctatttcgataatctgtggaagtatcgtgaatcccaaggtgctaaaccttctgcacgtgaaactcagcatatcggtgaagtgaaaacacttttagctaaactgaatcatcaccttgttgaactcagtcgtcagacagaattatcgtacaatgtataataaaatgtaatcctacagccctagaattcatctagggcatttttgtatcctcggctgtataaatccattctatcttccagaaagttcctccagatgccctaaaaatttttgcacaaagttgtttacttcctctatcaactcggttactatagctccatcaaaacaaaacagagtaacggagaataaaatgtctaaattcaactttatccaaattgaacgtggttataacaattacggtactcctgatcgttatcgcgcgatttggattaaaggtgaacatgaacacgcagtgttcaatgtagcagaaactcgtgaacttaaagatttgattaagcatgttcgtaaagattggcctgctgttgaagagtactacgttcgagtttaccatgaagaagctcctaccgaaactgttcaaattaaattcgcaaaaactgctagtgctttaaccaaacgaattgaagctgtaattaactgctaataattttggggagttataatgaactccccacctactgaggaaataaaatgtctattctgaaaaaacttgttgaattcatccgttctaaattcggtacctttgttgcacagaacacttctgttgaagaccagtatacgatggcagcaaaccgtattattgatgaaatcactaaactgcgtaccacgcatgttaaatcagtaaatgaagaaaagcgtctgctgaaacttgctgatgaaaaagaccaagcgggtgcttctaaagagcgtgaaattcgtcgcttgatggcagaaggtatgaatgtagaaacccatgctaaactgggtcttctgtatcgtcgtactgctaaggctttacgtgataaagctgccgaatataaagaaatgcgggcccaaattgaagaaaccgtagttaagcttgatgaccaacgtcttgatttggcagtgaaactcgaatacatccgtgagacccgtaatgcttctgctctgggtattacctctgctgacgacgtgattgaaatcgcagaactcgctaaagtagatgtacaagacatcatgatgaaagttgaaaccttcagcggtactcagcctggtattgaaaccaccactgctgatgtccaggaatatctggaaagtctgaagtaattttaccggggccttcgggccccctaacttggataataaaatgttatatgaatgcgctggagatattccaatggcaacacctcaaattaaagaattaattgcagcaggattcccaacagaaatcactgatattcttggaaaatttgcttatcctgatactcggcctgaaaattggaaaactcgctataacgggtataacaccacagttttaccgcgggctatcgttcttaaagactattccaagctgaaaaacttaatttctaatatttcgtctatttccgacggagttaagcttgtggatatttttgcacttcggtacggaatctactcttttaacgattctccatcaaatttaaaatcagcccgtactaatgccggtgaatactctacttctggttcaacaacgtacaccatagttattgagattattcataataaaaatagctatcgtcttggtattaacctagttaaatatgtgacatctcaggatgattatagcaattatttaaattactgtgttaatgaattgccatcaaaggttatgagtatgtttgactctaacaacatggtaggcaaacaattaatcattgatgaatttatcaaatactgccgtgagagggtgcagaaatgagtaacttatatctgccaagtgaacctcccgtttataattatgtctataaatttgatcagattgattatgcccttgttcctggtattggtgcaactgtcggcgcaatgtgtacctttgccgcgattgatatcatgcatttaactgatattacaccggcagtgttattcggaattctgcttgcatggtggggaactagtttgctcatcatgggattaattgaatgttcccgatgggttaaatggtctcgcaataattataagcgtaaagctgaatggaaagaacagtgcaagaatttaactcttgaatggaatcgcaaaaagtcgtttgagtttattaaagaggtgagaagaaaatgaatgaatataaacccgacggattttggaatcaagatgggctcgcgccaggttttggaattgtgacatggcttttatattgtgctttcgtaattgttggagggacattctttggattgaacgtctcagagtttatgattatgcttttatttttaggtgttttcgcattcagcctcatgtggatgctaattatcgcgttgattaattgctgtacatttttagcttaccgaatgaaatacaagaagtggaaagaaaaagaagatttcaacacctggattaggagctgcagaaaatgattaaaacttgctaccgtggaatgattaaaagcgatgagcctgggtatttcttcctatttctgcttatttggttttcattatcagcctttgttggatttggaacattctgggggttctacttcttttctccagtatttggcgatgcgttatattacataggctggatgtcaggtgttggaacttggtttgcaatacttgcccggtggttgcaattcgtttcccagcggcagaggggtgtattcgataagcccaaagtaaagaaagaaaaatctaaagatgactctcgtagtgaaactttatcctggattaaggagatgaaataatggctgttgcagtgcatgtaaaatttgaaaatggtgatactcgccttctgtgttacagtgataatgaatcactgagcggtatcgagatttcactcaaagaagaactgcttggtattaatggacctatctgtgatttctcggtagaaggttcggataattgtaatgatgatttggagtctatggtctatactgccatggaagatattcttgaagaaagttggaacgaatgccaatgaaagagctcagtgcaggaattttattctttaccgatgacaaacggcttttaatgggtcgtatgacaaatacatatgtccagggcagaggctctagatgggatattccaaaaggacatgttgagcctggtgaaacaccaaaagaagctgctattcgcgaatgcaaggaagagactggatttactgagtttgaccaagacctcttatatgaccttggacgacatgattatgcaagcaataaggatatccatctgtttggatatatgctccctgtaagcccagaaatgttcagaaattgccgttgtacagcttaccataaagatgaaaatggaattaattttcctgaaatcgatgcatttgctttaattaaaccaagccagtggaaatatgtgatgggaccaagtttatacaaaatcatgacgcaaatgtatagcacagctcagtgaggttattatggaagaagccgttgaattaggcattccacacatttataaacatgagctacgatttattcacgatggaaaatggattagcatatttcatcctagggataaaatgtcgcgtatactaatgaaatcacggtatgtcttcagtgatagtgagtatataaaatcagcatattatatagcagaacagctatatccgggatttagtgaattgcccgaggacgataaaagagattatgtgtggtggaaagataaatggacaccatacgagaagtgtagccttgagttattcatagccaagtgcagggccaaataaatactcctataaattaataggaggtccttatggatatttttggcatgttgcgtattgatgaaggatacgacagcaaaatttataaagatagcgaagggtattggactatcggtattggtcacttactgactaaagacccgtcaaaatctttggctatttctaatctggacaaactggtaggtcgttctaccggtggccaaattactcaggctgaggcagaagtaatttttgccaaagatgttgagaaggcaattaaaggtattgttgctaatgctacattaagcccggtatataatatattagatgatgttcgtagagctgctctgattaacatggtattccaaatgggtgtgtctggtgtagccgggttcccagcttcaatgaagttattactcgctaaaaaatgggatgctgctgccaaggaacttgcaaattcacgttggtatcgtcagacacctaatcgtgctcgtcgtgtaattgaaactatgcggaccggaacttgggccgcttatcaaggaaaataaatgaaaacctatcaagaatttttaaatgaatcccgtttagcaacagttggcgtaatgactgaatctgttggaagtaatcttctgaaatttaaaaaaggtcagaagatgacagccacgctagaagatggcacagaaattgaaatggacgttgttggatataactacgtagtagacggcaagttatataataagagccatgctaagtttgattcattcgatgattttgtctcttcggttgaagatgaatcttctcgcaaagcagtagcatctggcgatgcacgctctttaatggcccatggacatatgcgtattaagtctaagcagaacaaacctggtgaagataactttgcattagtaggttatcagtctggtaaaacttctaacggttaccagcgtacggttaccatgtacatgcgtaatggtaaaattgcattcgtaaacgatcgcggcgctattcgttacgctaaatcaattaagtaagcaatttcctaataaagccgaacacgacctctcctcatgaacgtcgagtcctctgagtgaagtagcttttcctacctgtaataaggtcgagcgcaagtgcggtaaggggtttacatagtgtgtcgatggattaaacatgtgccaaggaatggccccatttaatttaaaacttttacctttctggatttaaaaatgaaaacttataaagaatttatcactgaagcgcgagtgagtgcaggtaaattagaagccgctataaataaaaaggcccattcatttcatgatttgtcagataaagaccgtaagaaacttgtaagcctttatattgacaaagagcgtattctcgctcttcctggcgctaatgaaggtaaacaggccaagcctttgaatgctgtcgaaaagaaaattgataactttgcttctaaattcggtatgtctatggatgaccttcagcaagcggctatcgaagcagctaaagtaattaaaggtaaataacagtttactttctcctagaattgtgatagtatattcatatttacatttaaacaacattggaataacctggacctcatgattctatgagggattcccgcctacctgtaataaggtcgagcccaagtgtggcaatgccagttacataaggtatcggaatggactcactccatgcgccaaggaatggccccattaaaagagagcttatgaaatacttaacaccaatttatttgaccctgatgcatgctttcaaagacgctgcagacagacgattaaataatcccaactacagtttttatgaaccgtcttgccttatgcgagagtacggtacccttcgtctagatggtggaagacaaaccggaaagaccgcagccttatgccaattcgctaccgattggttgcttgaagatggttcggttataatcttatctactcgatacacacaatcatctgaactgatggaaggtattctacgagaatataattcatcgcatttaattaataaattaccggctaacgagatagctaaatcaattgttccgatgacaatcagggaatttctatccaatgattcctcttataagtttagaggaagaaagcttggaagagcattaattatcattgaagaaccaatgaaagttcccgatatgatgaagttctatgatatgtaccaggaagctatcagatggtctatgcctaatgataccttacctttatttttcgtgataggaatgcaatgatgacacagacagaaattgttgatatgattacagtgatggaaaatacaggatttgccgatatgaagcaattaataacaatggttacggctggcaacctgcttgagtacaagcgctacaagtttctgtctggcccgttcaaaggcgcagaattcatttctaatgctcctaacacgaagtggatgaatcgctatcctaattttagaattgagtttatatctggtaagctaaaaggcgtgattagttcaagcttaatcacatatgaccaacgcattcaagagaaaacaatgcaatggctgaaattgttataaggtgtcctccacacctagttgagagcttctgtgaatggttcagtaattctggtgagcaagatttttatgaagctcaccagaatggaacttggaatgaaacaaccaaacagtgggaagaagctacaacgtatataggcactcgcggatatggagttaacgagcctattgaaattgtggaatacgataaagaaactgatgaagaagttacttatcatgaagataaaataacttatctagaagcagctgcaaagtttcattcagacgaatggaataaaatgagtgtaattaccgcatacatgcgtggttggaataaagaatctaattaagaggaaatatgaaagcatatcaaattcttgaaggtgaacttaaaggcaccatttacatcgaagatggtgatgacgcacgagtaatcgtttcaaaagttcttaaagaagatactattacggatgctgaaactttttatggctacaaggctcgtgaagtagaaattgaataccagccaacggtaaaaattgaaggcggtcagcacctgaacgttaacgtgctgcgtcgcgaaaccctgctggacgcggttgagcatccggaaaaatacccgcagctgaccattcgtgtttccggctacgctgtacgcttcaactccctgacgccggaacagcagcgcgacgttatcgcccgtactttcacagaggcactataatggcaattgaagatatcaaaggatataagccacataccgatgaaaaaattggtaaagtgaatgctattaaagacgcggaaattcgtcttggattaattttcaaagcgttagaagaagaacatgttgaaaagtacatgaatttagatgttagcacaatgagcgacaaagaatttgatttagcacatgagcgtattactcaaattcgcaacgcgattcaacacttgaaggaagcttctatgtgggcatgtcgttcagtgtttcaaccagaagaaaaatattaaaaagtagtttactttccttacgggccatgatactatggccctacaaacaaaggagaatgaactatgtcaactaacccagaagtattcatccgcagaactaaactacgtcgtaagtttgaggaagcatttcgctctttgaatttatcagttcgtgcccgagctaaagctgagggcaaagagcctttcttcactaagtactctgatcatttgttggaccgtgctatccaacgtgaaattgatgaagagtatgtattctctgttctttccaaaattcctaatcatcttaaagaaattaatgaattcttagcaatgccttggcttccaattgacccaaaggacattgatgaaaacattgagtataagccaatgcggttagaaattacggatggaaatctgtggctagggtttactatggatattccaagaccaggaaaaggacctagtataaagtgtcgtatggcattcgttaatgataaacgtttgaaaggtaaaatcagcacaaaagttatacacattaattgaggtaaacatgaaaaaagcgcttatcggtctaatggccttatgttcaacggcctttgggtctgagccaactttcagtaatgttcaacttgacaacttgcattacgcatataattttggtgaacaatatcaaaaatccggaaaagaaaaatctccgcataaccgatatgataataacggcttaggatatataatggctgctatatcatggaaagaatcttcggcaggagccaatttaaaagcaggaaaggggcatcattcttatggggtatttcaaaattacttgcctacggttaaagccagagctaaattagagggcaaaaaccttagtgattctgaaataagaaaaatgcttaaatctagacagaattccgcggaatgggcatatattgagctttcatattggttaaatatacataacggcaatatgcgaaaagctcttgctagttataatgcaggatggaatgtcaaaaggggaaactcttatgcgtcagatgtcctagagaaagctaatttcttaaaaaaacataaaatgctacatacaaaggtggaataatggtaaagtacgccgcgcttcttggattggtattggcattctctgctaatgctgaaaattcaatgacagattcacttcgtatcgctaaaacattttgcaatacgaactctgaatgtgttgatatattagcgcttgaattagattcagcattcagcgatggagtaaaagattcacgtagcccggctcagtggacaacactaataaatcgtaaggctaagagcatgaaagatttatgtgtcaatgctcctaacgaaaatatatgtttaatgtatcgtgaccaattaatggctcgttatatgtcaggactatcgtcaaaatgaaaaaagcggctattttattatgctgcgcattttcagttaatgcctgggaaaaactcccaggctatcctgaaactgtacttgcagcacagggtactaaaatagaaagcaatggcccattcaagaacaacattgaaatagcatttgttcctagcagcagaaaattgctaatgtcattttataattatcaagataaagatgaccaggtgatagttccacttgtcgaatataatgctcgtggatgtggaatgcagagcgatggcgtttctgttgatggagtaatgcatcctaaagaacaaggagtgctgaaccctatccttaattgtaacaatgctatatttttaagagtatacaataatcttaatgaatatgcaacatataaaattccataggtgaataaatgattactggatatattaagggcaatattgtagaactattcatgaagcatgaatgcgatatcgctcatgggtgtaattgctttactacaatgggtgctggtgtagcaggacaacttgctaaagcatatcctccaattctcgatattgacatcgatgaagaccgttattatgacaataatttagccaagcttggaactcatacacgagccattcacaaaaaaggcactgcatattgctataatctgtatactcagtatgctccaggtccaaacgttgattacggcgcaatttttaatgcattccatgaactaaattctggtcgtattgtttataatcgtcctctatacattccaaaaattggagctggtattgctggcggtgattgggaactaattgagaaattaatcaatttagcaacacctgatattgacattatggtggtagaatatgaagaagctaaaagctaaatccgtcttgtagaggtaaatagatgattactgaagagcaaaaaactaaactgtggcagttgattgacgattatgcaggtgccgagcaagtagtagctattagtgccatttacggaaatggtctacctgaagaatacgatgaactcattcgttctaagaatgctatttctgattttatggagacactttaatggcacagctttatttcaactacgcgagcatgaatgcaggcaaatcagctaaccttcttacagcagctcataactataaagaacgcggcatgggaactctcattctgaaacctgctattgatactcgggattcggcaacggaagttacttctcgtattggtctacgtcatgaagctaatacagtagacgaatctattgacatacttgaatttttcaagtgggcacaaacacaacgtgatattcattgtgtatttgtagatgaagcacaattcttgactgctgaacatgttcttcagctatgtaaaatcgttgacttgtatgatgttccagtaatggcatatgggcttcgcactgattttcgcggcgagttattcgaaggttctaaagctcttctttctgtagccgataaacttgttgagctcaagggcgtttgccactgtggacgtaaggctacaatggtagctcgtattgacgaaaacggaaatgctattaccgatggtgaagtagtagaacttggtggtgaagacaaatacgtttctctttgtcgtaaacactggtgcgaactggtaggtgtttataatgaagccaagaacgtataacactatcctgatgctagttttaagtatgttattcatttggatgggtgtagcagcatctattcaaagcgatagacgagaagaacttcaaaatcgtcttgattctggatgcaaagtattagctcagggtaaagactttattgctaatacaaatgggtgttatattaaatatgagtagcctatttgctatagcgggtgtatagtactagtactcgtgattgggtttttactatacgtaatatttctttcgttattggtttaatatgaaaaaatatgtgatgtgctatcgttgtcttcatgtatatgattacaacactgctccaaagactgctaccaagcgtcttaaaaccaaagaacctgaatgtccaaaatgtaaatgcaaggtcatctattcatgaatattaaatttttcaaatcaggattttactatcgttgaggtaatttaacttaacgaggtaataatgtctagaacaattcgccgtaaaggctggcatgtagtaaaatcttccaaatggaacgatcagaataataacgaatttgcttatattaaaagctataacgaatacgttaaaactcagaaagataaagaaaaccagcagaaatatgttgaactgcgtatttctgaaaacagtgaaagaccgttagaggccaagaaactgatcgctaaatcaaagcgcgatggattctggaaaactctacgttggacccgttatgctatgccggttccgcgtttatttcataaagccgaaattaaacgtgcattgaagtatgatgaagaatataactgggacgaagctggtgctagaaccattgagcaaggcatctgcgaatggctttgggattaagtaacacatacttatataaatactattactaactgatgaggtgtatatgcagcatttaagtgaaaagcaacttcgtaatcttactgtagagcagctggacgaacttcgtcgtgagattgggcatggtatttcgcaccttcaggaagaaattcgtcaacatagttcaaaagcagattatacccgtaaacgtacgctggaaaaatacctcaaagaagttaaggctgtacttcagcacaaacgtaatactggacaaaaataataggaggccgtatggcctttaatcacatttgcttagccctggtgttgggctgcgggatttcattcccagctgcatcacacgacgacatttcagattataattcgtatgttgagggagctctacaagtttatgctaaatttaaggagcctagtaagcaagagtctgaacagttctatgctttcgtacaaagtaaatggaagagcgagtcttgttctaaagattgcgattctttaggacgttcagcaggtgaagaatacgctaaccgtatgaggatacaattcgataatgaagttcaatgattttgtaaaggacggtaaacttactccgcaggatgaattcatcggtttacttatggtgtctcaagcgtattttcattcagcgcattttgataccaaatcgtatgccagacataaagcgtatgaagttttctttaacgagattccagatttgatagatgcttttggtgagcagtggttaggattctcaggtaagagttatacaccggctttaccatcgcagaaagagctgccaaaggacaccattgaaatgctagacttcattctggctaaggccgatggtatctacaagtccgttcctgccgccctccaaagtgttctggatgacattacaggcctatgctacaagactaagtatttgttatcattgcagtaataccctccgcctccttcgggaggcattttcttttcaaaaagttgtttacttcccttcattacatgatactatagacatatcaacaaccaaacgagaaaaacattatgattaagttaactaccgagcttcaacctggaaaaatcttttatcacgtgtgtggtgttaatcgcacagaaactaaacccggcgaaataacgcgttacattgttgcttcaggcacatatgatgtagaacttggtcttagtggtgtatattcacgtaaatctcctttcttccaagtgatttgtgaatatgaaaactatgctggccaaactgaaagctattcaactgaacggtctgcccatgatatgggtatattcaagccaggtgaaaagcgttcggttcataatcttaatcgtgggttttggacgcgtgaagaagctgaacagttcatcaaagagctccaagaaaataagttcagcgatccagatgatcaagcatatgcagacagactgaccccttctgaagatttccgccgtcaacaagaatttatggattcttatcttgacagttgtgattatgattactacgactttgatgatggcgaagaatgagaaacgttttacttatcatctacattgtggtacaataccagcatccgatgtttacatataatttggtgcaaatgattctggagagtttgaaatgaatggatggggcccatcagatgacggatttgcaactcgcgaagctacaatagcagacgggattgaatgggcccgtcttcagaaacaactccaagaacagcgggaatccgaagagttctgtgttgattgtgatgaggaaatcccagtagctcgtcgtctgttggttaaaggctgtcaacggtgtgtagaatgtcaaggaaagtgggatacagtaatgacttctgcttataatcgccgtggttcaaaagattcacaattgaggtaattatggaaagtattcttgatagtaccaatttagataatccgtacagcgatgtgcatgtaaaggttgtgaattcgtattttactaaaaagttgagtcgtgtcgtgctaaaacaaggtaatgatataattcatcttgatactaaacaaattgattcattaattcaattcttgatagaggcaaaagatggcgagtaaattagtatgggacggaaaaccccgtaaaggcgatgcagtaattgaagatgaaagcccgcatgttattgatttgtatcttacggtattccacacgtatgaacataatactatcatcgaaattgaacgtgacggagattgtgtagctattgataaaagcgacgctattgaactggtcaaatatcttaccgcaatgattccaactatgaaacaggataacttataatgaatatcaataaaaattcttggcatttcaaaatgaacctatggtttaaatctggcaatatatggaaaatgccaaaaactctatgtggatacttttggaccacagtacttcatattctgttctcttcagcaattgctatattcattggttctgttgcatggatgttcggttggccgcttatagcgcagacgggtattctcgcttggataggtgttagtttatccgccttttggctaaatgttgtagcagtaccagttggtgcagtgtttatagcaacatttgtgcttgcgtttgtagcaatagtgtttggatttattttcggtttagaaaaatttaaagaataccgtaaaaataaacaatttacgaagaaacttgctcgagtaaaagctggtcttccggcagaatccgaaccgttagtattcatccagtatttaaaagctcgtaaacggaaagtttgcccaatgattgattatgtagaaggtaaaactagtgaagaatgatcaagtttatatcgtgaacggccgaaaggccgtctttcgtgctaaaactgaacgtggtataatttctacataccctattgccgaatttacttttgaagatggcgagcagattaaaattaaatatgttccgttatctcagacgtaccgattcatcggcggcgaaattgatttagacatttattatgaaggtggcgtatggaaattgaaatcgtaacaaccaaaaagaaactctctatgagcttgcttaagcagatgaaaatggcaagctcttctgaaatcaaattcgcaatgtttgaccgagttcatcgtgttcttggatatgttaatgcctttaaatggaacaaaatggatatccaagtagcaatcattaacactgggaacgattgggcattagttcctatgtatgatacacatgttattaaaaccgcccggcgcgaaccacatccagacggtcaagaatatcatttccatgacgtagtatactaccatactatgcagaaaatcgggaatgttcatcgcaattctaagaagagtactgataaagaacatgttgaagcctgtgctaaagcctcaaatgatttgattaaattcgctaaagggaatcatatttacttatgaaaacaatcgtaaaatcttattttggttcacatctgtatggtacttcaactcccgagtcagatgtggattttaaagaaatctttgtacctcatccgcgtgatattctaatgtgtcaggcgatgaaccacaccaattgtaatactaacaacagcgcaaccaaaaatacgaaagacgacgtcgaccatgagctgttcagcttaaagtatttcttcaagctcgctgctgacggtgaaactgtcgcgttggatatgctgcatactccaccggaattggtagttgcatctgaccttcctgaagtatggaaattcattcaagacaaccgagctcgtttctataccactgacatgaaagcttatctcggatatgtccgtaagcaagcaggtaagtatggtgttaagggttctcgtttagctgacctgcataaagtcctggatgttatcagagatgttcctgaatggaaatatgacgatcgtcctcagcagaagggtatcaatgagcgttggaaagtacaggatatcgcagagaaacttcctctcggtgaattcctcgaatggaccaccttcgttgaccacaaatcaggcgagcagaagttttataacgttctgggtcgtaaattccagacgactatcactatcaaagagatgaagtattcccttgagaagcttgatgctgaatacggtgaacgtgctcgtaaggcagaagctaacgaaggcgttgactggaaagcactgagtcatgctcttcgtgcaggtctgcagcttcaggaaatctatatgactggtgaccttcaattccctctgacccatgctaaaatggtcaagatggtcaaagcaggtgagttaccgttcaaagaagtacaggagcttctcgagtctgtagtagatgaagtagaaattctagctcatactgctgaaaagaacggaatgcctaagaaagtagacatgaagttctgggacgatttcgtcgagaaggtttatcttgaaaaccacaattcttactacaaatgatacaatgaaggtcttcttgaattatggaagacctcataaaggtagacggtggtatttggaagcagtttgcagagagactggtcgtagagaaaatgctaaattctctgctcgaccaactcgaaaacaaatccaccaatttatgtcatgggccggagaaactctccggttctcactttactgggctgaaatatgattttactttggagcgtagtagtgccaatcgttgttgcaataatttactttatcgtgggttggtctgtctgtaaacatctaatcaaaaacggaactattgagaaggtaggagagtattggttctatctcatcttttggttccctgcttttattgttggagcgattatcatgttcttccgctgggcaggtaaacttccaaagcgtatcgcagaaaacgctatcaacaagcacgcataactgaggagccttcgggctcctctttttgtttcaaaagaatgcataaagtagtatacaaactcgcgggctggtgatactatagacctgtaccacccaaacagatacattggagaataaaatgaaaactttagaaatcgtcgtaaacaacattgataaagcctttaaagctgctgaagcccacggtgtagaatttgaaccaatgatggtgggagaagcgttctctaagcttgctatcatccgtggtgaaactgacaacttgattgattttgtggatgacttctatctcggttcaaaggtccgtccttactacatcaatgaaattttagaaaaataattaaaaagtagtttactttggagctgtagaatgatactatagctccatcaaaacaaaacagagtaacggagaataaaatgtcaactatcaccatcaagaaagggatttacttcggcaaagagatttcaggtacttatgagttactcggtgagtggttcccggatagcttaagtgctgaagattctcgccagggtgatggtaaagtctttgttgaactgaatggcaaaaagcgtggtgtttgggtattcaaagatgatatcacaattgacggagtagctgctaaaattgaagttgttgaatccgttgatgaaatgaaagagcgtatcaagaaacgctttaacgttatgggattaatgactaacggtttaatccacgggaacattcgttctctgattatctccggagcagcaggtatcggtaagacttactctttggataaagcattacaacatgctcatgatactaacgctattgattacaaatcagtgaacggtaaaatctcaggaattggtttatactgccgtctttgggaatcacgtgaagcaaattcagttctgcttattgatgatgtagatgtattctctgatatggacattcttaaccttctgaaagctgctttggattcaggggagaaacgtaaagtatgctggagcactgcatcttctttcttggaagataaaggaattcctaatgagtttgagtttgaaggtactgtggtctttatcactaacgttgatattgaccgtgaattagagcgcggttctaaacttgctccgcatcttcaagccttggtatcacgttcggtttatcttgaccttggtgttcacactaatgaagagattatggttcgtgttcaagatgtaataatgactacttctatgttacagaaccgtgggttaagaaattctgaagttattgaagttttggaatttatgaaagataacgtaaatcgtctgcgtaacgtatctctccgtactgctctttatatcggtgatttcgttgcgactgaccgtaaaaattggcggacaatcgctgaagtaacaatgctgaaataatttaaacgggaggagaaatcctccctaactgaggaaaatataatggctactttaatttctaatgatgtaaaacgtgttttgtttaaaggcggaatgtatatcgttgatactcctaaaggtgatacctcttcctggactattaacgagtggattaattacattgatgaaaacggagcgtgggtacaatgagtttagcagctattaaagatattgaatgttggttaaacgatattaaagtatatccgcctggtcatatctttgcaggtaaacccaagggtaaagcagagaaagcttgtgaagcaatctgtgaaaaactttataagtttaattttggcgataagaaaaatgtattagctgaagtccattcttcttatcatgaattacgtgtaatggtaaacgtatttcgtgctcctccattcattgagctcaggaaagaatacgctaataaagtatttgatactttccttgcaaatgtgcaggatgcagtaaagcatttagacgaaatgcataaacaacaccaagatttaaatgcctattataagccttggcgtaaatcataccaagagcttaaaaatcgtattgaacttattcgttatgaggtgctaaaatgaaaaactgggtaatgacggaaagtgaagcctatgcagcgtatgtttcaccagacgatcgtcgtagtgagttgtttggttattatggttcatattgcgttgccgaagaagcagttaaggggcagtcttggtggggctcagatggtacagttaatcgtaagccaacggaactaattacattcaccgatgaaaatggcgaatcatggacttttcctaaaagcgctgctattagtgttcaggaagaaacacctgaagctaagcgtaaacggttggaaaaaattaaagaatccgctttggctaaattaaatcctgatgaacgcgaggcgctcggattatgagtaaagaatttagtactactcgtatggtagatgcttttggatatccgtgcaacggttatcgtgaatttattcacccggaagttgaaaatcaatttaaagaagtcgtaagaaatattttgctcaatgcatttaaaactcaaggaactaacccgagagatttaggcatttatcttgaagaagccatcagagacgtacaaaagagcgtatcggctaaacttcattgggctgaagaaaatattgcttggtcaaacaagaaacgttctgatttaaattggcccgctgatcgtgaacaaatcgtcaattatgctaaagggtaacccatgtttaatactatagtgtctatacatgcgtattacgaagggcagttaaatgctgcccgaaccaagtataagcgaggaatggaggaatctgtggaatgccttaaagatattcagacatttgcccagaagacccagaacctcatcttgatggaccgtaaacaggtctcattggctgaagagctaaaagcctctaagatgattatagaagacaataggaaacaccaactgaaattgcttaaacggcgacaacaccagtcgccatggtttaacagtgatttccgatctttttaagggccttcgggcccttttgttgtttacatcttagaaaagccatgataagatagcttccgttaactaatgaggagattgaaatgaaagcacctacttggaacgaacttcaagaaatgttcaatactgaagaagcttttggaactatttctgaaatggttgagaatttagtagattctccttcagaagataatcttctgtgtttagcacagttcatcattgaaacttacatagagaatcagaaatgacagtatacgtagatgtcttgatgaatcatggttggaaaatgagaggtcatcaagtaaagaactgccacatgtttagcgacaatcttgatgagttgcatgctatggcagaagccatcggaatgaaacgttcttggttccaggataagcgagttccacactatgatttgcgtgatgttcgtcgcaagcaagcagttgctctaggagcagtagaagtatctcgtagagacgcagttctgctttggagaaaatttttcacaaagtagtttactttcggcgaggctgttgataagatggtctcgtcaaccaaactggagaataaaatgaaaactttaaccgagattatctctgcacttgttgaagaaaatcgtgtagcccgccaagcacaccgagcgaaagttgaaaaacgcgccgaggagttgaatgctggatgggcgaagacccgcttcggtcgtgaatactttgataaagtggtagctcctacttggggcaaagatgatcgtcctcatgctccctttgatggttatctttgggaaaatgaattaggtgaagttgaagcttatcacgcaggcagttacttgccgtatgttacagaattggattcactggataagcctgagtataccggtgaccacggttggtggaaaatccgcttaactcaagaagagtacaaagaacttcgggagtatggttatcctcttgaagtacgcattccatataaagagtggaaattgcaagatggcacaaatgttgttatggcagaagttagagctcataagagcatcttagaggctatccaggaacattcaaaagaggtctttgataatatattcaatgagctgaataagaataaaggggatgcaccggaaggacgagtgaccgtctctggtacagtaacgtcagtaaaagtttatgaagactattacggcgtacaatgtaagatgatggttgtgcttgagaatggagctacggtttacggctcccttccaaaaagtattccgtttgaatacagaggcaaagtacagtttactgctacatttgaattagcgaaagatgataaaactcatgctttctataagcgtccaagcaaagttattatgcttgatgaatagttgttgtataatgggttcagggagattttgagatactctttgagcccagtccaaaatagaggaaaagataatgaataagaatgaattaaagatgtttgtagaagctgaatttaataagttgaaagataaaactctcacgaagcgtgagaaacatgttaaggtgttatcagctttacatgatttaaatccaagggcttatgatgtagcaattgctggtaacgtagctcgtcgtgtgctaaatagcatggcatcacatgaagccaattatgctggttttgttgtagaaaacattcgtcgttctcgctggttaggtgcaatgtcagcagagaaacagctcaaaaagtttgctatcggcaatgctaaaatttacggtcagcgttatagctttgcggcaggggcgtttaaaactgaagaaagacatgaccgtagcgctgctcaaatcttctgttctgaatttaatgcaaacctgcgccgtattcttaatcgttcaatttgcttgcttaaaggcgatgaccgcgtgaaataccaggcatcttctactagttctagaaatcctaagggtgtttcatttattcgtgccgaagaacttgacaatgtaactgtacgaattcatattaatagccatttatccagcggaaagtatccggctcgggcgcttttagcgcaagttcgtactgcattagatcatatggatgtagttaaaaaatcatgctgtaaacagcagggtgaaaactcatctgttcttgaagtacatttggacccatttaagatttttcctaaaacattgagcaccaccccagttattgatgaagatgtagcacatatgtatctcaatgttgttaagcctcttccgttaacaccagtaaatcatattgaaatcgctaagaatagtattactgccgaaatggaatcggttaagcgatttattgacacaaaagaagctgaattggctaagcatgaattgacgatggcagatttggttaaatcgcttaacgaatacaaagagcgttatgaatctctcgagtatgcccggagcttactgtgaaaaatcaattaaaagaagacatggtcgttgatgataacgaccttgaaattgagtttgagtatccacctgtacctgaatttaaaattgactgggacgcctgtcttgaaatggtagaccgtcgagaagctgcagctaaacaagttgtgccttgcgaaaaatgtggtagtattcaagtacagcttgtcgattggacaaccgatattctgaaaatgaaatgccggacttgtaaacacagatttgagagaaaattaaaatgattactaaaactattactggtgctaatactaagttttttgtcgagtatgctaataacctcataaaagacaaaaactttgataacatcattgcagatatgattcttgacgcatacgaaagtggcatcgaccctatgcagcttaaagaatatcttcgagcgacaatggattttacagttcttaacatgatgcttagaactgatactgaattcaatgaaatgattgctcgtcgtaatgaaggcaagttcaatttgactgatgatgaagtattagcatgcgctgctcacgaagcttggaagaaggtgattaaatgaaaacaactggcgcgctttggaaagaattttataacgatgaagccttctgggaaggctattatcatgatgacactttaatactctttgatgatgttgaagtagaagaatatgaagacccttcgcctgatgcggtagtaaaaattgaaagcggatatgtttacaaaaccgatgatgattccttcacttcccatgatttgagtcttgaaactttctttaaacgttggaaaaagaaacagaccactcgcactatggtagtcactgttgataaagatgacttcgccaaagtatttgaaactatctctaatattcctggagtgaaaaaggtaaaatgattgacattaaattagatacttatgcagtacgccagttattcccagaaggtacagcagcccgtgctcaactgcaacagtcagtaatcaataacatcgttaaagaaatggtgttaaaagattcacagaataagctgaagcaagcagtacaatctgaagttaatattgctgctgtgactattccagatgtccgagcagaagttaagaagcaagttcagcagatgttccatactcgcggttggaatgatatgtctgctaaagaagaaatgtcacagatgatgcgtaacgctgcccaatcatgcgctaaaaatgctattgatgatatggttcgtcaaactattgatgacgctgttaagcaagctgaaggtcgtattaagatgtctattgaaagagctaatctccgaattcaagaaatcattgttaatgcaatgaataaaaatttcgctgatcaaattaacgctgccattgctgctaaattggcagaacacttcccggtaactgctaatggataaaattgattttagcaaattaaatataccacgtatgggaattcctgatgatattgccaagcaattagctagcgttcaaccaatgccagataattgcatcaaagatattttcgatgcgttagatggtaaaacattagttataactactaaggctgaaaatggctcgtaaacgatatatggaagaagccgaacgagtaatgctactcatgtattcggtttattataatgagactggtcaaatagttgatagttctaaactcaaaggagctatgactcgtggccgaggttttgcacaagcagctattgataaagaaattatttctcgccttggaattaagtatagctccaagatgtatctccatcctggctggaaccaagttcaagctcaagtatttaaggaaatagaagaagatgttcacagtttttggctacgacagcaacatccataagtgtgtattttgcgataatgcaaagcgtctgctcgatgttaagaaacaagagtatgcattcattaatgtaatgccagaaaaaggcgtatttgatgaagtggttatcagtgatttgcttcgtcgtttaggtcgtgaatcacaggttggattaactatgcctcagatttttgctcctgacggtacacatatcggcggttttgatgaactccgtaaattcaaattcaatgcatgattatcgtggaaccctccttcgggagggtgatattgtagccctttattatggctatggcggattagaaaccggtgagattaaacaaatcaaaaatcatcgagcaaaggtagaggtaacttactctaatggagttaaggttatgtctaaatggaaatacggtgagtgtatggtgaaattatgattagcatgaggaagagttatgagttatgatattggtgatttaaaagctccgtgcacggtaacaatttcagcagaagagttcatccgcttgcaagctattgaagaactgttgtgggaaattgaatgtgcgcttccgtctggtttagaaagctggattgatgatgaagacctacaaaaactgcgaggttaaaatgactaacgctgaattagtaaaagaaatcaagcatatcgctggtgtcactggcgaatgggacgacaactatgatttcgaatatccgcctaatgcaccagacgatgatgcagaagaaatctttgttttagtagaagatgatgaatggacacaggaccataagtatcaaagccgttctcagatttggtattacccagctcgcggcgtccatttcatggtatcagagtctcgttcaggttcatatcataccgattggtattataatcctcctgaagtagatatcgtcactcgtcacgagaaagtagttactcgtactgaagttgaatggcgtattgaatacgattctgttaatgattccgctccggcaccatgcaaagcagcaaaggcataaaaccttggtacacggctcgatgggaaactgtcgagccagaggaagatgctattcctgaagaagattataatacttctgaacctaccattaacgaactacttgattatgaggacaaagtgaatggaacttattggtaagcagtttgaagttatagaaaatgatgatgaattaactgaacaatttccccagtttgttcctggatttaaatttcaggttatcaatgcagttaatgaagatgaccttgaaacatgtggcattacagcagtaattgatttgctcacaaataaaatcatcacaattaatgacccaactccattcggtgaatcttggttctggtgcttctatagtgaagataccatgcaccaaattaaagaaatcggccaaggtgaagacgttccaaatatttctgaaattaaactcgaccattttcatggaaaaattgttccaattaccaaagctctttatgctttcgcaggtcaagaaaattgtgattctgaagaatacgatttaatgcagaaagcagctgattatatcgtcgccttggaaactcgtcttggagttcaatatgtctaaatcatgcgtaaccaaaactattacagtaaaaattttggatttttgtgatattcatcgtattgcaagggaaatcttacgtagtcatggatataaaattggtgacattattaaattcagtaatggatattatgacgatgacatcggtggaatggcttggccaaaaatgagtattattcacaaagaaactaattcatatattgagttcaatgcggatgattatgaaggcatctatgctttctgtacttctttctgcataaaagagtctaatcataacatctatagtagttactcgttaatttaactataaatactcttatctaatcgctgaggtaagagtatgttattaaccggtaagttatataaagaagaaaaagaaaaactatatcaggcacagaacggattatgtccttgctgcaaacgtcctttagatgaggatattcaaaagaatcacctcgaccatgaccatgcgttagaaggtgacaatgcaggaaaggtcagaggcttgctctgtaacctgtgtaatgcggcagaaggccaaatgaagcataagttcaaccgctctggtttaaaaggtcaagatattgactacctcgaatggttagagaatttgctggtttatctccgccagaatcgtaaagacagtaatattcacccgcaatatgttgccgatatggctaaacgcttttcacgtcttggtaaacctgagatgattgctgaaatggaattgcatgggtttacatacgaggaaagtgatggaaaatcacaacttgcttcaaaatacaagaagcagcttcgtaagagtttaaaatgaatatcgaattagaaatccagggacttattaataaaaccaacaaggacctcttaaacgagaatgctaacaaagattctcgtgtttttcctacccaacgtgacctgatggctggtatcgtatctaaacatatcgccaatcaggtcattcctttctctgtaatggaagcacacaaagaaggtgttatccattttcatgatatggactacagtccagctttgcctttcaccaactgctgtttggtagatttgaaaggtatgttgcagaatggctttaaacttggtaacgctcaaattgaaactcctaagagtattggagtagctactgctatcatggcgcaaatcactgcacaagtagcatctcaccaatatggtggaactacttttgctaatgtcgatttagttctggctccttatgtagagaagacattcgctaaacatgtacgtgatgctcgcaaatatcaagtagcattagtaaaagattatgctatttcaaaaacagaaaaagacgtatttgatgctttccaggcgtatgaatatgaagtgaatactttgttcagttcaaatggccaaactccatttgtgactatcacatttggtatgggaacgtcatgggaagaaaaattaattcaacgagctattcttgataatcgtattcgtggattaggacgtgatggaattactccaatctttccaaagcttgtgatgtttgtagaagaaggcattaatctacgcaaagaagacccgaactatgatattaagcagcttgcattagaatgcgcagctaaacgcatgtatcctgatatcatcagtgctagaaataatagagcaattacaggttcagaaactcctgtatctccaatgggctgtagaagtttccttggtgcttggagagactcttctggcaaacccgttcttgacggccgtaataatctaggggtagtaacattgaacctccctaggatagctctggatgcaaattataaaagttcagatgatagtaataaactgttcaaactactggatgaacgtcttgatatttgtaaagaagctcttttaactagaattaaatcccttgaaggtgttactgcgtcagttgctcctattctttaccaggaaggtgcttttggtgtgcgtatgaaacctgatgatgaaattcttgagctattcaaaaatggacgtagttcaatttcattaggatatattggcattcacgaatttgatatgcttacttttaaaggaagcggtaaactcgtcctgaagtacatcaacactaagctaaacaagtggacggaagaaaccgggtatgcctttagtttgtattctactccggctgaaagtctgtgctatcgtttctgtaagattgaccaagccaagtttggtgatgttaagggcgtaactgataaaggctggtacactaatagtttccatgtgtcagtagaagaaaacctgtcgccttttgaaaagattgaccgtgaagcaccatatcattccattgctaaaggtggtcatatttcttatgttgaactgcctgacatgaagcgtaaccttgaaggtcttgaagtggtatgggactatgctatcgagaagttggattattttggtgttaatatgccagtagataaatgtctttcttgcggttctactcatgagatgacacctactgaaaacggattcacttgctcaatttgcggtgaaactgatccaaagaaaatgaatacaattcgtaggacttgcggctatcttggtaatccttctgagcgtgggttcaatcttggtaagaacaaagaaattatgcatagggtaaaacatgttagagaaaccaatgaagcaagttgattggaaccaacttagcgaatggggattgatttggaaaatcaacaaagaggttctgcacccgcttggaattgctataacccgtgaccccgaaagtggattatcggctggggctattcaaactgatgagccctggaaatatgatgcagaagtagaagcacgtaatgaggtaaggttcaatgaatttcgacagaatctacccttctgactttgtgaatggccctggatgcagggtcgttctttttgtcacagggtgtttgcataaatgtgaagggtgttataataaatctacttggaatgctcgtaacggacagctattcactatgaatactgttaaagaaattgcatctcacttaagcaaatcgtatatccaaggccttaccttaaccggtggtgacccactttatccacagaaccgagaagagatttcaaatttagtttcttgggttaaagcaagatttccggagaaagatatctggatgtggacaggatataagtttgaagatatcaaagatttagatttgctacaacacatcgatgttataattgatgggaaatatgagaaatcactgccaactactaaaaactggcgcggttctgacaaccaaagactctgggtaagaaatggttctacctggacacatgattgaggaaatttatatgctgacttacaaaattatgtttactctgaaccacatggctactgaactgtttggaccggaatttctggctatgacagcgttcatcttaactatttaaggaaaattatgaaatttattaatgctattcgtaaatttatttctaacgttatcgctttggttgcattaacggcaggtgctttcgtagcaattccgtttattgttcttattatcatcgcagattggattaatcctaccaagaaagatgaaaagttatctaatgaagaatttcagaaacgagttaacactctgactgctaaactccaacaggtcatgaaatgatagaaatctatggcatccctgaagaagtttggagatgccctggatgtaaagcagttcgtgacttgctcgataagctgcaacttccgtatgagttctataacgtaatcaatgaggtagacggtcaaccggtttatgaccgtccgttgattgagtcacttgctaaacgcatcgggtgctatccatcgcttgctattcggtatcctgtcatttttatggataacgttaagcagtatgacattccaacattcaaaaccaatcttattgctgctgggcatgacccagatatcatagaagattaaccggttcctttctaaggtcatcttgaccaccttctgtatatttctatacccttcatttagaggttcctgtgggacctctcttttattttaaatccatttcacaaagttgtttacaagctagctgatgagtgatactatagctctatcaacggataacagcataccgtttaactcgagaggaaaatatgaactggttaaattggcaagaagctctagaagctatgagtaaaggctgtaaagtaaagcatgtgcattttactgatgacgaatacttcttgatgaagaacaaagtcatctgtgacgaaaatggatatgatatgactcgctggtacaagggtgagtcttggcaaaacgaacattggtacatcgcatgaaaacttttgctgtaggtgatatcgtccgtaccagaatttgggatgggcttcaatttgaagtagttgtctacgtcggttcagatggagttctacttcaccgaattaacaatctgattaagtggcaccttgaacgcttcgtgaaatatcatgaattcaatagctaccactgtactgtagctccggttgctagtaaagaatactacgatatgctcgaagagttaaaatctctcaaagattgatttgctacaggagatttgatttaaaatctcctctgtcaagacaatcactactgaggaaaataacatgtcccaagcaattaaaaacgcactgaacgctttcgcatactataaagtttctgcaatgctggaagaaggacgttgtgtaactccgtctttgcttgatcagtgggaagttgagcttcacggtacgatgaaagaagaaggacaaaaaattggtaaagcacgcatccgtgaattagtggttgcttatcttctgtctgaatttggtattaaagcctttggtgtagaacccatcgtagttggtgttggtgaaatttctgaatccgctattcgcaaaatgaaaaaccaacgcaagaaaggttttcgtgatgtgaaagcggttaaggcggcaaaatgaaactaaatcaaaacggatgtccttctcgcgtacgattttgcattctagaattacgatctaacattgtcgttattgacgaatacaccacgattgtaggtgtacaacaatatcttgatagacgttttgatacacgaacccatatgaaatatggatttccaggcaaatgtaaattttatccaatgagtgctgatcatcaatctgtagtaaatgatgaatacaagtgggcagaaggtcttactttaaaagaacttgaggaatatcttgatgcgtaaagttattctatacacagaaatttttaccagccgttgggtgtttgacagtgtcagaatttcaaacgcttcaaaagaagatgttcgtaacgctcagcgattagcatacgatgaagctggaaaatcaccagcatttgtaaaaattgagtatatcattactgattctgctttaattcataatgtatcagaatcagtattaaagaagttctgcgttgatcgcatcaataaaggaacttcaatggaatattttctattagcgagagaactgaaatggtagaagaacaaattgcagaaatcggtttactcggatggttcgtgtctaaaactaaagacggcagaaacttgattgaaactccagaaggagaattcattattgaagaagattttgacgcgttttggatttatgaacgctctggagagaatgaatacacatccgtggatgctttctctaaatttgaagatgctattgactcggtgaaagcatggctaaagtaaaccaaattatgattgtagtagaaggcattggcggatttactatagattcttatatgggtgtttggtttgacaatgaagagggcatgtattgggaaacgcatgcctctatgttaaatgaaactcattatgaaagtttatactcttcattcatggaaatgatgcatgaagtagatgaatctgattggtttgaacttagtttggttgagttcaaacgtatcatggaacagctgttccaatgctatcgtattatgaagggtgaactatgaaaattcaattgactcttacacatgaaaatattaaaggtgtgttctgtcttgaaaatagccaaataacttttgcacaagatggaacgtactggtatgctgaatcagatgatatcgctggttatggaatggaacgtgtatttgaagattttgaagccgtcattgatgttccattagatttcacgtataacgatttttatcgtatcatgatgaaattaattgcatgcgctgaattgattaagtaatgctttaatcctctcgcttcccaaatttgttataatagatattattaattgaagcgaagaggcaatatgagtaattatgtaaataacaaggagttgtataaatcaatctgttcatggaaagagaagtgtcgggagtctgaagctgctggcggtcctcgagtagtaaaacagaacgatacgatcggccttgctattatgctgatcgcagaaggtctgagtaagcgtttcaacttttcaggatacacccaatcctggaagcaagaaatgatttcagacgggattgaagccgcaattaaaggcttaatcaacttcgatgaaactaagtatgataacccgcatgcgtatataacccaagcttgtttcaatgcattcgttcagcgtatcaaaaaagaacgcaaagaaatggcaaagaaatacagctattttgtccacaacgtgtatgattcacgggacgatgatatggttgcgttagcagatgaaacctttattcaggacatctacgataaaatgacgcagtatgaatccaccgcttataaggcgccagggtctgctaaaaagagcgaacctacaagtgatggacctaatctggaatttttatatgaggctgaagattaacctcgacgggtttttagaagatgtgcaagacctagacgctatcccttatttgctaaagatgtatttaagggaggtgcttgatcttgatattcacattgacccgaaaaatccacatgacgctgatttcagatcagattctgctataattgaacatagttataattggactgatactgaattcacatttgaaataaattaccatccaaaggaataacatgaacaatattacccaggaagagcgcgacgaactgcagcagaaactaatggaagcggcagaagaacaagctattgctcgagccaacaaaattgttcgtaaaaaccgtcgtgaaattgagcgattaaaagctcatgctggagacgcggtattagacaacaatttccctgcttacaagtatgctattgaaaaactgcgtactattttaaaacaaccttttaccgatgagattattctcacctgttggaatacctctcgtaaatctgtttgggacattctaaatgctggtacaagtaaaatttaaacgtgttcgtaaagacgcaggatttactttgaacactgctactggaacaatggcagtaaaagtagcagataatcaatatcgcgtgttaggctctaccgaaggatgtaagctaatagataagaactctcttgtctgggttgacaccttccaagttaaacggtggtatgaatggtaaatgaagagaattgggatgtatgacgaatttgatgggttctaatcctgggcatgattggcctgaaggaaattacgcgtgtcggtgtagtaattgttcagaacgttatacaggaccaaagcgtagttacttctgctataaatgcgataccgccaggagagaagcacccgctcccgattatgaagcaattcgtaatgctaagatagatatgctcaagcgctttgaagaagctaagcgtatatgcgaagcagcgggttatgttgtgtataagaaaatttaaagggcttcggcccttttgctttattacgggaatggtaaaatatccaaaattaacaacaaaggtcaatatatgaagattaatattttaatggctcgcggacttgagggatgcggcgtaaccaagttcagtctcgagcatcgtgagtggttagtaaaacatggccatgaagtaaatatcatttacgctaaagataaagcgtttactcgtaatagagcacatagctataaagatgtaactattcctgtgtctctggcagatgactacgataagactttatctctgcttaatgcatgtgacattcttatcattaactcagtacctgctgtcaacgctccagaagcagcgattgataactataagaagctcatagagaacattaaacctgaagttcgggtagtcgtatatcaacatgaccatagagcattgtcacttcgtagaaatgctggtcttgaagaaaccgttaagcgtgctgatgtactgtttagtcatagctcaaacggcgattttaataccgtgctaatggaagaatattttccaagcggcgggttgagtttctttgatgattctgactcagctcctccggtttataactttcaacctgctatgaacatcaaagcaattcgtgataagtattggaaagacttctctgccattgattttgatatccatcgttggattggtcgtactactacgtggaaaggctatttcttgatgtttgactttcatgaaagtcatctgcgtcccgcaggcaaaacgactatcttggaagggttagaacgcagtcctgcgtttattaacatcaaagaacgctatgaaattgactattgccgtcattatcatcaggttaaaactgggccaggtctgaatcctcaagttcttgaccgatatgttaactctgaaatgcttgagcgtatgtctcaatctggatttggctatcagctgtcacgtcttccggataaattccttgagcgttcgttggaatatactcatttggaattaggtgcatgtggtactattcctgtgttccataaagccaccggtgatgctttgaaattccgagttgatggaaagccattgacttctcatgattctggcattctgtggttgaatgatgaaaataaaaatgaagtctttgaacgaatgaaacatctgtcatctgaccagaagctctatgataaagagcgaaataaagcatttgaattcctggtagaacaccaagattctgagcattgctttaaagaacaatttgagttaatgacaaaataagtaatgggccttcgggccctttttgctattcatggaataatataaaattaaactctactagagaggttatatgaaaattattcactcaggcgattggcatttaggtgtccgcgcagatgacccgtgggtacaggatgtacaacgacacggaattaagcagcatattgattatgccaaaaagcatggaattaaaactatcattcaatacggtgatatttttgatgttcgtaaagctatcactcataagacaatggaatttgctcgtgaaattgcagagtctcttgagaaagaaggaattaacttaattacgatcgtcggaaatcatgacatgcactacaagaatacgttgacgcctaatgcatcaaccgaagttcttggtaagtataagcatattactgttattgaaaagcccgtgactatggattttgatgggactttgattgacttgtgtccatggatgtgtgaagagaacacatcagaaatcatgaagcatatcaaagaatcgtctgctgaatactgcattggtcattgggagcttaatggcttttatttttataaaggaatgaaatctcatgggctggaaccagatttcctcaaaaagtacaaacaagtatggtctgggcacttccacaccatatcaagcgcagcaaacgttaagtacatcggaacgccttggacgcttacagcgggtgacgagaacgacccacgcggcttctgggttcaagacactgaattatcaacctttgatttcgtccctaatgaaatcacttggcacagaaaactgatttatcctgtcacagggcaagttgattttgaagagttcagaaatcttgcagtgcgaattattatcactgcggtcgatgaagaccttcctaagtttgaatcagaacttgaaaaggtagtacatgaattaagaactgtttctaaagttgacaactcggttgagtctgaagatggcgaagaagtagaagttaaaagcttattggatttaatggaagaatatatccaagcacttgaagacctgtccgcagatgatatcaaagccttaaaggttatgtctaaacagttatacattgaggcacaaaatcagtgaagacttttaaactaaatcgtgtcaagtataagaatataatgtcagttggccaagcggccattgacattcaacttgataaatgtcaaaagaccttaatcacaggtaagaatggtggtggcaaaagtactatgcttgaagctattacttttgccttatttggtaaaccattccgtgatattaagaaaggtcaattaattaactcattcaataagaaggactctgtagtagaactgtggatggagtatgacggtcatagtttctacattaaacgtggacaaaaaccgaatgtctttgagattttacgagatggcaataagcttgatgaagccgcaagttcaaaggattttcaatcctactttgaaagcctcatcggcatgtcatacacatcgtttaagcagattgtcgtattaggaacggcaggatatactccgttcatggggttatcaactgctaatagacgaaagctcgttgaagatttgcttgaagtgtctcttttagctgatatggacaaactgaacaagacacagataagagaaatcaatcagcaaatccaggttaatgatgttcagcgtgaagcattgactaatgaaattaaaactcaccatgagtatgcagaaaagcagaagaaactttctggtgataacgttgctcgcctgcaggcgatgtatgatgaacaggtcaatgaagcccgtgggtataaagcagaattagaaactcttcagagagaactgcttgagttagtaattggagacgacccagcagagtcaatccaagaagttcaaggtaaaacatttaaaattcggtctaaaattgaatcatattcaaaggttcttgggctgtatgataaaggtggtcattgcccaacgtgcttgcaggatttgcattctaatgacactctaatcactaagattaatcatcatgttgaagaatgtaataccattcttggtgagttaaagacgcgccagagtgaactggatgaactagctcgcgagtataacacggtccgggctcgcgctagagatatcaaaacccaaatgggtagtttaaagcaaatgactatcactgctgtggaaaaggcacgtcgtattaaagcagctattgataaagcatctcaggagtttattgataactcagacaagattaaactgctacaagaagaattagataaaattatcctcgtcaaaactaatttggttatggaaaaatatcgtcgtggtattttaactgaaatgctgaaagactccggtattaaaggagctatcatcaagaagtacatcccgatgttcaataagcaaattaacagctacctaaaaattatggaagctgattattcgttcacactgaacgaagagttctctgaaacgattaaatcacgtggacgagaagagtttagttatgcctcgtttagtcagggtgaaaaagccagaattgatatagcattactattcacgtggcgtgatattgctgaaaaagtttctggtgttaaaataaactgtctgttccttgatgaagtttatgattcggctaccgacgcagaaggtgttaaggcaataactgctattcttaataagatggtagatgccaatgtgtttattatttctcaccgtgaccacgacccgcaggcatatggccaacaccttcaaatgaagaaggtcggacgattcacggtgatggaatgaatgagtttactacgggccaacatctgttggcctttcctgaattaaagcgttatgtgttagttaatttattttctgatgaacgtcatcttgtaactgaagaaatgttacgagatgcttttacgggaaatgaatataatagagtcatgtccaacaggaatcccggttggatggttgaagattactacgattaaggtaaatataatgattaattttgttgatgtgaaagatatccaggttaaaaacgtacgtgcagattccaacccgaataaccaaaatcgtattcgtaaatcttgggttctggctctaactgaagaaactaaacaggctatcaaagataagattaaagattctgaagctcgctttgctttctataaatctatcgatgatgaagtcgcagaaaaatggattgaactgatgcgtaagcattacaatgaatcaatcaaggctggtgctaaaattgttactgatcgtcacggtggcgaacgtctagaaaatgattactgtgtagatgctgatgagcaactcgttgcggcaggtcagattgttgcagaagaattaactgctacattcgcagcttgatataattatcctgaacttaattaaaaggtattgaaatgaaattctctaaagaaactctgaacattctgaaaaatttctccaccatcaactctggtatcatgctgaaacctggcaattttatcatgactcgtgctgttaatggtacgacttatgctgaagcaacaatttctgataccatcgatactgatgtagcaatttatgacctgaacagtttcctgagcattctgtctttggttggtgatgatgcagatattatcatgcaggaagatggtaatctggcaattaaagatgctcgctcaactatcttctggccagcagctgacccgagcacaatcgtgttcccgactaaaccaatcccattcccggtggcaaacgtaattatcgattttaaaggtgaagacctgcaacagctgatgcgagtatctcgtggcatgcagattgacacaattgctatcaccaatgttgatggtaaaattgttctgcgtggttataacaaagtagaagatgctgcactgacccgtccgaagtattctctgacactcggtgattatgaaggtgagggtaacttcaactttatcatcaacatgagcaatatgaagatgactatcggcgattataaactgatgctgtgggcaaaaatgaatggctccaagaaacagactgccgcaaaatttgaaggtgcatcagcctcttatgtagtagcaatggaagcagacagtacctttgattttgagtaataacttcggggcttcggccccatctttaatctgaatgaggaaatataaatgaaattgacagtaaacgaagcagacttcatgtgggaacagaaatatcgtccaggtactatttctgagtgtgtacttcctgctgaagataaagaaattttttcagctttagtagctaaaggaaaaattcctcatttaattctccatagcacttctcctggtactggtaagactacagtagctaaagcattatgtaatgacattaatgctgaaatgatgttcgtgaatggttctgactgtaagattgatttcgttcgtggaccgttaactgcatttgcaagttctgcttctattgcaggcaagcagaaaattatcgttattgatgaatttgaccgtgcaggtcttgcagaatctcaacgacatctgcgttcattcatggaagcgtatagcacaaactgtactattatcattactgcaaacaatcttgatggtatcattaaacctcttcagtctcgttgccgtgtaattaattttggtaaaccatctccatctgatgttaagccaatgcaaatcgagatgctcaagcgttgtctcgcaatttgtgaaaacgaaggcgtggtagttgaagataagaaagttgtagctgctttggtcaaaaagaattttccagaattccgtaagaccattaacatgcttgaccattattcttctaagggtgtgattgatgcaggtatcttgtctatcgttctgaatgaccgtggttcaattgaagatgtcatcgaagctattaaaactaagaacatcaaagaactccgtgctcttgccccgaaatatgcagcagactatacttggttcgtagataaactttcttcggaactgtatacaatggttactggcccaagcattatccgaatgtatgaaatcattggtgaaaataaccagtatcatggcatagcagcttcgattgaattacacttggtttatatgcttattcaacttgttgtagagatgcagtggaaatgatgagtttatttgaagatgatgatcagtataacgagcaccaaatagcgtggttaggtaaagactggacgaaagtccaggaattatctgattcatataaagaaaaagcagaaaatcaattcttcacaattattgggtctattaacgaaaagcaagagcatttgaatatctcgacgatggattattcaaaattcatggttgaaaacgctctttctcaacaccctgactgtatgccttcggtttatgttatgaaccttgttggtcaagggttatctgaccaagcacactataactatatgatggcctctgttcctagaggtcgtcggtatggtaaatgggctaagttaacagaaaacatccaggatgcattgattcttcaagttataatgacatattacaaggtcaatgcgattgacgctaggatgtatagagagaccctggaagctaaaaacaagcttaaacctgctctcaagaaaatgaaaggtcttgtgactgatgaattggtcaagacaatcacgaaaaacgtgaaagaacagaaaaatcttaagaaaacagcattggaatggtaaagatgattgaaattacactgaaacagcctgaagacttcctgaaagttaaagaaactctgacccgtatgggaattgctaataacaaagataaggtactatatcaaagctgccacattcttcagaaacaaggtcgttactatattgttcattttaaagaaatgttgaagcttgatggccgccctgttactattgatttggaagatgaaattcgtcgagactcaatcgcacaactacttgctgactggggtctactgagtattaatcgtggtcaaactcttgctcagatgcagaataacttccgggtcattacgttcaagcagaaacatgaatggaccttaaaatctaaatatacgattggtgcataatgacagaccaagaattttacgacaaacttaaaaatatcaggattactgctcctgaatggttcagtcttcctattgatgaacaaattcagtatcaggtaaaagaaactttagaaaaatatcctggccgaaaagttatgatgtgcttcacatatgataagaatcgagttcctcgaattcagaagcaagtaattgaagtttaagaaaaggccttcgggccttttactttataaaactcggagtataattatcccacctaaagactaataactcggtctataaacaaaggaaacccatgaaagaattttatattagcgttgaatctctaggcaatgacattgtagaacgttatatcgattctactggtgaggaacgcatgcgtcgtgttccgtattctcctgtgatgtttagtcattgcatggaagaaacaaagtacaaagatatctacggcaagtattgcaagaaaaatacattcccaactatgaaagatgcccgcgattggatgcgtcgtatggaagatatgggaatggaagcaatgggtatggatgatttcaaactcgcgtatatcagtgatacttacggttcagaaatcgtctataataaaaaattcatccgaattgcaaactgtgacattgaggttactgcatctcaattcccagacccaatgaaagcagaatatgaaattgacgctatcactcattatgattcggttgatgacaagttctacgtatttgatttactgcattctctttatggttctgtttccgagtgggacaagaaacttgctgctcgtttagattctgaaggcggtgatgaagttccacaacatattcttgaccgcgtagtatatatgccgttcaattcagaaaaagaaatgatgcttgagtacatcaatctttgggaacagaaatgcccagcaatctttactggatggaacattgaaggatttgatattccgtacatcatgaatcgtgtgaaacagattcttggtgagcgtgcgatgaaacggttctctcctctgaataaagtttcatctaagattatcacaaacatgtatggtgataaagaaatttattctatcatgggtgtgactattcttgattacatggatttgtataagaaatttagtttcacgaaccaaccgacgtataagttggatttcattgcttattatgaaaccaagaaaggtaaattagcatatgacggtccgatcaataaattgcgtgaaactaaccaccaacggtatatttcgtataacatcatcgacgttgaatcagtacaagcgattgatgctgttcgtggatttattgacctggctatctcgatgtcttattatgcgaagatgccatatcaaggtgtaatgagtccaattaaaacatgggacgcaatcatctttaacagtctgaaagaacaagacaaggttattccgcaaagtcgttctcatgttaaacagtcatatcctggtgcgtatgttaaggaaccagttcctgctgcatatcgctatatcatgtcgtttgacttgacatctctgtatccgtcaatcatccgacaagttaatatttcaccagaaaccatcgttggacagtttaaacttcatccgttgggtgagtacattaacaagactgctcctcgtccgtctgatgaatattcatgttcaccaaatggttggatgtatcgtaaagatgtagatggtgtcattccagttgaaatcgcgaaggtattttatcagcgtaaagagtggaaaaataaaatgatgggtgccaaacgaaatcaagaactgattaaaaaggttctgaatgataagaagtttggaactatcgataaattcgcagaagttaatgtctatgaagatttctctgatgatatgaaagcagaactgctgacatataccgaagagtgtcttgacaaactgatgtttgaatgtaaacacgctgaaatcttgggtaacactaaccagttaaaccgtaagattctgatcaactcactttatggtgcattgggtaacatttacttccgttattatgatttgcgcaacgcatcagcaatcacattgtttggtcaaatggcaattcaatggattgaacgtaaagttaatgaatacctcaacaaggtatgtggcaccgaaggacattcgtttgtagtagctggtgatactgactcaatttacgtttgtgttgataaggttatcgagaaggtaggtcttgagcgtttcaaagaaactaacgatttggtcgaattcctgaaccaattcggcaagaagaaaatggaaccatggattgaccaatcatatcgtgagatgtgtgaatacatgaacaacaaagaacatttaatgttcatggaccgtgaagctatttcttgtcctccgttggggtcaaacggcattggcggattctggaaagcgaagaaacgatatgctctgaacgtgtatgatatggaaggtactcgatatgcagaacctcatctgaaaatcatgggtatggaaactcagcaaagttctacgccaactgctgttcagaatgcattggaagaatctattcggcgtatgctgcaggaaggtgaagaatctttacagcaatattataagcagtttgagtctgaatatcgtgaacttgattataaagtaatcgccgaagttaagactgcaaacaacatcggtaagtatgatgacggtgcaggatatccagataaaggtacaccatatcacgttaaaggtgctttggcatataaccgagcaaccgcaggatttgaaggtataacaccaatcatggaaggtgagaaagtgatggtcatcccgctgcgtgaaggtaacccgtacggtgagaaatgcatggcatggccatcgggcactgagctgccacaagaaatccgacaggaagttctagtgtggcttgaccacagtgttctgttccaaaaatcgttcgttaaacctctgacgggtatgtctgaagcggcagggttagactatgaagagaaatcgtctcttcttgacatgttcgatttttaaaaaagttgtttactttaccacaaggatgtggtactatagctctcgaaataacatactgaggagattacaatgaaatcgttacttgctgttattgttgctctcacgctgactggttgtcaaatgccacaaggtgatatcgtcccggcttcttctgttgggcaggtgcgagcaattggcggtactgtaggatactatcgtgctagcaaccaggtctctgctgaatcgctcgcggttgagcgtcggttggcgaaagaaaaagctaatcctaatcgtcagctgtctgcgatggaacttgacatgattgagcagaataagcatgaactggaagaaattaagcgtctgcgtaaaactcaaaaagaacgtacgtgcactgctcaagcggcagcagtgaatgaccagattcgtttaactgattttgctaacggcggattgagttataatgagcataaacaacgtatggagcagttaaaatctctccaaaatcacatctacaacaaatgcatgtctaactgaggagattaacatggaagcagtatttggtttaatcattcttttcttcatctattttttgccgacctttgtagcttgcagtcgtaagcataaatcacggggtggaatctttatcacaaatctagtattcggttggtccattatcggttggttaattgcgctgatttggtctgcttctaacgcacagcagaatacaattattatccagcaagttaaataagaggtctcatgattgtaactccaatgacagtacaagatatccgtcaagaattcgctgatgctttgctcaacaaagaatttgtgattgataagacgggtgtgaagactattgaaatcgtaggtgcatcatttattgcagatgaaaacctaatttttggcgcagttaatgatggatacattgctcgtgaacttgagtggtataaatctcaaagtttattcgttaaagatattccgggtgaaaccccagctatttggaaagcaattgcatccaaacacggcgagattaattctaactatggctgggcagtttggtcaacacaaaactattcacagtttgctaactgtgcgaaagaacttatcaataatcctgattctcgccgcggaattatgatttatacacgacctcaaatgcagtatgattttgagcgcgatggcatgagtgatttcatgtgtactaacaatgttcagtatctgattcgtgataatcgtgtgcatgctgtggtaaacatgcgttcgaatgatgtcgtctttggatatcgtaatgactatgcatggcagctctatgttttggaacagttaaccaaacttctgaatgcatcaggtaaaaattattcagttggtgacattatttggaacgtcgggtctttgcacgtatattctcgacatttctatctcgtagataattatgctcacacgggtgaaactcacatcgcaaagaaagactataaaggtgaatggaaatgattcagtttgtaattccaagttataagcgcgccggggcagttactgccctgactatgtttcctgaaggttatgttccacatcttgtagtacgtgaatcagaaaaagaagcatacgaaacttggcacggtcatgctgctaaaatcgttactgtccccgatgatgtcgatggaattgcgggaactcgccgtctgattactgaaatgtatgcagggcaacgaatttggatgcttgatgatgatacgaccattcatctgactgaaattcgtgaacgcgacgatcgccgggttccacttggtgtcggcgaggcaatgagtcaagaggtatttgatgatatggtcaaatacgtcgagactgccatggattgtggttattatcacggtcatgctcgcttaccgattttcaaaatcacatcaagctggggtcattatcgtgagaatagctttgggttcaccaatactttctatgatttgactaaacttaccgcagaagacattggctacggaattattgaccttaacgaagatgcttatgcttttctaaaattaattaacatgggtcatcctcatctggctctgtttaagtacctcgttaaatctggtaaggtgcagtcacctggtggttgttctacacagcgtgatactgctcgccagaatagagcccttgaacagctgcatgctgctttcccaaatcaagcccgttggaaatctaaagacggtgaaagacgtggtttattcggtgatgacgaaccactaaaatcaattcgtatgtgtattaacactcgagtgaaatcccaggccttccatgaatttggtaaggtagaaccatatctgtgagggcgaaagccctccaaggacctcttatgaacatctatgataaatctgatgtagctggtaacatattcaaggctgaagaattcagatgcttcgtatgtaaatctgatgagtttgttcatgaaggaactactggctcagatggaatgcattgctggtggcacggcatgtgtgttggatgtaaaatacactacgaaatagatatggaaacagtggtttataacaccaagaagaaatggaacttctgttaatagcttcaagaacaaagtaatataattactctatcctttaacctgtgagaaaaatataatggagacttatggaatataatgaatgtctgacttaaaatctcgcctgattaaagcatccacttctaaaatgacagcagaactgactaaatcaaaattctttaacgagaaagatgtagttagaaccaaaattccgatgcttaatatcgcaatcagtggagcgttggatggtggtatgcagtccgggttgactatcttcgcaggtccatctaaacacttcaaatctaacatgtctctgacaatggttagtgcttatcttaataagtatcctgatgcggtctgcttgttctatgattcagaatttggtatcactccagcttatctgaaatctatgggtgttgaccctgaccgtgtaattcatacaccggttcagtcggttgaacaattaaaaatcgatatggttaaccagcttgaagctattgagcgtggtgaaaaagtcatcgtgtttatcgactctattggtaacatggcgtctaaaaaggaaaccgaagatgctttgaacgagaaatctgttgcagatatgactcgtgcgaaaagtctgaagtcgctcttccgtatcgtaactccttacttctctattaagaacattccttgtgtagcggttaaccacacaatcgagactatcgagatgttcagtaagacggtaatgacaggtggtacaggtcctatgtattctgcggatactgtattcatcatcggtaaacgtcaaattaaagatggttctgagcttgagggatatcagtttgtcctgaacgctgagaaatcgcgtactgtcaaagagaaaagtaagttcttcatcgatgttaaattcgatggtggtatcgatccatatagtggtctgcttgatatggctctagatatcgggtttgtggttaaaccgaaaaatggatggtatgcacgagaattcctggatgttgaaaccggtgagatgattcgtgaagaaaaatcctggcgggcaaaagatacgagcagtacggaattttggggtcctctgtttaagcatgagccattccgtgacgctatcaaagcccggtatcagttgggtgctattgattcaaacgctgcggttgatgaagcggtagcagaaatgattaactcaaaagtttcaactaaggttgatggtgttaaacttcctgagagtggttcagtatcagctgctgaagttgaagatgaattagagaacttcatgaatgaagactgagtttgatttagaatctgaactcgagaaatttgaacaagaatctccctcggaagagggagacttcgagcgtcaagaacgagtgttcaagaaaagccatgaaataatccaagaagctatgaagactgttatccaagaaattgtgataaaattaaatggtcaatcacacttggtttatgttcataaattaaatatttctccttcgggggaagtaactattgagttcagtacaccatctgaagctcataaggatgaactttatcctcatgtggaagcttgtgttaaacaacaaatccagagtgcattaaagaccaagaaaaaatcattatggaaaatcttttaagaggttaaagtggtagaaacaatcttagctaatctgatttacaaccaggctttctttacgaaggtttggccatatatggacaaagagtacttcgagcaaggacctgctcagacggtgtttaacataattaagaaacacgttaatgaatacacagcaattccttcaaagactgcgttatgtgtagcactggataattcgtctataactgaaacggaacatgaaggtgcaaagaaacttattgataagttatctgatgctcctgaagatttgaattggttagttaaggaaacagagaagtacgttcaagaaaaggctatgtacaacgcaacgtctcgaattattgaaattcagactaatgcccagcttgagccaaataaacgcgataagcgtcttcctgatattggggctattcctgatatcatgcgtgaagcgttatcagtatcgtttgatagctatattggccatgattggatggaagattatgaagctcgttggttatcataccagaataaagctcgtaaagttccgtttaaacttagcattctgaacaaaattactaaaggtggtgccgagactggtacactgaacgtattgatggctggcgtcaacgttggtaaatcattaggattatgttcattggctgcagactatcttcagatggggcataacgtcctttatatttccatggaaatggccgaagaagtttgcgctaaacgtattgatgctaacttgcttgatgtatcacttgatgatattgacgatggatgtgtatcatacgctgaatataaaggcaagatggaaaaatggcgtagttctagtactcttggtcgtttaatcattaaacagtatccgactggtggcgctaacgctaatacattccgagctcttctgaatgagttgaaactcaagaagaactttaaaccgactgttatcatcattgactatcttggtatttgtgcttcttgccgtattcgtcaatatactgaaaacagttacacgttagttaaagctattgcagaagaacttcgtgcattggctgtagaatctgaaactgttctttggaccgcagctcaggtaggtcgttcagcgtgggatgcttctgatatggacatgagtgatattgcagaatctgcgggtctacctgctacggcagactttatgctggctgtgattgaaacccctgaacttgctcagatgaagcagcaattaattaagcagattaaatcacgttacggtgataagaacatcaacaataagttctctatgggtgtacataaggctaatcagcgttgggtagaaattgagcagcaaaacgacccaactaagcctaatccaagcaataccgtccgagaaggtgccggtgcacagaaccgtgtagccgaatctaatcgtcaagaacgagtatcacgttctaagcttgatgctctagcagaagagttgaaattctagggtaaattttatgatttttgtgtttagcgtaattcgcgaccaatcaggtcgctcctttgtggtgacggcgtctgatagcgtccatcgtggagtcatagcttacaacaaagcagatttatcttcatatgactatggtgaagttaaggcatataatgacgaaggtatctgggttaactctgcgatataccttccaaccaagaatttgacatccgacgaagtcctcgaaaaattattcaaaagatagtttacttttaagtttggccatgttattatggccttactgaaacaaactgaggaaaacaaaatgaaaaagattgtacttgctttaatcttcgcagtatcaagttgctctgctgttcccgctctggcgaactatgacaaagacctctgcgaatggtcaatgactgcagatgaaaaagatgttgctgagcagattcgtgctgatgtaggtcatatcattgataacactgacccaagcaagatgaaagaagttcaggcagaaatctccaatgatggcgcagcaattaaactgaactatgctctgtactgcgatgctaattttgataacttcacaattgcaagctggattctcggatgattacatacgtattagtaatggctataatgactggtgccggcggtgtttctactgaaaagttatcattcacaggaatgaacgagtcttcgctggctcagaaatgtgaagatgcgggaaaacaatttactggcatcaaagccgattccgggttcggttcaccatcagtctacactacgtacaagtgtattcgtattgatggtggaaataataaatagtttggaggctctatgaaaacatttaaagagtttgttaaacttaatgaggaaatggttgctggcgatgccggcggtaatcctcagaacattgcatcaggcactacttcgggcgcagtagtaaataaaggcccagaaactctcccaaagaaaaagcgagataaatcaaaacctgaaacgtgatacaatggccttattagtttaaggccagaggaatataatatgtcatgggttgataacgaattcgctatccgcgcaatatctcacctacctaagtttagacacgttactacatcttcaacatttaagttaaactgccgttgcccaatttgtggtgactcacagaaagatatcaataaagcccgattctggatttttgatgcgggtcaaggattacgctgccattgcttcaactgtgagtataacaagtggctatcacaatatcttaaagataatgaacccgatctctatcgagagtatcttcttgagaaaagaaaggagcaggtctttgataagccaaagaccgtagaaccgtctgagaaaattaatgcaaaactccccgtaatagaaaaacttaatttctgtgagcgattagatagacttcctaaggaacatccgatagttaaatacgtgactgccagatgtattccaagcacttcttggaaaaggttatggtttactaaccaatggccttctcttgttaactccgttaatccaggaacctataagaatgagacgaacgaaccacgtttggttattcctatcttcaacaagaaaggagagattgagtcgtttcaaggacgagcactacgaaaaaatgctccacaaaaatacatcacaatcaaagcccatgaacacgcgaccaaaatttatggtctcgacactattgatgagtcaaaactcgtattcgtcatggaaggaccaatagattcgttgttcattgataacgctattgcaatcactggcgggtctttagatttagctcaagttccatgccatgataaccgagcgtggattatggaccatgaacctcgtcatcccgatacaattaagcgtatgaaacgtttagtagatgctggtgaaaaggtagttttctgggataagtcgccttggaaaagcaaagatataaatgatatgattatgaaagagggggcaactgcttctgaaataacggattatattaatcaaaatatatcgcaaggtttaatggctaaattacgtcttgacaaatatgcgaagatataggggccaaagccccttaaattaaagcaatcctccagtcataataaacgacacaactttttctaacggcattggaggaagaactagcccgtgtgtgctagctaatggaactaccacataattccatgcagctaaagcagcagtggcgattccgacgtaaagatatcttccaaatcctcctttgtctttacattctcgtttcacttcagacatgaatcctcctgctatttatgttaagtgatataatatttatctaatttaattgaaaggaaaaataatatgccacatttcaacgaatgtagtcaactgatcgctggtgcagataaagctgaagctcgatacgcaggtatcgtacgcaaagttggtggtgaccctctgcaagtaatgcttgatatgcaaaaatctcttcaggttcgtcttgcaaatgacaagcctggtactaacatgcatcctgatgaattggcccaagccggtgatatcgtgcagtggctgcgtaaccaaaaagattacattgatgacgaattccgcgaattgctgacgtctcttggcggtatgagtaatggtgaaaaggcagctagtgctgtgtggaaaccatggaaatctgaccacgtcaaaatgcaggaaacttatatcaaagacctgtctgataaagaccagcttgaaatcaaatttgaaatgattgatatcctgcactttgttctgaatatgtttatggcgcttggtctggattctgaagaaatctttaagctgtattatctgaaaaacgccgagaactttgctcgccaagacagtggttactgatggccaaaagaatatctaagcgtcgtttaaaaattatcagaaaacaaaaagaaagggccttagtattggcccttcgagaagaaatcactcgagaaattgataaagaaatattaaaggcgcttacagcagctatataaatactcctgtaaactaaataggagattaaaatggcttacgtaaacatcaaaacttttgaccatacaactgctgatggtgaagttaaaggtacagaagtatctgtagcttttaaggtgtattctgattcacatcgcattgctaacgcacagtatcagattttcccatctgaaaaagctgcttattcaacagtagttgatgatgctgcaacttgggcaaccaccaacgctaaaatgtttgaagctgttccatctgatgcagaagtataaaaattaaggactcctccgggagtccttttatgctatactgggaatagtatattattcctactaactgaggagaagaaaatgatatgttatactaagccctggtatcaatcgtcattaaagaagtctcattttgattgttggtacagaggtgtaagagctgcagcgttattactcaaagctgcgccggctttaattaaagcaaatgataagtggtttgaagacaacaacatgactgaaggagctctttgtggcaaacgcaaaaatctataacgcaaaaatctataaagtaagcttacaacgcgcagttcaatcaagaagtgatgcaaatggagttttgcgtctagaccaagatagaatttttactgttgctctatacagtacgttcgacaaagatttcaaagacctagttaataaattcgaagcgtttggttggtgtccttctgaagattatggcattattaagactgcccatgtctttgacgtagatacagttccaggaagtcctgttgctatactacgtgctctccacttgaaaggatacactaatgtatgtcatgaaactagcttatatgaatacgaaaatgacataatttcaagaggcaaaaagattatcattgatagcacagattctctaatagaatttactaagttagtttggttgtatatgggcgcagattttatcaaactgactccaagcccgctgttgcaaaaagcggctgatggatataacagcagtagttgtctgtatcgcaataatgagtggttcatgtgatggatttgtttgaaatgatggaagagcctcaggaagaggttcaagttcatccagtgatttctaaggacatcaaagacgaataccgtataattatacagaagtatggtattaaagccccagaagctcttctagatgaactagcttcaatctggtctgacccgccgccctggtctccgtgggcaaaataatttcacaaagtagtttactcttccaaaagccatgataagatacctctcgtaaccaaaaaatggagaatatcatggctatttcattaaacccatctatttcagtaaaattatcaaaggttattcctatcgaaaaacccattcgttccattgatgttcttaacttcgcgcgagaaagcaaaggattacctttatatgatttaagcgtgtgggaagcattagccaatcgttttgactgcaaagaacagtcaattctatggcaatgcatgaacaataagattggcgaagaatttcataagaaacttgactctatcgttagacgtcatcaaattgataatagtgacattctctatagaggtctatcatgccgcgagtctaaagccttttatgacgcccttattaaaggagagaaatttggctttggaaaggttgcgtcattcacaacagatgaaacgatcgccagagagtttgcaggcaaatggcattactcgacctttgtagtcattgaagtcaataattgccatcaatcatttgattatcataccaacatgaaatcgcttttaattactgcaccagattctgaattcatgcgtccaaatgatgtgattgataacattgctcagcgcagaagcgctgacatcgagatgattgataaagaacaagaaaggatgctaccgatgggaactaagttcaaagtggtgggtcataacaaagttgaaaaatctggtttacttatggactactttagtgttactatagcttagtcaactagtgattatctagaactagggacctagacccattataccgtccgtaagacgaaagcatttttgaggaaaacatgatgaaatttactgctgaaaccgctaagatttatactcgcctgattacaactttaggttctgcccagcgtcggaacaaggagttcaatcttacccctgagtatctgtttaacatcatgcaacagactcattgcgcatactcgggtgaaaagtttggaaccgtcaaaggaaaccatcctgacagcatgacgcttgaacgctggaataatgacttgggatatgtaatggggaatgttattcctgtcaagcaaaagtataatactttgcgtggaaataatacgattgaaggccttgagcgaaaagcgaatgaaatcgcagcacgcatagttcgttcttcagattctgttaagccaacaagtgataaagaagcttctcgtttggaaaagattcgtgagtatgaaaaaactataacatcaattaaaactaacttacacaatcgtgaaaatcatctttctcaatttgtgcaaaaagaaaagaatggaactgcaacctcggctgatttagaacttattaatgcattgagaactcgtatcagcggtggtaagtctgaattagctaaagttgagcgtaagttatctgctattttagcgtcagttccgaatcgtccgtcagatgctgaaatccgtgtacaatcaatacggttaattgttagctcacttcgtcggttagaagaatgctcaatgttagataagttaaaattgaaaaaaggtcttccattgactgcttccttcttccaacttttgagaggtaaaatgtaatgcaacactatggatatgtagtagcgtataaggataaagacggatttgaccatccagtcacaactgatatgtatgatggagaacgatgtgtagtcttcactaatgaagaatcagccaataaagcacggattcgtacaatgtcggttttaacagacaaattggcaaaggggaattttactgggaaaagcaaaaccaaagggatgctttggtggaaaacaactgagctagtgtatgaaccacttagcgatgttgagcgtgaaaaactcaaagcaaaaattaaaaatctacatgtagtgagggtaaaagtggcatgattacgtttgaccaattaaaagaaagtcaaaaagcgatttttaataaagtcattgaaatggtcaaacaaggagctaaaggtcaacatattacgattaatggacccgccggtacaggtaaaacaactttaaccaaatttatcattgacgctttgatttctcagggtatctctggaattgcattggcagcacctacgcatggggccaaaaaggttttatctaagctcagcggaatgcaagccagtactattcatagtcttctgaaaattaacccgacgacatatgaagaaaacgttctgtttgagcaaaagaaagttccggatatggcatctattcgagttcttatctgtgatgaagcttcaatgtatgaccgtaagctgtttaagattttgatggcaactattcctgcctggtgtattgtcattgccattggtgataaggctcaaatacgtccggtagaacctggaagtaatgaacctgcactgagtccattcttcactcataaagatttcttacaacttcatttgaccgaggtgatgcggagtaatgctccaatcattgaagttgctactgaaatcagaaacggtgggtggattcgtgactgtgtagttgatggtcatggcgtccgtggttttactaaaggaaccgcccttaaagattttatgctaaattattttaatttagttaaaacaccagaagatttatttgaaaacagaatgcttgcattcactaataaatctgtggataaattgaacgaaataatcagacgcagaatctatgaaactgaacgaccattcgtagtaggtgagattgttgttatgcaagaacctcttaccaaggaacttaaatttgaagggaagaaattcagcgaaattcttttcaataatggtcagtttgttcgcatattagatgcaattgaaaccacgtcatttttaggtgccagaggtgttccaggtgaatatctggttcgtcattgggtattagatattgaaacctatggcgacgatgaagagtacgctagagagaaaatctgtgtcatctcatccgaagaagaaatgaataagtttcaattcttcttggcaaaaacagcggatacatataagaactggaataaaggcggtaaagcaccttggtctgaattctgggatgctaagcgcaagtttcataaagtgaaagcattaccagcttcgactttccataaggcccagggcatctcaattgacagaagcttcatttatactccatgcattcacatggcagatgcttctctcgcgcaacagttattatatgttggtactactcgtggtcgctatgatgtattctatgtgtgaggtaatatgtttgaattgaaattagaagaccttcaaacaatgattgttggcttacaagaatctaagtttgaagcaccagataatgttaagcgtgctattaacattaaaattgatatagttctgaatgagcttcgtgatatagcagataatgctaatgctattacttggttcacaggatatgacccaaaggtgtatctgagcgaatatattggttgccagttacgcgaaattaaatttatgctagaggctcaaaatggctaaagactttattattgattttgaaacattcggaaatgtgtcaagctcttctgtgattgaccttgctctaatcacatttgattctgaccccgaagttttggaaagcttcgatgaattggttaaacgtggtcatcgtattaagtttgaccttaaatcccagaaaggtcatcggttgtttggtaagtctactcttgagtggtggaagaaacaatcagctgaggcccgtgctaacctggcctcaacgccagacgatttatcagtaattgctggaattaaagaagctcagcaatatctgattgataatggaattcacccatgggattcctttggctggtgtcgtggacagagctttgactttccaatttttgttgattgtcttcgcgatgttcaacgagcccaaggaatttccgaagaagaaattgatacatttaaagaagaaccatgtaagttctggaatcagcgtgatattcgtaccgcgattgaatcactgcttcttacccgcgggctgacaactacccctcttccaaagggtactctcaacgggtttattgcgcatgatagtatccatgactgtgctaaagatattctaatgcttaaatatgctcaacgctatgctctaggcctaagcgaagcaccaagtccagaagataccgatccactgagtttacctaaggggcgtggctaatggaagagtttgagttcgatgaaaactttgaagagtggttcaaccgggaaatcctcccgaaaatctctccaacgatggttctggtggccaaggctttgatggctaaaggctgggacgcagggtatatgttcggcgtcgatgttgggtgtgaaatttctcaccgatagctatttactttatgaaagagccgttatataatggctctacattaacaaactgagagaaacatgatgaaaaatttggttgtaggcgaaaacgttaaagtaattggtggtaagcatatcggtaaagaaggcgtaattgttggaatctttaaccgttctaacaaaatgtcttcatatttgcttcaattggaaaatgaagacaaagccgtgtattcgctgcaaaaattcgtagttgctctagaatcgcgcgatttgcttgattctatgtttaacgaaagctatctgcgcaagtgggtacatgtgaattcacttgacaatgttattacccaatcggtgagttctactaattcagccactaatctgtcgctgcataaaaatgttcttgtcactgatgagtgggaagaagacggtaaaaccctagtaaacgtagtgtttcaaggcaactatgcagttctgcctaaagccgatgtagagccgacagaatcgcaacgtcaaggtttagtataaaaagttgtttactttgccacaaggatgtggtactattatcttatcaactactgaggagaataacatgaaaactgaaaacaccgtaaaaattactgccgaagcttttgaagacattctgttcaacccggacttaatcgtcgttcagaaagagaaaaccttcggtaaagaagagcattggacctggttgtatgtattcgcgaaccatggtgatatcgtcccagttcgtacctttgctcgtgtaattacagttgatggcccagaatacatggagattgtgtaatgaattttaaagaaggcgtacagtacaaattcgtcaatgatgaagcggaagaagaattttcttcacgttatgaggttaatgaagactttgtgtatgaactctatgaaaatggcgggagttttactgttactaaagttgaccgccaaaataatagagtatcaggaattatgtgggctaatggcacagaatgtgatgaagtcggcggtgaagaccttgtaatttttgatagcgaattcaaatactttactgaagttggaacttccgcgaatgtaattccaaccgatttggttatgaatctttctattcataaccgtggtcaagcaatcgctgctattgcagcactgcagagtgcatatcaatgttaaatttagctcctatttttgaagcatcaaaactgtcttatcctattcctaaccgtagcattgggaatgtcatgctgcaactttcttcagaaactggagaaatgtgtgattggattaatcgtccatggcggcagaaagaagagtttgaaggtgagtgcgcagatgttattaactgtgtagtagatgcactttggctgcatttcagaaatcgtcataaaaatgatacccatgtatcagatgatgaaatctccatgatggttactcgtgcactaaatgagcaaatcatggtcaaaacacaaaaatggaaggatgctgttaatgccaatgtatgattacaagtgtgaagtctgtggaaaaaagatagaaattatgcgtaaaatttcccatcgtgactatactgttaactgctttaaccctaagtgtgaaggtcaaatgaagcgggtggtttctgctccggcagttcactacgatggattaaagagtggtgattattgatgggaactaaagcacgcattaccatgaaacccggagaaatccgggttattaaagtaggtaatataacttatagggttaaattgaaatgaaaaagattttaattacagcgcttgccttcatgatgattggatgcactgacgctgataacgcaactcgagtattagaaaatgcaggattcactgaagttgatatcactggatacaaatttttctcatgttcagaagatgattttcagcataccgggttcaaagcggtcggtcctaccggaaagacggttaaaggtacagtgtgttctgggattttcttgaagaatagtactattcgttttgaataaaaaggaccttcgggtcctttagttgtttacacgaatagtcttctgcggtattatagacttataaactactggagaataaaacatgaaatacatcatcttaactttaatcgcattagttatctcaattggagttctggtttccttagcagattctacggaatcttctaatgaagttcagaaaagctcaattggtattggtgtgaatggacaagttggtgttaagatttcagataatctttgtgttaatccttctactggtgctgctgaagtatgcttttaaaatgtattgatataatgcctccactaactgaggaaatgtaatgattaagaacgaaattaaaattctgagtgaccgagaacatatcattaagcgcagcggaatgtacatcggtagttctgcgtgtgaggcacatgaccgttttctttttggtaaattccaatcagtaaagtatgttcctggtattattaagcttattgatgaaatcattgataactctgttgatgaagcaattcgtacaaattttaaacatgccaataaaatttccgttgatatcaagggaaataagattatcgtaactgataatggtcgtggtcttccacaggctccggtagtaactcctgaaggagaaactattccaggcccagtcgccgcatggactcgtcctcgtgcgggtggtaactttggcgatgatgctgagcgtaaaactggtggtatgaacggtgtcggttctgcattaactaacatcttttcagtatctttcactggtgcaacatgtgatggtaaaaatgaaatcattgtccgttgttctaatggctcagaaaatatctcctgggaagaacatccagcaaaagacaaagaattcatcaaagataagactggtactgtagtatcattcattccagatttcagtcactttgaaagcacaggattgactgatgttgaccaatcaatcattcacgatcgtctgatgacattagcagtagtttatcctgatattgaattcaaattcatgggtaaacgtgttcaaggtaagtttaaagcttacgcccagatgtatgatgaaaatgcggtagtgcaggattctgatacttgtgctattgctattggtcgctcagatgatgggttccgccagctttcatatgttaataacattcacaccaaaaatggtggtactcacgttgacctagttcttgatgaactgagcaatgaacttattccagcattaaaacgcaagtacaaactagaagttaataaagcacgaattaaagagtgtctgactgtcattatgtttattcgtgacatgtctaacatgcgatttgattctcagactaaagagcgtttgacttctccttggggcgaaattcgtagtcatattgatattgattacaagaaacttgctaacgctattatgaaatctgaagatattcatatgccgattattgaggcgatgttagctcgtaaacttgctgcagagaaagctgcagaaactaaagccgccaagaaagcgcagaaagctaaagtagctaagcacatcaaagccaacaaatatggtaaagatgctgacaccactttattcttgaccgaaggtgattctgcgattggttatctactcacaactcgcgaccgtgaacttcatggtggatatcctctacgtggtaagttcatgaatacatggggaatgtctgctgcagatgctatgaagaacaaggaagtatttgacatttgtgcaatcaccggtttgacgattggtgagcctgctgaaaatactaactaccgaaatattgctatcatgaccgatgcggatgttgatggtgttggttcaattttcccaagtcttttagcgtttttcagtaattggcctgaactgtttgaacaaggtagaatccgctttgtgaaaactccggttattattctcaccaaaggtaaagaacaacgttggttctattctcttggcgaatatgaagaccataaagatgatttcaaaggttggaaacttcgttatattaaaggtcttggttctcttgaagaagatgaatatgaacgtgttattcaagacccggtttatgatgtagtatctcttcctgaaaactggaaagaactgtttgaattaattatgggtaatgatgctgctccacgtaagacctggatgagtgaataaatagtacgggtaatattgccctgctatagaaggaattactatgcaacgttattggattactttggtctcaggcgattacggatacatgtttgccgaaaagaaacctctccctggtacttgggttactatctgggtggaaaactcggatggttctaaacatgaggtgtatggccgcgttagcagagtgcattaatcccgaggggcttcggcccctcttttctgaggaaattattatgaagtcaactatcatttcaatactccgcactgaggcactaaaatactcagtcgacccctccaatgaataccaagaacttttaatcaaacggttattaaattctatagctgaccgtttggaaagtaaccagagtgtccctattaatcacagcctttttgctatgaaagtgatacgctttttacgtcctgatattaaaattgctgacatggtcaaagtgattaaatcgtcaggagcagtaaaatgctaaagaaaagttatgttccaaataaagaattatttgatgatgctatatatcgagagtatcgtatcatccaacgtttctttgatatccaagcagcagaggaattcaaagaccgctttaaacaaatcagtgataaaatttttacaactaacaccgctactgctgaagagctccttgaagtagcagaaatcattaaacgacacaattgataggaataaaatgaaaattaaatgtgatgatgaagtaattattggttcttctgacgctgaggattcaacgtttaccattaaagcttcaggtaaagcttttgacatcttgtcaaacaaactctataagtataaagttcgtgcggttgttcgtgaactttctactaactgtgatgatgctcataaactgaacggtaatgaaaatcgtccattttacatcaaagcaccaactcgtcttgacccgcgctttgtaattcgtgattatggtccaggtcttaatcataatgacatgatgacgatgtacaaaacgttctttgaatctacaaagaataatagtaatgatttcatcggtgctcttggtcttggttctaaatcgcctttaagctatacaagtacatttaacgtagtatcatatcataatggtaaagccaccggttatactgtcatgaaaaaccgcggtgaacctactattcgtccgatgtttgtcgatgatatgaaagaagacgaagaaactggtcttgaaattacagttccggttaaagtagaagatattgatacctggcactatgaaatcgcatatattttgcgtacatttggtgctgtacctccaaaggtagattctcttcgccgtgaaattgaatatttcccagtagataaaactgattggtttagcgttaatagctcttacgaaagttatggcctgtatgcagtttatggaaaaatcgtatatcctatcagcggtgtagatgttaaggcagattggctgcttaatcgctatggtaaggtttatgttcatttcccactgggtgaattggatatcactccatctcgtgaagagctttctcttgacgaagaaacaattgctaatatccagaagcgtgtgaatgctcttgaagaagaggtaattaccgcagatattaaagcgtttgaagcgtatgaatctgaccgtgaattcctgcgtgagttcaataagctgagttctaaggaacgctctattcttcagagccgcggtattaccattgggaaccgcgatattaaacaagtagttgcgaagtataatcttgataaaattcgttcatactatgtagataacgaagtatcagtttatgtttcatgcgatgaacctgctcgtcgtaaagtgtcaagcagttcttggcatcgtcataaccaagtaaacatttctgatatttgcggggttgatagaactaaagcgtttgttcttattgacgataaagcgggtaagcgtattgctacggttcgtgctctgtgtaaatctgggttagttccaatctgggcacacattactgtaatcaaagacaatgaagatgaattacatgtcattgatgagctgaagaaaatcatggatactgatgaagttgtagtattccgtgtgtctgaacttgaagcccagagaaaagctcttcctgattacgacactggtccaaaagagaaacgtcctaaatcaccaaatgtttctctgcattggattgataaagacgggtactgggaagaagaccgtcagactttattatcatctgaaattactgagcttgaaggttatgctatcggtcgcaatcgtgatgaaatccacactttcccagataatgtttggtggtggaatatgagcatcacagatatgcgttctttggcagaagcatgtggaattaagaaattctatgcaattcgtccgagtgctatgaaagccgcggccaaagctgatggattgctttcatttgaccggtttattattgaccaatacatcaagtgtattgataaggtagactacgaccagtacatgccatcaaatgctactggaaaccgtatctgtggaaatattgcgcattacgataaattgaatttcttgtcgagtaagtttactgcgtctggaatgaaaaatccgttcctgacaaaactaaacaaaatcgctaaagtttgtcgtacaagtaaaatcaaagatgaaaatgatgaaaacaatgatttagctttatgtaataaaatttataataaactgtctagtgatgctgagacaatcttctataaaaagattgaacagtttaaagatgattatcctgtcatcgcaagtgtcttggatacttggcggactgacagcaaactcgtcgatgatatcgtaaaaatcatggagctccttgatggagcttctactcaaaattctgaaaataaaggtgaataaatggctgttacctgtctgtctgaaatccaaaaagatgcaatcgttaaaaacttcaaaaacggtctgtacactaagaaagagctcgccgagaattatggtgtttcccgtgacactattcggcgtgtttttaaagagcgtgaagctcgagctgccgcggcagctgttcctgctaaagtagaagctccagttgagcgtgaatttaaatgggcagcaagttccaaattcatttcaattactgaaggccgtactacttataacgctgatagccaacatcccgggtttaaatctgcactgcagaaacttgtagatggtgatatcgctggtgctattgaccacattaacctggaacaaggcatcaagaaattcgttcagggtaacgtccgaattgaagatggtactttgttctataaagatatcgagctgaaatctggtctgactgagcgtatcgttcgagctatggaagatggcgaagactttaaacgttatctgcctttcctggaaaacctgatgctgaacccgtctcgtcgtgcagtttatcgtctgtttgatttcctgaacgcaaacgatatcgacatcactgatgatggccacttcattggttggaaagtagttcgttccaattacttcgattgtgcttcaaacacatttgataactctccgggtaaaactgttacgatgccgcgtaaccaggtagatgaagatgatcagcgtacttgttccacaggtctgcatgtctgctctaaatcttacatcggtcacttcggtagtggttccgatcgtatcgtttcagttaaagttcatccgcgtgatgtagtatctatcccggttgattacaacgatgctaaaatgcgtacatgtggttatgtagtacttgaagatgtaaccgatcgttggggttcagaacttcgctaattataaggagccttcgggctcctcttttattatgggtgaaacatgattaatccatttaacgtatctcattctaaagttgttaatcttcgtggtactcatcatgctgctacggtattttgccatcatgtagttaaacatgaaggtgatgttcactatgcttggttgcactgtgatgaactcgtagaacttggtgatgattttgttgtggaaccagacacatgtaaccacgacgatcgtgtttattttggtgaattacatatcagaggaatttatggcattgatgaacaaagccctgcagagattgaaccaactccggacatttaccctagatttgaataagctaaggggtgaagcaaaagtaaaaatcattgatactgccagatatagcttagatatcgatccatctcaagatagaattgacgttcttaaacgatgcagaattgctataccggcagagtatgtggtagcggattttcttgatggatacgtgaacgatcaagttgttgaccataataacaacgacccatatgaatgggcctgggacgtattagctcatccacactaccaaggtgttagggttgaagttaaaacacactttgttcatgaccgagcaaatcataagccatggattaatgttacaactggtaaagacggtccattcccagatggaagtggaataaatctagggcccatgtttaaacataaagtcgcagactgtataattatattcgttgcagaagaagtgtcccagaatgtcatacggtacacaccaatgtttgccggcggtatcgaacagctcatggaagtagtaaaaccttcacgtgttggagctggcgggtatatcatgcacaaattttaaaaagttgtttacttccgggattggccatgatactatggccctacaaactgaacgggagtaaaacatgagttacttagagctaaaatcacttcgagccaaacgcggaaatgcttctattaaagctgagcttttgaaagagtatagaattctcgaatctatgaattggcattatgctatcattgcttgtgataatggcgattcaacttacggtggattgtatcccaatggagccgctgctgcccgtgatgagcataaagataaagttaaagccttagaagaaaaaattcgtaacttgtgcatttaacggtttactttcctgttcttcggtgatactataatcttgttagctaaactggagaacaaaaatgaaaaagttacttacgattttgaagaacacctttgtagtattctgccttatcgttactttcattggtgttttcgcatgggatttagttaacgtttggattaatgctttcatctgaggaaaatataatgattcgtagtagttttgatcgtcgctttaacttaatgagaactgttgttctgtcctttatcgttgcggtagcgcttggaattgttgctatattcgggttcggaatttattttgctattcaagcggtagatattattcagaccgatggccttaaatctttagtagaaaccgtatgggaaggtcaaaaatgaaacgacacatcgtgtatcgtctgttggcttcgggtcttcttgcattttgggttggtatcgtgacagtggtagtagtattttggtaataagaggggcttcggccccttatcggagaataaactttaatcaactgaggaaattaacatgcgtaatattatgacttttgctgatctcgataacgctggtgcagaactgatcggttctattcgtaacggtgattgggcagcaggtgctccatctcgtgaaattactgagcgtgaaggattttatttcctgatgttcaatgatggcaaagcaggttatatcggtgcatctgctcgtttctttgtagctaaacaacgttcaaaggcaggatttgagagtgttctttctcatatccgttctggacgttctcagttgggtcgtacccttcgttcaaactgtgtaacatacggtgtgttctggattcctgccaataaaatgaaaccgctcaccaccggttatggcaaaggtcaacttgcactggcgtttactcgtcagcattcaagcgccgcgcagacctactctgaactgaatcgtattctgaatgataacttcatctttactttgcagaaatactaatgagaaccttcttcgtgatgggctatgtgtttctgatggccctaatgatttgctcaggaacattcatgtggtatggccttgtgcctaccactaaagtaatcggaagcattgcgttcactgcagcatttattatgtttgagcgcatttgtaaaattgtaggagtttacaaatgattaaaggaattgctggcggaatttgggctgctctatgcgtatcgacattgactaccggtgaaacttctgttatttcgcaggcgttagcgcaaggaactttatcaattattcttattatagcagccttttccaatgattaagaaaattttgattggagcggctttagtagccgctttgcttttaattttgtactatggaatgatttacgggatgatttatattgtgcttttcatttccgatgttatagtacaaatcggctcactaatttggtaggtacaatggatatttttgacactctattaaaacaagcaggttctatcgatgatttggctaaggcatcaaatcttcgtcatcgcgatttgaaatctatcattgataatgaagcaaaagagtatgcgatttacactgtagaaaaccgtgctattccgaacttgattgatgggtttaaacctgtacagcgttttgttattgctcgggctcttgatttagctcgtggtaataaagaaaaattccataagcttgcgtctgtcgccggtggtgtagctgatttaggatatcatcatggcgaaacctctgctcaagatgctggtgcattgatggcaaacacatggaataacaactatcctctgttagatggacaaggtaacttcggttcgcgtctggttcaatctgctgcggcaagtcgttatattttctgccggatttctgacaacttccgtaaaatctacaaagacacagaaatcgctccggtgcataaagacaaagaacatgttccacctgcgtattatcttccggtaattccgactgttcttctgaatggcgttcgcggtattgcaacaggttattcaacttctattcttccgcatagttttgaatctgttttggaatgcactaaagcagcacttcgtggcgaaatgatggaacctgaagtacagtttcctaaatttaacggaaaaatcgttcaaacagaagacggttctgttgagctgcacggcgtgtataaagaaacttcacggaactcaatctatatcagtgaaattccatacaagtttgaacgagcttcttacgttgaaaaagtacttgacccgttggaagatgcaggatatatcacatatgatgatgactgttctaagactggctttggctttaaggttaaattccgtaaagactatgctttaagcgaagaccctgagcagcgtcatgctaaaatcatgaaggattttaaactcattgagaaaatgagtcaatacattgtggtcatcgatgagaatggtaagctgaacgacaagttcaaaacttccggtgagctgattcgtcattttgtagaagtccgtaagacattcactgccaaacgaatcgagcataaaatcgctgaaactaagcaggcgtttaatcttgctcaggcaaaagctcaatttatcaaagaggttatcgcaggtaacatcgttatccaaggtaaaactcgcaagcaactgactaaagaaattgaacaaaatgaactattcaaagaccattctgaaaaactcgtttcaatgaacatctatcacatcactgatgatgaagcgaagaaacttgctcaggaagcaaaacgcctagcacaagaggttaagtactgggaaaagacaactcctgaagccgagtatctgaaagacctggaagaactatgatagaattttatttaattataggttctgtaattgccgtattaggtttagttttattgctcctcagttaatctagggaacctggaggtcatctccaggtccttccatataaatctatatccctccaaaatccttccttagaatgccccaaattattttcacaaagttgtttacatgcttactcggttgtggtattatagcaatatcaaaacaacacggagtaaaacaaaatgattacatcattaaaatctgatatcaaaaacattctttatatttccactcaagccgatggcactcgactgagccactatgtcaaaggtaacattgtggtgctcgatgagttcgaagttaatcgcgagtatcctatgcgtcaggtaattcaagcaagtaactatgaagacggtgaagagtatcaagtcgttctttgtgtatatgatgatttctgggtgcttaaacttgagaatggcgataagttcttgatctttaacgtataacatttttactgctctttgaagaaaatttttcagagagcagaataaaatggtttacaactgctttaaaccatggtattatagtctcataccaaacaaactgaataaaacatcatggagaatcacaatgtctaaagtaacttacatcatcaaagcttccgaagatgctctgaacgaaaaaactgctgctatcctggttcaggtagctaaaaaggatttcatcacttcttctgaactgcgtgaaatccttgaagaaaccatgaacgcaagttctgttaactcaaacatcggcgttctgattaagaaaggtctcatcgagaaatctggtgacggtttaatcatcactggtgaagcacaggacatcatctctaaagcggcagttatctatgcagaagagaacaagcctgaacttcttaagaaacgcaatactcgtaaagctcgtcctctgactgaagatatgaatgagcacaaagacctgatgatgaaacttctcggtgagatggaagatatcttgcctttgaaagaactgactgtttaccgcagtaactatatcgcagttctggaaaaacgtaccttcggtattcgtagtcttgaagttaacaacaaaggtactttccgcatcttcggttacaagatttctgaagagcatcagaaacacttcactgacctcggaatgtcttgccgtgtagctgcaacaggcaatacttacttagatatcgcccgtactgctgaaaacattgaaaccatcatccgctctattaaggaactgtaatggaactttgggaaattatatatgaagatgatgtgaatatcagaggcagcatcttcattaaggccctggacaaatatcacgcgattgaattgtttgaacagttacagcaacaaacttatatcaatgaatcgcgttatttaattaaactcgcaatgtttttggtggaataatgaacaagtttaaagtattgaatgagcttcagcgttgtgttgaaaaggttaacttgaatgctaatatcccaactgattgttgggatgtatggttccgtggacactttatcggatacattgataagaaattcacaaaatgctatgctatctacaatgcagatggtaaacatatcatggatgtagataattaccaaaaggcccttgctaaatttgttccattagcggaagctgttaactcaatggaatggttagagaaaatacagggtgaacctgttattcgccagattggtattcgtgaaaagaaaagtttgtggcagaaaattaaaggattctttaaatgagcaagttttccgaacaaatgaataaatttgttgatgcttctcgtcacggtgctctaattaatgaaccagaagaagttagtattcctgaaatttgctttaaagtagctgattggtgggatggacgattacttcaacgccgtatcgtttgtgcagcaaatcgttttgaattgaaatctggtggaacaattgtggttccaggcactcgccattattctgttgatatggcgaacgttctagatatgttccgtgacaaactggtttctgaccatgtccatggagacaatcaaggatttgtcgaccagtggggtgagtacttcacacgtgaagaagcattaatcatcgctacacatgcaggtcaagttaatacagttcgtcctaaatcaggacccgccaatgaattattctcagaggatttatactaatgattagtacattaaagaataacattacgcttttaaaaattcaacgtaaatcgcttcagcgctcattagaaatgatggacgataattggggtacatataccaatgaagccgggtttaaaatggcagatagcaaattcatgaaaactctcatggataaggaatacatctgcccgtttagccatccatttaatggcggtgctaagccatttcttgctgaaatgtacaaaataatgacagaagaaatgattaaagatattgactattacatcaaggaacttgaatgcaaggaagataaagtgtgagagcaataagcgccaaggcagattacttcaatagcttaaatcgttcagaaaaggctcaaattaaacggtttatcttggaattgggatatgtgcatgccggagatttaaaagcacatatccaagaatgtggtattgctaagcgttttgatattacacgcaactgcttaaatgaggtaattgcacatgtacaacccagtagcgaagaatgactttaacaaaggaggcgcgcataaagataaaaagcgtgctgctaaagaatcaaaacgtaagcaaaaacataaaggtaaagacaatgcgcattctgaataattctaaatgtactactttaaccattatttgtgatgacctagaagctctccataaaaaattaggggaccattctggattagtagcagatatccattctgaactaatggaagacctccagaatgctggatatggggactggatggtacatgattggaataatggtacctttactgtagctattattgctaacgttgaacctgaagaagttcttgaacaatttcagaaatgcgttgatgcttatgatattggagattatctatgaatactgaaactttacgcagagaagatgaagccaaggcatatcataaacgtgttgaattactttcagcaattaaagtagaatacactttacaagttaggcttaaagttcttaactcttgggctaatgacttagaagtaaaacatttagaacaagcagtaatgtttacgtttactcaggaagcttctaaaccgtttagtctatcagcagatttccacacgtatggaattattactattaaagcaaaggatagaggtgacattataagtggagttgagtatattgaaagcattttaggtaatcgcggagaggttgttttagcatgagtcataacttagaatctgtcattgaatcacaaagatatctcgaagcgttaatgaataaaatcgcgcttggaagtctaatcgacttgtcctttcaggaggcaatggacgtatgtcactggatgaatcgtagggttcgtccaattggaaaggaatggtatttaacggctaaagtaaaagatggtcgctacgggctctggatgtcctctggtgctgagtatatcactaccaaggaagatttgaattctcgttgggaattggcataaactggtttacaacgtggtatcaagatgatactataatcacataatccattatgttgtaggaaaaataatgactaagtttgaaattgtccaagaaattgttaccgttgcttctattctgactaagttcaatgctgaacatatcatggagaagcgagatgaatttattgcgttcttgaacgaaattggaatcaagaacgagcaggggcgtcagttaaatcagagcaacttccgtaaaatggtttctgagttaactgacgaagagaagagaattctcgttgaagaatacaacgagggatttgagtctatctatcgaacaatggctatgcatagtaataagtaatcacttagctcttcctagagctctaaccgcctgaccacatatcgatgttagtctttcgttagataatgcaggtttggaattgtaccagtacatttcaacagttccagcataaacattgtctaaattgaaatacggacagctaaacatgtacgatatttcaggtggttttctttttgtcggtaagaaaacaaattccttatccgtccaaaaatatctacccgataaatgcgtgctatattcagcagacgttttgtcgattggatatcctcccaggtttttagaatctaccgtgctaggtaaagtcccctcataagcaattaagtctacgaagtagttcaagtttttaggtctgaacgtaaagaccgcagaaaaatctgcaccacttgagatatgtactatctggagttgttcgagtgctgtattatcaaatcgggtatccctatccttttgaaccagtttatcatacttgtcatatgtactatcgacgtaagcagtaataagactatctgacttataaccagcaaacgccaacaatgctaaaagtatgacaacaaaaacacgggaaaagagaactcttcccgtggctccatctttgaataatagctcgagcaacccaagaaacatatcaaaaaatggtattgattgtttgcttgccatattgctctccttacagagctatttattgctatcttctagttataagaccttgccagtattggtcagttctgtcactaaaccagtttttaagcttattagcttcgtcatttgaagctatttgatagtttcttacatctccatccattttacctggagtaaaatcaaaggtagtgccatctgacatcattacccgaagatttattgcgtcgccatttcttattcccaaggttgtaccttgagggtcaccgttccaatagttaaccccaccttgtccagatacagacacaaataaagtaacctctttaccttcgaagttaccttgtactgtatttttggttgtcggtttagggctccagttccagccaccaacttgccatgaacctctatagtaaatattgttccagttacgatattgcactgttaaactaaagttaaaaacacttcgtcctatcatattagacatccagaaaggtgttcctagtcttaatttggctccggcttgggccatccacggctcgccggtttcagccttcgcggaacttccaacccatggtcctgttactgccatgatatctccttaaagatggggccgaagccccatgcattatttagatttaagttcttcaatttccgctttaaggcctttaacctcagcagaaagctctttaacagattcaacaagaagtgcaattactgagttgtaattcagacgcaataatccgccgtccgcttcaatatcttgagtaactgcttccggaagaacttcttgaacttcttgagcaatcaacccagcagaacgagtagtaccgccagaagtattatgaagctcataagtattaccgcttaaggtctctactttttccaaagcgttttcaataactttaatatcagatttagctctacggtcagaacgaatctcaacgttatcaaatgaaccattgcgagtacagatgaagtcaccgccagctctgaaatagaaactgtcatctcgaccgaatccattaacattaatgatagcttggtggaagttaccaacatattcttggaaatacagagaggcataagcaccattactaaatctgcttactaacccagcggtattgttatatgtgccattgggttgtcctgcaggataattagtagtgctgctaattccgttatagttagaaatggctcctgggaattgacatgaaccacttgcccagaaattccatactggtccagaagcaccgccggctcttatactaacattaccaggctcatcagcccaaagaagacctttttctgtaccatctgctttacggaagaacacatggctattaccggtgttctgaacgttaacagaagtggatacactgaactcttgattaaacctagcctttccatcaacagttaaaaccccattaacggcagcatctccggtagtccatagagaagtagttttcagttgattacctgtaactattaatgtaccagttacagtaccacctgctaatggaagataagtatcgccagcattactaatagcagaagcaaccttatcatcaacatatttcttgttggttaggtgcgagttatcagtaggagcttgacctgcaataacaaacttaccagaagcgacgttgatgtttccatcagcattaatcacaccgctgaagcgggaattgcctttaactatcaagtctgagttcaagttagtattacttgttactgtaagctgcctgttaatttgggcatttccgtaaacagtttggtttccgctagcatcaactttgaatatatcgctaaacgtgtcagcaggattaatttggttgttggtatttgcagataccataacggtaaatgagttagatttaccgatggccatttttcctggcataccgtttttcttgactaaaccaatatcagagtttttgccaagaacgatcattctgttatcttcagaaacgttcaagttgcctgtgattttcgagttctgggcctcgaactcaccaccgacagtcattttacctttttggtcaataactgtagcttggttggaatcatcgccgttaggtcttaaatgaagagcttgacctgtttttgcgtagataacaaaagcaccagagtcgtttgaacgaatacccgggccataggaccactcaagcagaggctcagaaccgttagctttaactctaatctcagacccagaagaatcaccgaatggtctaaaagcaatatatttcgctgatgctgcggctgtagcagaagctgacatgatcaatgcaccagtactaccaccttgggcttcacgaactactgcgccatttttaaatgtgatagttggatcacttgttccgacgccattaacaactaaccagccgaacttcacactctgtccttcaccaacaccgaggttattacgagcagcagccacagaagttgctccggtaccgcccaagttgattggttgaacccctgcaacaacctctttccatgcagaccatgtgccgttttggcagtatctaacatatgtgccttcaacattaccgttctttgtagtaaaggtctgcttacacgtccaatcactgtcagaaattttacgcaaagacagaacttcaagaacaaagttaccatcagatgtaggtttattagatatattagaaccaccaccagatgatacacatttatacagctgacgagtacctaaatcactgcctttaataaccatgttgttaaggtcattagtcttatcagtaatattaattgcatcttcagtaccgcgatatgtctgattaaaaaccaaatccccttctacatcaaggccatcaggcttaactcggatgtacttgctgggagctggagtagcaactgcatcttgataaccaaactgcacgtatccttcaggagtaattttaagcattgctacggcagcgccagagccaactttacgtgcaagggtcaatctgctatacttatctgagttctctgaacctaaatcaaccattgatccattagggttttcgacttttaagttagcgttaatagtcaagttaccggtcatggtatcaccagtcttgcttacttgcttactatcaccagtggtgatatcatttttaatagaagtcaaatagttgttaaggttaccgccaaacattgaaccagaggtaatattcccgtctttggttagcattgctgctccaccaactttaactgctacaggaacatcaaggcggccatcagaacggaagctaaaatcaccggcagaaacatcaccagtagtttttgcacgaatattaatctgacccaagtccgcggtattcggagttgcccaaattacaccacgctcattacctcctgttctaaaccatacatgagcgtttccgcttcctgcgttaacatatactgatgcagtaccagtgccggaagcatgtaaattaggaacagttaaatcaccagtcatggtatcgccggctttcttaacttgagtatcgtttgtcagattaccaagtccgacatcagccttagatggtttgtttgctgtgccgtagagaacattagaatttactcttccacttgctaaaccgctatcgtttatagcaaatactctgacgttgccagttgcataatctatattaagcgcagacattgtatcgccagttctagaaaagaatcctgcgccatgggagtaataaggagccccggtataaccactcgctacgttggctctaaatgttgtaccaccaagagccttaaggcgagtcattaaatcaacatcagaagtaatatctactagtgattttccgttaccgccaataccaaaggcaccaacttccatcacatttccgctggattcaccaacatcacgaacagccgcagttctaagacctaggttatttctagcatctcctacgttagtagcacctgtaccaccacggttaaccggaagagtaccggtagtatcgctgaaatctggttttgagatactatcaaaaacctgtttcattgaaacaagaatgcttccagatggtgtagtagcaccagtatcttggccagtttcatagataattactttaccgctatcttggccgttgtattcagcagtgtttagcactgtaacataaagtccatttccgtatcgaggaactttagcgtaaaaatcaaatgaagcctctgaatctgtagcagcatcatttttaacaacgtaatactctggaacgtttcctttattaggagaaccaatcctgcgccattcaacccagttatctaaattgctagtgctccaggatgttaaattgcgaccagataacgtgataaaatcaacataatgccttccgtgtccagaatcaatgccaccagtaatcattaaatctaactgcgaagatgcatctcctgggtgtttaattgtagctactttaacccagcgcggagttccagcggttgcagcagaaattacgtattgccatgcctgacggttgttttctacattcgtcagaagagtaccggatttaccaggacctcttccgttcatggcgtaataaacctgtgaatttctgaatgtcagattactgtcattggttaattgaagaacacctacgcctcgttggtttttaatgtaagcgtcgttagagcctacacccatttcaaggacaagtgtgcttccattgttaattttaacagttttattagtggataatcttaaatcaccaggaagagtggtattacccgagccgtcaagcaagaccagttttcgggcttcaacgttgccgcttccgcgttgtacgaattgaatagtttcagcgccatcgtcaatagtaccgatttcaagaataccgctattgcttgtaccacctgcaccgatgtaccagccatcgttagtagcgcatttgccgacgatatgacgcactattgctccgcttaaatcagtggcttcaaaattgatagctttattcggagaaatagtaacgttgtcttttaatgtagtaattccatcaacattaagattacctgcagtatctaagaaaggaacacctttacctgcaagctgaacaacgttatcggcttcatctttagtgtaaatggcaagagtacgcccgtgtgtattcaacacgatttcgccacgggctacgatatctgcacctggtgctttattctctgtgctagttcttttaaattgtatttgttttaagttttgatcggccatggctacctcttagtatgtgccaaaatctattgttaccccgcgtgaaataacctgatctaatctaggagcatattcaccggatgttgctttatttactataactacgccagcgttagctctaagtacaccggtcatggtgtcgccagctttcttgactgctgcgttagctacgttgctaacagtatttattagctcatcgacatagtctttgcgtgttaagtgtgaatttgctgttggagctgcagccgcaacagaaacttgattgttagaagtgattccacctttagtagtaatattaccagatcgtaaatcgaatgcgatagttattccgtttgaaccagaattagattcaaatcccaagccccaccaagtttttattttggcattgacaccatttaaagtggctccatcaactccgccatttacgagttccatgcccccggagccagtagtttgaactcttaaacctgtttcaaacgttactgttctagagtaacttccgccattagcttttgacacaaagtcgttatctgcggcttgtggtttatctatctcagtataaacctttttacctctataagttagggagtttcctgccggcacaagaggaaaagtacccgcgtgccaaataggatttccgccaactgttgaacctgcttttaaatcggccatagtttatcctcttatatattttctatttatacgaaaaaaggaagcccgaaggcttccttagtctgatgtttctctgaacgattgaactggaataacaccgctcggatcgacttttgaatttggaagttccataatcatagtagttcctccttcaacgcctttattcattcttataccattcacaccaaactcctgaataacactattcaattgttcgccatgagaagtttgaacaaatacgaggtttttgattttagagtcaccaactacagacgtttttggatatcgcgataccacgatagtaaatccatcagcgtctgtaggaacagcggtaaatctttcaaatcttaaccatctatcagctccattttttggaacttctaatgatacgtttgaagataataaagatgtacccttgaaccaccgcaagctagctctagtagtagaaccagcatcaagaaggcttttagatgcatacatatcacatactaaaaataccgaatccccaggagatagtccataatcagctattttgcttatagattcattttgtactggatatcgtttatattcatatccagtagaatccgagtattcattggtatcttcaatagaacgataaggacacccagtatatcctacatctcctacattgtcatataccgtatctactttagcccttgaatcttctttaacctttccgtcattcccataaaatgactcaattaatatacgtccttttgctgctccgagcactcctacataagcagagtttggaaatgatttggaaaaatcagaacctggccaagatgcagaccacttatttttaaaccatctgtctattaacgggctggattgaaatcgttcatgcgtcattataatatacaatcctgaagttaatccatttgcatattctacaaacgctttgttattagcgttgttgtcatcagtggtaacgtcaaacgttttaaagttaataaatctgtcaccattaacttgaacaacattaatccccctccgtaaggaggaggtcatatcaaaggcaccgttaatattcaattctggcttattcggaacagcattagaatgtgtagcataagcttttagccaatacttcacagagtttgcctcagagaggattcgtgtttccacgaaatcctcaccaaaggctgccattaaaattggatcagccattaatcacctacccattcaaatttgagagtttggtttggacggtctggccagattttaactggaccaagcttaatccattccaaaacttcaagggttttaacctgagttgatactgagcttggagctccgatatcagctgcagttggaggagtagcagacgtgaacactcgcatccaatcatcaaacttattaaggtttggattataaatcctcatccacacagtatgcgcgaaacgcttatcagcagtttcggttgttggaggataaggtgtccaaagctgataagtgttgtttgtagttacaccaacctgagttaaaacaccgccagcagcagttttttcttcatatccggtcactactaaagtgcttgggttagcagggtcaatcggtgttctgattggaaccatataaccacgaagacctttcaatttagtagcgtctttaatttcagcagtccaagaaccttgtcgcaatacagtatcattagtcggcacataccacgattcagaacctgtaatgacgatagccgaactatttatgttaagattgccggtcatggtatcaccagctttcttgacataacgaccatcagctaatcttgcgtagtttttggtagttaaaatcggatacgagttagtattatctcgagcaaaaatttgcgtatcagcgtcacgagtatcaataaacgcagagtgagacctagcaccaataatagcattttgggtttcaatagttaatagaaccgtatcttttaccataacagttccgccaactattgtatttccagaagacctcagagttttagttgatacttcattaggaacatccagcgtgccgtttccaccaaatgtgtaggtctggcttgcagcagtagttcctgttccgtttttgacacgaacttttaaatttccagctgaagctgtttgggtttctgcataaattataccgcgttcagttccatctctattttgaaaacgaacatgcgcatttccagtgtcagcagttggagaaatttttacttcgccaccattagcgtataaaatattctggacagaaatgttgttattaaacacagtatcctggctaaatgtccaagctccagaaattgtctgcgctatatcgcgacgagcatatttgtctggggtttgaccacctagcattccggtgtcatacgctttaccaagacgaggcaagtaatgtttcaacgtgaggttcaattcatacggagacactgcgacgcccttagaggcatacccgttatccggaagagttgagccattggtatcattacctttccacgttccatcgcctgtagatagcctgacggtccctctaacgctgtctgtagcttgccatgactctgttacctgaatagtttgtttcaagtaagcaggaggaacaattctatcacttaatgtgcctgcatcaacttgcgcctgtgtagcatactgagcaagaccgatagctccttcggttgctgttttcgcgtgcaacgtggcagcagtaactattttcttggcgtcggtgccggttctgacctcagcagcagttgcaagagtagttgtacctctttgagaagtacttgcttcctgtatgttgatggtataatggtcccagaggttcccagtaatagttaagccagaactagtattaacttggatacgactagtattagcaaatttatcgaacagtaatttagggtttaccattactgtacttgaagtaccagcttcaaattcaccctgggcaccaggtgtcgcgaagcgagcaataccagtacgatcgttagttgctgtacggtcatttaatgttttaggtgtaactgctttattagtcacgccaccagcattaacttctgtctgtgtagctatttggattaaaccaattgctccatcagtagcaacttttttatgcaaagattctggtgtaacaaccgtaggaatatttgaagaagcaggagttccgtttctaacttcgctatcacttgctaaccaaactattcctgactgatttacagtagctttatactcacgaagagtttttggagtaactgcatttttgtaatcagaatgatcgaatataccggtgccagcagaagaacgatcagcagttgtgttaggagcaccaccagtttttactaactgaataacacctaaccgtgaatccgacgtagtacgataaagcaacttcttaggagtaacaattgtaaaatcgtctgttcctgcatccattttagcattagacgcaatttcagctaaacctctacgagtttcagtagcagatctttcgttaagctttttaggagtaacgattacgttatccaagtaagaagcagttgttgcctgattaacttcgccggaagttgcaattcttgctataccagtctgagtttcagtagaacgacgtccatttaaagtttctggagtaattgctaattctttttctggatttgactccgcgttggcttgagcttgcgtagcaagagcaataacacctaatcgtgctctggtagtattgtctttagcatcaacacgttctacagtagggtcagattcagttacaatccaatagctttttccggatgctttatcttcaatatatgcaagctcaagaacaggaacatatgacgtagttccattaaaggtaatcgagcttgattgaacccatgctgcatcaggtggatactctgagcgttttggaaactgcagtaaattcaaattactagcgatggtatcaccatcagaagctttaattactactgtctgtcctttacgcatataattcattgcgattttgacagtatccccaacagctacgtcagtaggtaaagtaatgttaattgttttaactgtactattatctgcgccaaatacagaaatatgctcattaggcattaaagtaacgtcagaagtaattattcttacacgtgtacgtaaatcattttcaaagatgcgccatattttgtcaatagcgtcatacaccaaaaatccactacctgaagtacgtacttgaatttccgtttgtccaggagtcccaattgagatagttgggtcaaacgtacgcacagtcatatggttaatcggcgatgtaccatcaaggtcagtaaaattaatgatatcgtttgaattagcgaacaacggcagagtaataaaaatctctgagttggaagtataacgacgaactacgttatcacctgactgtacctgggttggaacaatcccgttcggaactaccattttagcagtatcgccaaaatcggttaaactagcacgccatgcaccattactaaacgtaagcataatttgtgaatacggacgagtaagtcttacctcacgcagacgcgattcaccaaatacgatagacgcaccagtatcttgtgctttaattaagattccgttatagccaggacgacctccaatatcacgaactacaatggtatcgccttcgtctggtgctaacggaagaagtagtgtagcattaccggcagcgttcgagtcaacgttgatgaactgaccagattgaatttcaaactctcctttacggacggtataaatccagttcgggtcaacacgtaaagaagtccaattggcctgattaaattctccggctggttttggaatatctttgtttgcaatccaaatgcgtcgtccataagtcacagcaaaatcggtgagatacccacgcgtcgggtcatatttttggatagtattttcttgaataacgtactcgacagagacgccgtcggttttaacgttgcggtcagcgagtgccacatttataactttatttccgccggcatccaaaccgttagttgcacggaaatgttgtttcagtaaatcgctcatagagtctcctatggggttatgcttcattatagaagtatttataatggctgtactaactaattgaacgaggttcaaatgtctgatttaaattgcttattcgccgaagaagaccaagtaaaagaaggtgtcattctgattgacttgtcgcaaatcgcaatggcgacaattcttcatacgtataaagaaggagataaactaaccactcctatggttcgtcatcttattctttctactttaaaatttaatgcttttaagtggaagaaagatgggtacactaaaattgtcatttgtgttgataacgcagttaatggatattggcgccgagatgtagcgtactactataaaaagaaccgtgctaaagcccgcgaagaatcaaattgggattgggaaggttactttgaaggtcttcgtactgtaattgatgaatttaagcagtatatgccttattacgtcattgatattgataaagcagaagctgatgatagtattgctgtactgaccaaaaagttcagtctcgaaggccatccagtcatgattgtttcttcggatggtgactttactcaattgcataagtatcctaatgttaagcaatggtcaccaatgcagaagaaattagtgaaatctaaaaccggctctcctgctttagattgcatggttaaaattattaagggtgataagaaagataacgtagcttctattaaagttcgttcagatttttggtacacccatgttgatggcgagcgtactccttcaacgaaaatgacgtttgttgaagagtgtcttgatgctggcgaaaacatcaaagatttgcttaccgaagaacagtataagcgtttcttagaaaaccgagtgttaatcgattttgattatatccgtgaagacattgttgctaacattttagattgttataataattatcaactaccgggtcgtggtaaaatttatagctactttgttaaatccggtctgtctaaattaatgaaagaaataaacaacttttaaggtgaatataatggctaagaaagaaaaagagcaagtagtatttgatgaagcagtacacggacaggctctgcgagatatgattaaggaagcctcaggtaataagctaaaagcagaaagctatcttgagcttaacaaagacattaaagaccgcgccaagaaagaacttggcgtagaaggcaaattatttaatcagctgcttgccctgttccataaaggtacacgcgatcgttttgaaactgaaaaagatgaagtggtagaagcttatgactctattttcgcttaaagatgagggggacacatccccctccgaatccattaaccagctgctagataagcaagctaatggatttgctatcgaatctatggtaacagaacttggaatggggtatctcgaggcaacgacacaatggctagaagaaaattctattcctgagggaaacttcagtagatatattccacctgcaatcatagaaaaaattatgtcagaagcattagaagaaaatatgcttcgaccatcatttagtcaaacacataaaacgaatagtctggattttttattatgattcgtctacgcatgccccaaaacaataatagatacgttaacggtaagagcgtttatcttttatatttaatgctcaaacaacactttgccggtcgttatgatgttgttaagtataattgggtcatgcgtgtctctgataaagcttatcaaaagcgcagagacaaatacttctttgagaaacttgccgagaagtatacgctaaaggaattgactctgatattcatgagcaatcttgtagctaatcaagatgcttggattggtgatatcagtgacgctgatgcgttgatattctatcgtgaatacatcggtaagttgaagcaaatcaaaactacattctctgaagatgtaaagaatatttactactttgctaagaaagttaatgtagataagcttcatgatatttttgaatataatgagaaagtcggaacatcttatgtgttcaaacttcttcagtcaaacgttatatctttcgagacattcatcatgcttgactcgtttttagatataataaatacacatgatactgcaacggataacttagtttggagtaattactccactaaattaaaagcttataaaaaacttttaaacgttgacggtgctgaagctaagaaactctttattagcataatcaaatcttgtaaagaaattagtatataattaatctatcgtccagttgcaaggacccatgttgcaacaacaactgttaaattaaaaaggtaatcatatgttcaagcgtaaaaatcctgctcaacttcaacaacaactggctggtctgaaaggtggttcttctttctctaatgaagataaaaacgaatggaaactgaagaccgataatgctggtaatggtcaagcagtaattcgcttcctgcctggtaaagatgaaaactctctaccgtttgtaaaactgatcaatcacggtttcaaacatgctggtaaatggtacatcgaaaattgtacttctacccacggtgattttgattcttgcccggtttgtgctcatctgagcaaaaacgattcttataacagcaacccagctgaatataaactgctgaaacgtaaaacttctttctggtctaacatcctggttattaaagacccggctaacccagaaaacgaaggtaaagtatttaaattccgtttcggtcagaaaattatggacaaaatcaacgcgatggttgaagtcgatgttgatatgggtgaaactccggttgatgtaacttgtgtgtatgaaggtgcaaacttcgtcatgaaagttaagaaagtcggtggtttccagaactatgatgaatgtaaattccttggtcagtccgagattgcaaacatcaatgatgaagaaactcagaaattcctgaccgaaaatatggctgacctcagcgaaattgtggctccatctcagtttaaatcgtttgaagttaacgaagctaaatttaaacagattatgggtacagcagctcttggtggtgccgcggcaaaagcagcagctcaagccgataaaattggtgatgacctggattcctttgacaaagacctgtctgattttgaatccaaaccgacctcttctcgttccgcagacgatatcatgggcgatgctggtgacagtgttggcgatgacgatctgaatgatattttgaacgacctctaatataaagggaccttcgggtccctttttctttatccctccaaaaatattttcacaaaattgtttacaagccagttgatgagtgatactatatctacatcgaaacaaaacgagtagaggaaaacatcatgggtaaattaaacattgatatcgtggcagaaccttacatcaataaatcaggattttgtactgatttaatttttgaagatggttcacgtttttatgacactgaccatggtattgattttgatttagttatcaaagaaggccctggtggtggttggccaaatattgacctccgcggttctaaagaagcagttcgtgcttggttagaagcaaacgagtgggaagatattgatttgatgatggaagactggaaagagtaattacctttggggacttcggtccccactttgaggaaatgataatggcacaggttactgtagaaatatatgattatgaacacttcattgaaaccattgaaaaatacggtttgattgaagttagtaacaagtctgccccatggggaggaaacgaaatcactgtagaaggtgatactcctaccctatggttatggcttgaacaagaatattttcctggcatggatgatgaatgccgtgaagatacattaacgacttttagcgggtaaattatgaaactgaacacagaatatcgcattatcccaagtcttgctgccgagtgggacctttcatctagcggaaatcgccggatgcgcttgatgattgaagaacatggtggttcgttctttcctactaaaatgctcgacgaagataatagtttcatcacagaagtaaaatttaaagatggaacaactgctgacgctgaaggatttggagatgcatactttgaaatatctgattatgaattcaaatacttcgaaccagtatatgaaattggtagtgcaatccaacctggtcctactcgcttggacttgatcgttaccccagaaaatgcagaagaaatgattgacttgatcaaaaaagttttcaaaaagtagtttacacggagctatgcttgtgatagtatagctccataatctactggagaataaaaatgaaacttcaacgtcaaagcattaaacttggttctgaatatcgtggtaaatggaatttctgcatttgcgataaaaacccagaagaattagagcgtgttgaagaagtactgtgccaaatggaagctccattcactatgggtggtgaaactgtctattggaatgattactgtgataactgcccatgctatgaagatgggtatggctcaggcttctggattccagttgaagatgttgaagaattcaaaaaagcatttaaacttgctaaggccaagaaatgattgaggctgaattagtagttttgttaatttctgttactgtcgcttttattagcggcgttatattaggattatttttatatgtctaaatttagtgtaacgggatatcctcgcgttaatattcgctgccagtttgatgaaattcctggagtaactcatattgagctcgtatttgaccctcattcgcgatgcaatcaggtttcaggtaaaattgattcagcgtatggcgaatttttaattaatgaccaagttgtggtttcagctatttctggtgaacaagcaggttcgttgtatattctgaaaagggaagtatttgaggaaatttcagaagccataaaagaagggtttaaaactcttcagagcatgattaaagctagtgagtacaagtcatgtggattttaactgactgggattgtaagtactgtggcggtagcttatggcaattaggtggccggtgttttaagtgtggaatgaggcaaggttaatggaaaatttcgcagtagatgattacgatgatttgatttggtgggacggccgtgaatgggtaactatctgcgcaatgtccaatatcgatagcgctatcaaacgtctccaagagcttcaacagaagtgggaagacggtaatgttgaacgggttgaattttattgaggtttaaatgattcaaatagtttatgcctttgctcctacaaaaactgtagacggcaaaaatgaaaatgctttcggtttaggcgatggtcttccatggaaacatatttcccaggacatgaaaaactttgctaatcgtactcgagatactatcttgatttgcggagcaaagacttttatgagttttcctgaacctcttcctgggcgtaagacaatcgttgtccaagacatgagtcgtgcgttggcaactgctaaaaatggcttctttgcagatgcttatgtaagtgaattagaatttatcggtttcttgggtggtgacattatggccgctcatacttcttacaacagtactatcacttttaatagagaccttaattattctatcataggtggtgccggaatcatccagaaggcatatccatacgcggatagggttatccaaacaatcattagaaaaagtcatagagtgaattctgatgtcactctacctgctgaatttgtaacagctcctacttggccagaatcaggattcattactaaagaaaatcactggtatcatattgatgaagtgactaacatttcagaggtggtctatgagcgcaaactatgatatcactcagctatcagaagacaaagtccaaaagaggtggaaaagatttccatttaagcatggtattcatcttctagttttcagttataatggtcttagcacttataacggttcaactacagtatataaccgaaatggaaatatacctattgaaattgaacgtgattataagaagatgttcatcggaatgtcacacggtaatgtgacggttaatgatgatgtagtgtctattattgggcgatttgaaaagcgtggtgatcagcttttctttacacctcttcaggaaaaatttaatgcgtgaataccaagaattaattaaagacatttttgaaaacggctatgagacggatgaccgtactggtaccggtactattgcaaagtttggtactcaacaccggtttgatttacaagaaggatttccggcagtaactaccaagcgtcttgcgtggaaagcgtgcattgcggagctgatttggttcatgtgtgggtctactaatgtgcatgaattacgtcttattcagcatgactcattactagaaggtaaaactgtctgggacgacaactatgaaaaccaggcaaaagacatggggtattccggtggtgagctaggtcctgtgtatggtaagcaatggcgtgatttcatgggtgttgaccaactgaaattgatcattgatcgtatcaagcaacttccatatgaccgtcgtcagattgtgactgcttggaacccggttgatttggataagatggcattgccaccatgtcatttgctgtatcaatttaacgttcgtcaggggcatcttgacctccaatggtatcagcgttctgtagatgtattccttggcctccccttcaatattgcgtcatatgcagcattggttcatatcattgctaaaatgacaaatcttaaacctgggcatttggtattcactggtggtaacactcatatttacctgaaccatattgagcaatgtaaagaaatcttgcgtcgagagccaaaagagttgtgtgaacttgaaattgcattcccagatacgtatgaaacttggcagactagttctcagattcgttggttagaacaatttgcacgtcctcatcattttgaactagttgggtataaatcccatccaacaattaaggggaaaatggctatatgaatattcgatttgttcgtaaaggacatcagtctaaaaccgtattaggagaaatgcaggacgcattctctagtgatttgcctgaggttaatgacacgatagtttttgacggaaccgaacaacgtgttttatctgtcattaaatcatatgaatggtctattggcaaaacacaattaatctgctggtttgaagttgatataacatgaagatatgtcgggtggttaataaataccattccgacttcgatgtaaatatccaacgtggaacaatgtggggaaattacgtcggtaaagattgcgataatcgtcctgatgctattgcggcatttaaggacgattttattgctaagattcggaacggagaaataaagcgagagcacttagaaactttaagaggaatgagattaggatgcacctgcaaaccgcttccttgccatggtgatataatagctcttgtagtgaataaactttttaaagatacatttgaattagaggacttatgcaagtaattaagagctcaggtgttagtcaagaatttgacatgcagaaaatcattaaagtcctcgaatgggcgtgcgaaggaactaaagtagacccatacgagttgtatgaaattattaaatctcatctgcgtgatggcatgagcactgcagatatccagaagactatcgttaaggtagcggcgaatagcatttctattgatgagccagattatcaatatgtagcatccaatgcagcaatgtttgaaatccgtaaacgtgtttatggacagtttgaaccgcctgcatttattgaccacatttcacgttgtgttaacgcaaataagtacgataaagaaattctaagtaagtggtctgcagaagaaattactttgcttgattcttatattaagcatgagcgtgatttcactatgacttatgctggaacaatgcagcttatcgagaagtatctcgtaaaagaccgtcatactggtgaattgtatgaaactccacagtttgcctttatgctgatcggtatgtgcttgcaccaagatgatggcgaaaatcgtttagcaaacgttattcgtttctatgatgcagtttctactaaaaagatttcattgccaacaccaattatgtctggtgttcgtactccgacacgccagttcagttcatgcgtggttattgaaggtggtgacagtcttaattcaattaacgaagctgctgcgtcaattacgaaatacatcagtaagcgtgcaggtattggtattaatgcaggcatgattcgcgcagagggttcaaaaattggatttggtgaagtcaaacatactggagttattcctttctggaaacacttccagacagcagttaaatcctgctcccaaggtggagtccgtggtggcgcggcgacactgtactatccaatctggcacttggaagttgaaaacctcctcgtacttaagaacaacaaaggtgtagatgaaaaccgtattcgtcatttagattatggtgttcagattaataacctaatgattgaacgcttgattaagaatgattacatcactctgtttagtcccgatgtatgtcttggcgcgctgtacacagaatacttccgtgatgcacaagcgttccgtactttatacgaagagctggaaaagaacccagatataagaaagaaacgtattaaagcccgtgaactgtttgagttgttccttactgagcgtgctggtactgctcgaatttacccgtacatggtagataacgttggtgaatatggtccttttattcgtgatgtggctacggttaagcaatcaaacctctgcctcgaaattgcgttaccaacttcggatgttggccaagaagatggcgaaatcgcgctgtgtacactcgcagcattcgtgctcgacaacttcaactggcaagaccaagaagaagttaacgaaatcgcagaagtaatggtaagagctttggataaccttttggattaccaagattatccagtagacaaagcgttaaaagcaaaagaccgcagagcattaggtgttggcattactaactatgcagcttggttagcaagtaactttgcttcatacgcagatgctaatgatattactcacgaaatgatggaacgtattcaatatgcactcatcaaagcctcagttaaacttgctagcgaaaaaggtccgtgcgcgctttacaaagaaacacgatatggacgtggcgaactgcctattgactggtacaataaacgaattgaccaactcgcagctccaaactatgtctgtgactgggaactcctgcgagaagacctcaagcgatacggtatccgaaattcaacgttatctgcgcttatgccatgcgaatcgtctagtcaggtatcaaactctaccaacggtattgaaccaccacgtggaccagtgtcagttaaagaatcaaaagaaggaagcttcaaccaagtcgttccaaatgttgaacacaatgcttccctttatgattatgcctggcagctcgcgaaacagggtaataagccttatctgaaccaggttctgattatgcagaaatttgtagaccaaagcatctctgctaatacttattacgacccggcgaatttccctaaaggtaaagttgaaatgtcggtaatgatggacgacttgctttatttctggtactttggcggtaagactctttactatcataacacccgtgatggttccggtaacgatgatatgattcaagactctgctgactgcgcggcctgtaaattataatgaattatcaaaacgtatataatagtttaatctcccgggctagagcccgggaatctttattaggatataaagagactcatcatataattcctagatgcataggaggttctgatgataaagaaaacttagttgaattaacaggtagagaacattttatagcgcactggcttttatgtaaaatatatgaagcgccgggattaaagaaagcctttggtttaatgtgtttgaccggtaaaaatcgctcatataaagtttcctctcaattgtatgaattaggcaaacggcgtttatctgaagctgctacaggacgtaaagcttctatagaaaccagagaaaagataagcaaatctcttaaaggaagggaatttaccgaagagcatttagccaacatgagaaagcctaaaactgaagaaaccaaaaagaatatagctgctgctaaagtgggcgtgcttaatcctatgtatggtaaaatttctccaacaagagatgttccccatactaaagaaacccgtgatgtgatttctttgagaactaagcaaggtacagagtatccaccttgtccacattgcggcaagaaagttaataaaggtaatgctcttcgttggcattatgataaatgtaaatttaaggaccctaaatgagtacagtttttaataaagaacccgtagacattatgaacgaaccgatgttcttaggctctggtctaggaatcgctcgttatgatgtccaacggcacaaagtatttgaagaacttattgagaagtctttatcatttttctggcgtcctgaagaagttaacgttatgatggaccgtggtcagtttgaaaaactcccagaacaccagcgtaatatcttcactgataacttgaagtaccaatctcttcttgattcaattcaaggacgagctccagcagcagttttatctgcacttatttctgacccaagcctagatacttggaaccagacttggacgttcagtgaaactattcacagccgttcgtacacgcatatcatgcgtaacctttatgtagacccagctaaaatctttgatgaaatcgttcttgacgaagcaatcatgaaacgcgctgagtcaattggtgtttactatgatgatgttatagcgaagactcgcgcatgggaaaatgccaaaaatcgctgctttaatcaagataatatcgaaattaaagaagctaaacgtgatttaatgaaatctctttatctttgcttacatgttattaacgcattagaagctattcgtttctatgttagttttgcatgtaccttcaacttccataaaaatatggaaatcatggaaggtaatgctaaaatcatgaagttcattgctcgcgatgaacaacttcatctgaagggcacacagtacattctgcgtcaacttcaaactggaactgatggcgaagaatgggttgagattgctaaagagtgtgaacaagaagcaattgaaatcttcatggaagttaaccgccaagaaaaagattgggctattcatcttttccgcaatggtggtcttccgggtctgaatgttaaaattcttcatgacttcattgactatctgactgtatctcgtatgcgtagttgtggtcttccttgtccgattactgatgcaccaactcgtcatcctattccttggattcgcgaatatcttaactctgatgcagtccaatctgctcctcaggaagttgagataagttcttatctggtagctcagattgacaatgatgtcactgatgatgttctaattggatttaaaaggtacttataaggaaaggggcttcggcccctctttattatgaatgatattgctaacgagttttcttttataaaatatgttcaacttgagttagaaccagatttcagtattaaacctgttttggtagcaaacaagttgaatgtagtttatgccatcgcagttgatgatgaactagtttacattggtaagactaaaaatcttcgtaaacgtataaattattatagaactgctattaatcggaaagaccaaacctctgattcggctaaatctgccaagatttttgaagcactaatggctggcaaaaaagtagagttctatgctcgtcagtgttttaatcttttgattaataatgaacttggcgagatgtcaatatccactatggacttggaagaaccgatgtttattaaaaagttcaatcctccatggaacacacaacataaggtaaagaaatgttagagctatataaaaatttaatgaatctatgtgaaagctcagaagttgcaaaattcttttataaagattttaccggtcctatggatggtaagttcagagtgttttcataccactatgcaagctacagtgagtggttaaaacctgatgctcttgagtgccgcggtatcatgtttgagatggatggcgataccccaattcgaattgcttcgcgtccgatggaaaaattcttcaatttgaatgaaaacccactaacgatgggaattgatattagtgatgtagaatacattatggataaggctgatggttctctagtatcatcttatgtcgatgatgggtatctataccttaagtcaaaaacatctctctacagtgaccaggcaagacaagcttcagctttgcttaacagtgaagaatattcttcgcttcatcaggttattcttgagctagcgctagatggttatacggtaaacatggaatttgtttcacctaataatcgcgttgttttagcatatcaggagccacagctgtttgtgttaaacgtccgtaataacacaactggcgagtatattaaatatgatgatttgtacgctaatgctaagattcgtccttatttaattaatgcttacggaatttctgatcccacaacttgggttgaaggtgttcgtgaacttgaaggcgtagaagggtacattgcagttctaaacactgggcagagatttaaggttaaaaccgaatggtattctgctcttcatcacactaaagactcaataacgtcaaatgaaagactgtttgcgtctgtcgtatctgcaaattccgacgatttgcgttctctttttgctggagatgaatacacaattaagaaaatttctgcgtttgagcaagcttatctagattacctcggaaagtcacttgagctgtgtcagtcattctatgatgaatacagaggtcgtgctcgtaaagattatgctattgctgctcagaaagcaacggttaatcagcgccatctttttggtgttatcatgaacatgtacgaaggaactgtagatgtagataaactgcttaaagacctcgaaagggtgttcttgaagtactgggcaggatatgttccaaaagagtacgaaaaggaaattgaaatttccgaagaataattgtttacatcctcatcagggtgtgataccatagacttacaccaactgatgaggataatgaaatggatatgcaagcaattactttagatatggttgttaacaaatacggtactcattctgacgggatttttgtgtggaatggtaccaagaaagtgggattcgtcactgatctacgtacccatatggctcgcaaggaagctgctcgtaagaagcaaaaagagtacactaatcgtgtgaacgagcagcgtgccgaagcccttcctgaagccgtagatgaaatgattgatttcctagataatcatctcgcgaagtatggtgcagaggtgttcaagaacatcacccagccaaacgttcatgctaacgggtgcaaatgctatgtaatcgttgacccgatttatggtaagcatcgtcttggtattatgcatcgtgagctgaattattctgagatggcagaatatgtagaagcgtgcttcaagtgttctccttcggaaagttctgatcgtcacatcctcatttcgggattatcccgtgatgatatcgtagaggttatccttaaactatgctcaaaataaacacaacttggttgttgattggagtgttagcattatccgcaggaggattgaaatatctttcgtggcgggtagaaaatcttaaagctgacctcaaagtcgtccaagatgaatctgatcgacaagcaaaagaaatagaaaatattggtgtttctataaaaaatctgcagacaacatataaaggctatcaggaaaaccgagcagctcgtgatacttctaacgctaagatgaataaagattctaagcgtggaaacgtagttgcagccaaacctggattagttgaaaaacagattaatgcaagcttcaataagtttgcagaagatatccaggaggctaccagatgaaacgaagtctattagccatgtgtattatcagcttattagctggatgctcttctagtgccccagatgttccggttttacatcctgagtggccagatccaattcaaaaatgggaaggacattgggaagtaaaagtaattgacggtaaagcctgggttggtatgccgtttgaagagtcgcaagaatatcgtatctggatgaatgacattttacgatatactaaagatgctaatggaatgatatgttattatcgttctgaacttaaagaacctcgttgcgttaagtaaactaaacaagaggaaaatattatggaaccgtcacatttttattcttactttgtaaaagacgcatcgcatcttttatcgattaaaaatacacagctcagaaatatgctagctgttgggtcgtgccagttaactcctcttgctaagaaagctactgttataccggaaaatatttctaatggatatgtttatacagtccgtgttagtgtgcctggcgctttaaaagaaagattgtttgagcttaatgaccaaacacgaatttcgtttgatgtgtggtttaaactattcatggtagaattcatgtatcctgatttcttgaagtttgttcagcgtaaagaggcattgaaggaagcaatttctgaattggaagatgcctcaattgaatttggtaaggcactccaatttgtagaaagtggcggtgtagagcaagatgctgttaacgggtttttgaagaaatatggaaagcgccgctcattggcgcatcgtaatctttctaaaatggtgatgtagtgaatcaagaacagtatgaaacacttaaaggattaattgctgaaaatgaattggcgtgcatcgtgtttggacgcgcagctgaaaattatgacaaaaatgatatactgtcaatgaataagccattgcgagcaattaaagaaaaatatcgtgctaattggggtgaaaagtctaaggctcttcatgattttattgacactcttaaggacgtataatgaaaaaattggttttgacacagggggctccaggctctggtaaaacaacctgggctaacgaatacgtagcagctaatccaggttggtatgttttgtctcgtgatgatttgcgtgaaggcatctttggccttgataagcgtaatgattacaaatattctaagcttcgtgagaagtccgtatctgtatgccagttttctatggcgaagactctactcgagatggaaaccactaaaggtgtcatcattgctgatactaaccttaatccaacgactatcaagaagtggcaagagttggcatatgaaattgatggtgtcaagtgggaaattaaacgctttgacgttccttggactgaactagttaagcgtaacctctatcgtggcgcgaatgcagttcctattgaagtgctccgtagcttctactctaagatgcatccgtatgatttgtacattccagatgaatcattgccaaaagcagttatctttgaccttgatggcacgttagcagataacaatcatcgttctccttatgacttggccaaatgtggtaaagaccatccaaaggaaatggtaattgaatttcttaaaatgcttcgtaacaaaggatataaaattcttactgtttctggtagagagtctggaactaaagaagaccctacagtttatcaacgtattacgaagaaatggctgttggaccatgttggcgaaacaggcgaacacttccaacgtaagcaaggcgattcacgcaaagacgatgtggtaaaagaagaaatcttctgggaccgaattgctgatcgttataatgtaaaacttgcagtagatgacagggcgcaggtagttgaaatgtggcgtcgtatcggtgttgaatgctggcaagtagcccacggtgatttttagaggaaagtataatgtttccaaagtattctgaagtagtaaaagtatcatttacgcaagttgttgctaatcatttaacagatgagtttactccggctgaagtagccaaaatgcatgcagagtttttatctgccatgaatgcacttattccaaatggcgaagttgttaaattttcaattgaccgtctaggcggttcgtctgaaattaaaatttcttgtggcgaaggtgaacacgactggtttatcgttggaattattgctaattttgaaacccaacaggttgagacttatgttgtctgacgctaaattttcacatgatgaatttatttcgaaggttaaaatcttcgcacaggaagtagcaaaccgggttcctggaagtaaagtgactctccgacgagagtcatcctttaactatgttgatgcttatatcattacagttaataatggaaagagcaatcaacatactcaattggctttaactggaacaggccaagttgaaatgactaacattttaggacatatctaatgactttacgtgaagcggtagaagctcttttaattgaacatgctcgtggcattaaagcagaaatcagcccaaatggtattcggctgatcagtgctgttattggttctgaccaaggtgtttggtcaattccacgcgaagaatatgatgctattttgtacagtaacgttaatgtcaaggaaggacaacctatgtatggttatgtcttctctgactcgcttgaacgaggaaaccatccgtttccagatggcacaggcattcgtacttctcgagtagagagttttgcttctcctaccgacgagttaaaattggttaaaacaaataacacaacttatctggtgatttaaatgaaagcgtcgacggtactacaaattgcgtatctcgtatctcaagagtcaaaatgctgctcgtggaaagtcggcgcagtaattgaaaagaacggacgaattatttctactggctataacggttcaccttctggtggtgtgaactgttgtgaccatgcagcagaacaaggttggattggtgaaattccttacaaatctacgggattgcgtcaagacggattccaagtcaaaaaagtcggattgctcaaagaacatcgagcagcccactctgcatggtctaaagtcaatgaaatccatgctgagcttaatgctattctttttgctgcccggaacggcagtagtattgatggagcaacaatgtatgtcacactgtctccatgtccagattgtgcaaaagccatcgctcagtctggtattaaaaaattagtatactgtgaaacatacgacaagaacgaacctggctgggacgatattcttcgttctgctggaatcgaggtgttcaatgttccaaaacgtaatttggataagttgaattggtataacattaaagaattctgtggaattgaataatgaaacttagaattgttgaaattaataaacttaacctaagtggtgatgttgttatatcatactcagtagaacgccggtattggtttaaatggaaaccattagcaacatttaaatttgaagatcaagcagttcgattattaaaagaattatccaagcgcaaatctgtaattatcaaaactattaaagagacatcaaaatgaaactgactactgaacaaaacatccatattcgtgaaactctgaaggctgtgctgagcatgggcgaatcccagattgtgtttgaaaaagctgatggcactattcgtactctgcgctgtactcgtgataaagacattattccatctgatttggtagaaagcactactaaatctgctcgagcagaaagcactacttcacttccagtatatgataccgagaaagaaggttggcgctcatttgcctttgataaactgatctcggtaaatggtatgaaagttgagcatctgctgcagatgatcggtaagtaatttgctttaaactgaccatgttaatataactacatggtcaaacaataaaggtaacacatggaacttccaattaaagctctaggcgagtatgtaattctcgtatctgaacctgcacagcaaggtgatgaaattgtttctccttctggtattattcttggtaaagaagaacaaggacaactgccggatatgtgtgaaatctattctatcggtgatgatgtaccgaaaggatttgtcgaggtcggtgatttgactccgttgcctgttggtaatatcagaaacgtacctcatccgttagtagcagcaggtgtgaagaaacccaaagaaattcggcagaagtttgtgacttgtcattataagtcccttgcatgcgtatataaataataatatgaattgggcgtcggacaattagttacccgagcaattctacgtggtggatgcccgagctaaacctcggttaccgtccaccaaattttaacctcatttgaggaacgattcaatgaacaaacaacttactaaagctctggaactccaacgtaatgcatggaattccggtcacgaaaactacggtgcttcaatcgatatctatgcagaagcactggaagttctgaaagggtttaaacacctgaacccagcacaagctgaatttcgtgatactttagaagcgatggacgaactgaagtatgctaagcatcttggttctgctgctcgcaaagctgttcgccactttgtggtaacgctgaagtaatttgtacgcccaccatgtgtacgcatgggtaacgtatgatgtggacgttgttggttatccccacgtaaaacatccgaaaccaacggtgatttgctaccaaagtgcagctagaaataaacggcaagtgcatgctaccccgaggcgatggccaatcgggagtacgcctcaaggcctatacatccatcggtgtatatcttatccccgataaatcggacccggaacctttaagctaacggtgtgcaacagataagagtttaaacgtaccccttgagggctttcgggagctacaaccgaaagaactgtcgaaagaagttgaacctcggaagaacgtgctcccatgtatttctccaaaatggaagatgataaaatggctaaacaagctaaagcaaaaactgcagtaaaagaagttgttggtacctctaaacgcgctggctacaagcgtgggtcgaacaagcgtatcaatcagacggttgagaaaatcatgcgtcgagctcgtgcggttcttcgcgatgatgcttctcgttttggtaagccgaaagcataagttcagggactccttcgggagtcccttttttattttccacagaatgaaaaaagttgtttacttctaggctcaacaaggttactatagacctgtaccacccaaacggacaacggagaataaaatgaacttcactaacttcaaccgcaaatacgtacagaacaatgcctgggacgtctctactactttgctgtgggaacacaacaacggcacagtggctcaaatcgatatgtactgggaagataactacgtatttttcagctttgaaaatggtcctactctggatattcagttcaacggttctgaaatcaaagttggattccatgatgaagttcgtaaacgtgatttatcttcacatccgtcttggaacacaaatcgtcagctgcttgttaaaatttatctgcgccacatcctcggtcgtaaaacaaccgaagaacaacgtgaagcaatctgggatatcgtttcaaacgaaataaagttttaactaactcggggcttcggccccactattgaggaaatgataatggaaaaaggtaaattctataagcttaaaaagactccaagcttgtctccaggcgctcttatcaagggtgtttttgagcaaatcggtaataatccaattaaaattaccagaacctttaaatatgcggaaaacactggattagttgaatttgaaatcattaagcccgatggggaatacaaacgcgttagtatagatgaagttcgcttttctcgcatgtggtgtattattactaatcaagagtttcagcattattttgaagaaaccacccacaaagaacctgaaccgaagaccgatgacggaagcaatgattggggtgtttggacctcaaataaaggaaatgatacctacaaaggtggattaacaaaggaagaagctgttaatcttgcaaaagtacaacgcctgaatgcaactaaagacacaaaagttgtaatcatgcaaccttttgctgtccctgtggttcacgttaatattcgcccgttttaagaggaaattgaaatgattgtatcagctttctatgattcacgaaagaaaaaagttgaaaccattatcagcgatacccgcgatggtacacctgctaataaaaatggtgtgaaagcatacattgataagtattgccctcctgaatttcgtatgattgacggtgtagattctctgagcattaacattataaatgctaaaattgaatttattaatgaaactgtgccaattgggtattctgacggtgatggctcaaatgctaaaatgccgaaagaaaaattcataactaaattttgaggaaatcaacatgattgtatccgtgcctaaatctaaagatggtattttttcttgcggcttgaaaaaccacccaatggttgatatcatgtcagctaacgttaaacaacacaccgttgagtatgaaattgatgctccggatttctttgaattgcctgaatgggcagtgaggcttgatgcatgaaatatcatatcttcaatacagtaagattagcaaatggaattcctggagttgtatgtgatacggctccagccattaaagcctactcggttgaaccttggtatgaagttaattgggttgatggcaatcgttcaatccatgcagaatccgagctttatccaattactcaattaagggctgctaacgacgatgtctattaatcctcacttcggtcatatggttgcccgacgtatcaccagggaaatgctaaagactgctgagtattataatatagaattaattgatatagaaccctcggacgctccagggttaatctggttcaatttcaccggtgccgcaaatagcgtcgccaaatttaaacaagcattgaggaatttccccgaatgtcaaaaccagtaatcgcaaccgatgttgatggaatcatcgttaagtggcaaagtggtctgccttactttgcccaaaaatataaccttccggtagagcatatccttgatatgatgactactgaaaaattcattaaacccgctgagctgtttgattgtgaagaagacctggctgttaagcttcttctgaaatataacaacagtgattttattcgttatctggcgccgtatgcggatgctttagctacagttaataagctcaaagaaaaatacgattttgtcgctatcacggctcttggtaattcagtagatgctaaccttaatcgtcgtttcaatctgaatgctttgttccctgatgcatttacagaaatcatggtctgcgattatgatgaatctaaagatgctttactggaaaaggctaaagtaaaatacggcgatcgcatcgtctgctatgtagatgatttgcctaaacatattgctgcggccagcaaagtatttgaagacactgaaacccgtgtgttctatatgcctcgtggtgagcgagagggttcagtgactgctcctggaattatggttgaagattggcatcaaattgtaacttgcctggaatctttggaatctgttaagaaaccgcagaagtctctttctagattgtgggaagaagctatcaaagaccaaattcgtaaagagcaacatccttttaattggcctccacggcaagttccaggagattggtggaaacaacctatcattccgtttagtcctagtccgcatgttcctcctggaaacgactggtggaataacggtcgtattacatgtgataaccaccaaattaattgctaacacactgggtatggtataatagccataccctaggaggaaatatgtttgtagttcatactaaggtaggtaaacgttggttatcatgtgattatggccatgttaatcagttttatcgttggaatccaatttggcgtgaagcaaaggcgtgcccgatttggaatgaatgcatcaataacgggtttgtttatatcgatggattaacttatcatcgtagcgtaagcgaactttcaaaagaattaggtgaataatgatttttgatatcatcaaagcgattgaagatgctaagggttctaaagccaaaacccaaattctcattgacaataaagataacgttgatttaaaacgagcttatctgctggcgtattccgggcgatttaagttctttattaagaaagttccagaatatactcccgttaaatatccaaatgttccttcaaagacgttttctgatggtctagattacctccaagacattctggcagcacgagtacttactggtaatatggcaatccaggggctagtagatttgctctctaagatgaacgagggtgatgctagtgtactggtccgtgtacttcttaaggatatgcgttgcggcgcttcaggttctattgctaacaaggtatggaagaagttaattcctgagatgccacagatgttagcatcagcttattctgagaaagcgctatcgtatattaagttccctgcatttgctcagcttaaagccgatggagcccggtgcttcgctgaaatccgcggagatgatttagatgatgtaactcttcttactcgttccggtaatgaatacctgggtctagataaacttaagcgtcaacttatcgagatgaccaaagaagcccgagaacgccatcctaatggtgtgatgattgatggcgagttggtatatcatgtcgaagtgaaagaagaagaaaacgacctgtttgatatgtttaaagagcctgagcttcctgaactaagtaaagctaaggaattccaacagacggctcgtacagaatcaaacggcttggctaataaggccattaaaggaacaatctctgccgaagaagcagaaggcatgagattccaagtttgggattatgttccgcttgatgtagtatattccgaaggtaaagttcctggatttgcttatgatgtacgcttccgtgcactggaaatgatgagcaaaggctatgacaagattattctaattgaaaatcatgtcgtacacaacatccatgaagctcgtgctatctataagacatatgtagaccaaggtctcgaaggtattatccttaagaatatcggtgcttattgggaagataagcgttctaagaacctcgttaaatttaaagaggttatcactgtagatttgaaatgtgtcggttcgtacgagcatagaaaacaacctggtaaaatgggcggcttgatgttcgtatcagaatgtggtcgtattcgtgttaacgctgggtcaggtcttaaagataagcccgaagaactgcacgagcttgaccgtactcatctatggaaaattagagattctcttccaggaactatctgggaacttgaatgtaatggttgggtaactgctgaaggtcgtgatgatggtacggtaggattgttcttgcctatcattaaacagcgcagatatgataaagaagtggctaatacattcgaagccgcatttggcgtgaactttacagaggcaacaggaataaaatgaaagtattatacgaagtaattgctaaaactgatgatgggcgaggaggtatttccgtccataccgaagttcttgattttgataatatcgatgtattcaaaaacttcaaagaaaacattgaagagtatgagtctgtaaatggattacaggtttggcgtactgccacaataattaattaaaggccttcgggccttttttcgtataaatagaataaacaaacgaggatatgtcatggaacttttaaatgaagttttcgatgaagagaatagcaaaatctatcctgtcgagaacgttaaaccaaaactaaaggtgcctcaggtatttctgattaaggtgccgggtaataacaatctaatgattcgcttagtacatgggtcaggtcaaggtgatgcagttaagaatatcaaaatgggtgataaattcattcaggtatatgttttctctgtgtcagaaaaaggtaatattggagccctcaagggtgggttaggacaagacccgattggtgctatcaatacaatctttgaaactgtcaacaaagtagttaaacaaattaaagccgatgcagtaatgttccgctttaatccaaagaaaatgcaaggacaagataaagctattcaacgcattcttgctcggttgattactactcgcaccggtggtcggttcaatctaatgaaagatatggcttactataaaggtaagtatgcttattccattatggttcacaaaggtaagaagcttgaagagattgaaggaattcctgaaatttcagatgagttatacacaaaggttgaatccaaagtaggtgaaatttatgtgtctaaagaaaccggcgaaagcgttaccaaagccgaagcattggctaattctattggcgaaaaagaagacaagaaatctgaactcgctgtaatgagtaaaatgaaagtgtctcgaaaagatttaatccgagcacagtacggcaaatttgtttcatatgttgatgaagattggccagaaaataaacgcgaacgttggtacgaattaactactaacactccagtactaaacgcagaaggcgatacggtagacctccaaaaagatatcaaagccggattagaaaaatcaattcctttttatgttgatgatatcaagcactatcgtgttcgtggcggatatggaagtaattttggcgatgcagttgagagattatttgtaggccaaatgtcgagaatgcatgacgactggaaggttttcattccttcgggttcagacaaaatgaaaatcgctgaacaacgaatttcagacgttgctgacgttattgctcaagctaaaaatcctgcatctatggaaacaatgcgtaaaatcgttgaagtagctactcgtggatttgatatgcctccagctgacgatttcggagctttgcgtcaataccaaaatcttgtcaattatatgatatccgcttatgtgtcaattgttggcgattctatatccaaagcaattgaatataaccgtgaaatgcaatctcgtttaagcgaagaagaaagagatgcaatacatcattactgtggttctggttattcatttgttaataactatcttattggtatggaaagcttaggcgatccgattattgacaagaaaattcgtccgctcgattctgcctttgaaaaaggtttgcgtcttgaaccaggcactcttttgtatcgtggtcagcgaggaaaatatgaagactttaaagataacattgagtctaaaatgttttatttccagaactatgtttctacttcgttaagtccaattatctttggtgcttattcaaatgctggtgattcattaatgccagacgcacctagttctgatttagaaaacaaagaaacaactgctaatgcggtatcttctgttattggaacagacaacttggaaagagttgatagaggcgaggaagttgcctatggcgatgagtttaagtttggattcgttattcatggggctgataaagttaaggtagttatcccaggtgtcttgtcaagctttagcgatgaggctgaagttattcttcctcgcgggttggcaatgaaagtcaacaaagtatggggaactccttttagaaatggagttggtgtagcgaataacaagacattcatggtagaaatgacggtagttccgccagagcaaatcgatgaatccgttcatctctatgatggtgacatcttgatggaacaaggaaaagtggaacctcttgaagaaagcaagttcaaaggctttttaaatgagatttacttttcgccagaccgttctacagataaggttagctacacacgtaccatggagctactggctggtgctatcaacctggatggtatcccagaaaaacttgcataaagttgtttacttatcacaaggacgtgatactatagacttacacaaaccaatgaggaaattgatatgaaacacgtattccgctttaacggtattgaatggtctgctgatgttaaagatgcagagaagttcaatgaagaagttcttatcatgcttgaagggtttaacgaaggtactccgacggttcttattcaagatatcttccgtaagccaactgaaccatcgtttgttgaagcggttctaaacggtaaagcagaaggtattattccggtcaaagtagtttggactactaaagaaatgaaacttcttcgtactgagccagggtttattggctgcattgcataaaacaaaggggccataaggcccctaaattattctgcttgttgaagtagtgatattagaaattccaccacctgccccgcctaaacgagacaatcttgaagcagacgtactcaagccctgatttggattaatcgtctcaattttctgaatagttttatcttctaaccaatccattgcggcttgttttccgactgaacctgtttgcatgctgcgataagcaaacgtgacatcaaacacagctattgtgttttctccatcgtaagtaaattcgggagctccacatgctacaggcatagcccctgagaacaggcatacagtatgtggtaatccatttctagcatgaaggttaacttggatatcacattctacgtcttgtggcaatcctcgcagaccagtcaccgggtcttcaactgcatttacccaatcttgcattgctctatagttgcttgcttctgggtccatcctaaatgaaagaaccaacggctccatatctcttccagtgatttttatgttaggagcgttatggaacttatccatttcatatgacagtctattctctggtattttagcagaatacaccatcaagcctgctgtcggaaatgccatgttaaagaaatcaagcagataagtacctactgtgaattcacctaacaacgactgtacaacacgctgtgtcattgcgccaatcataaatgtattcacacctgatttgcgaacaacctgtcgagttccttgtgtcactatggttgttataccctgattgaattcacctggtgtcaatccaagccaatttccatctaaacccatattattatacagctctccgccaaagtcgtttagaagagcctgggttttactagagggtacagtagcgaatacaacagagaacatattagttctctggaaatcgatgtcagcagcttgactcttaaattcttcgagagtaaacattattcaatacctccgatataaacgttccctctattaagagtaagtatttcacgcatagtaatttcaagcgtaaacgtgcttggaaggttaggagcgattgctaacccattaaaatgaccgttcggtgttttatcaaagcggatgctctgaatttggcacggaccaaatatatcctctctaccatccattgatgtagaatatccaaaattacgaacagtccaaatcgttgggttagaaactacaataacattgcttaaaaacgatgttatttgctcaaacacagtgttttctactttagctccatccggtgctgccgatttaagtgttcctttataccattcatcaatagcagctttaacttcttttgcatatgatgaattccccgtcacaccgtaagaatagtagttaaaaatttcatagatgcgaataatttgtataaggtcatctgcagacctaggagttaaatcccaagtaaacactttcgttctattatcaggtccggcatacatactacgggcagtgttataaatttgctcaccgttatcggccattaatccctgcgttaaagattctatcgacccaaacaccgcagtagaagccacgttgcttaatacaccagtagcagtaccgctgccgcgagtaacaagagaatcgccaacatcattaaatttatggctaaccgaatcaacgtctgacttagaccgtggtaatagaatattagctaccggcgcagtacttgtagtagaacttgatgaattagccagtgctgacattggtgaatcgaatacagacgataacattacatctcgtctaaatgaacgcaaatcaggagtagttcttcctttaaaatcatatgctgtgaataataatccgttacgatacaagtcatgtactctcatatcttgtgcggaatcgtttccggctgagcgttcggccggaaactgcgccaccttagtggtaggcgcattcgtcagtttagatttaccttgggaaattcgagttcctgattttttgatgttttcaaggccatcggccagttcttcaaaaatcattgtttttccttaagaggttttcatagcgccttgcattccaggagcagctgttgaagtctgtggaggcgttctataaacgtatgtgctattcttatttacagcggtattaacctgaataggttgcgactgtgtattagattcacgtgtacgagctgcttcacgactatctgcggcggctttaatagaagcagactgcttaacctcaggctgttctgttgcaggtatagcttcggcagttggagcaggttctgatattttagaatcaagaagcttttgcaattggtctaattcaacctttaaatcttttgcaacttctggagataatttctccaattctttatatctggtggttgtgctttgtactgcatccttagcagagtctaatcgagtggaatcagatgcatcagttttttcaacatatgcttttgtacgcttgagttctgcctcagcattattacgagctgtgatgattttgaggcgttcgtcttctggcaagtctgcatacgctgactgctttttctctccgctcagcaatttattatattcatcgtcatcaatctgaccggtgaatttttggaatttagcagaaagctttcttttccattcaggttgttcgtcatattctctttcttgacggtcaacatattttgctctcattttagcatcttcttcatctagttctgccccagtaacagtttgaaatctgtctaaagcagcgccttcaatgttatctgccgaatcgttaaatcctaatgcgcgtaacattccagcgagaagcttactcattccgagcataatagtttctccgagcttgtcaattacatcaaccaagccagaaccaatggctttagctaatccgccccaatcccctttgacgaatgattttactatttcattcgacatctcgcttattgctgttaatagcggaccccattctttggcttgcttgttaaattcaacaaagttcttttcgaacagtttagtccaataattaaaatgaactttaattaaatctataagcattatcacgcccaaaaccatggcggcagttttcgccatttgagccaaagcgctaacagtatagctaaatagcatgctgctaattttatctgttaatgaaatagtttttccaaaaccagatttaacacttttaattaattctccaaattttaggccaagaaactttttattcttatcctcagtttctttgttaggttcttttctttcctcttgctcttctgtgttaggaaagaaatccgcgtcaggacgtctatcatcctgtggaggaataagcctttcgagtaattcctctagcggctgctgaaccggagcatcaggtacttgttccgttattgtttctaacgatgttccagtaccagtcttttggacatcttgctgaacatcatgctttttagataacaagtcggcaagtttcgtgagcttatcattaattaacgatgctgtatcatttagtttagagacagcatctgttgtgcgttctgaagcttcagcagttaattcaacaccagctgaaacatcttctactgatttgataatttcatttgatttagtttctattacatccgaaatcaaatcagtagacgcttgttggtcgtctaagcgacgaccaatatcttctagcgtattaatctgagcatcagcttgagactcagcctttttctgtggagccgagtcagcaataactcttctacgcattgaattcatttctgatttcttagtcattcaaatatttccattacgttaagcatgcctttgattggtccttcaggtccatcaatggctatagtgtttactaagtcatcagcccactttgttacaaaagctggaagcttcataaagtttatatccattggttttccatctactgattcaagaaattcgcttaaaattgaatctactgaacctagtttggaataacgaggaggagctctgaatttgaattctttaccatctaaccgctgagttaatcgttggcaaatgtaaactttattcaaatcgtaggtaaaatcatctttaacaaccgtttcttttattcggttgttaaatgctaataaatgtagtacaacgatatcggattcggctgccgttaatcctgggcaaattgaatctaaaagaagattcatgttttcgtctggtcccttaacatctttcatcagattatggtgctttaatccaagttttggaattgatatcgtcttttcgtttattactattttcttaataggaagaatcacgtttaagttcatttttcaccttaatcaaatctacaggttcaagggcagagccatttgtgaacatatataagttagttatagatgtgttatttgatatttcatggataacttcatctacataaaagtcagttctgaactggtcctttaaatcaacaaaattgattttcattccaggagttagttcaaaattaccgtaacatttagtttgagcatacccgtcatattgagccatcgtagaaatgcgtagtgcttcttcatagccatttctaaaaatcatgtcagaatatccgcctgacctattaatgaatacgctgttttggccttctccattaataattcgggtaacatctttgtccacaaacgagtgtgcataaaatgttgcgtttttcatgggatttctattatatctgtttgatttaacaagccattcaaaatcccatgccaatggatattttaatcctgctgcaaactgacctattgtttgaggagctccaaacatgaatacatttgggttctgggatatcattgattcataatccatcatgttaatcccagtgatatcttcccatgcaaaaataaattggtcgttatcagtagaaatgcctacgtttctaacgtatcgcaagtaatctttgagagtactagtccatggaactcgtgggacgtaggcgttaattccgttgataggaggagcaatcaatggttggtcaacatacatcgcgcctatcatttcttttatagtttcatatgcagaactaaaaaacgctctactgaacttgagattcattatgtcatgcagcgttccaagctgaagggtgataatgctatcacctttatcatcaacaccgactgtaaagtgtttaattccgtaaattcgagtttgcgttcttgatgtgttactgtttgcaacagatatttgaactagttcatcaccgttcatacgcgtgtgcatatttttcgaatcataaaactgaagtagaccctcattagtcccgcgtaatgaatctctcattgttaatgtaataaatgtagctgctaattcaacgaatctattagctagccacgcatcatatccagaatataattttatgcttatattaggatatcctaatctttgtgctgtcatgatttaaggtccttttcaataagcgataaggttatgccacgttctataggcagcattttcattatagaattcaaatcgtatttaccctgagaaaccaatctatggttaatctgataaaatgtgaaaatctcgtcaggatgtagcaatagcttaaaaatatcgacaatgttatcatattttaatattgtcgtggtatcacagcatgatgtttttaattcaaaattaaagggcttcatctgtgataaaatcttttccaaggtttcaacatctatagcatcgataacggtcaatttattgctatcgctcaattcattccatgcgtattccccagatgaatccttcacagatataatgttatctaaaatcattttacctgtatcgtcaattatttctatgggttttttgaacttgagcgttaatccagcaacctctacttttggatttaccaatggaggttggttaagattaaaaagatactgcttatattttccgcattttgggcacttcattctgacaggtattttggttttaccaatacttgaaagaaataccttaagaaatatataaggacgatactcggcaggatggtcatgaaaataatcatccattaattctgctataagttgtttttgttcttcttcagacttggtgttcatgtcgtttctaaccaataaaaggtctctataatcttctactgtaaatggcttaaaacgttggacaccatctggtaattcgcatctaactatattggccataaggtaatcctctttatactatttataaataattgaataagaggagtggatatgaacatcacatacaaatttgaaacaagaataaatggcaagaatatccagtgccgagcttttacactagaagaatacgctaatttaattgcagcgaagaaaaacggcacaatcgatgaatgcattaaagcattgctcagagaatgcactaatgccactgaattaaacaaacaggaatcggaattacttatagttatactctgggcccatagtattggcgaggttaatcacgaggtgacctggaattgcacctgcgggcgtaaaattcctgtgccattaaattatacacacgcgcaaatcgatcctccagaagacctctggtatgacttaaagggatttaaaataaagttcaagtatccgagtctttttgacgattcagacattccaatgatgatatcaaaatgcatagattatatcgtggttggaaatgagcagatttactttaatgatttaaacgatgcagaaatcgatgatttatattctgctattacaaccgaagatgtagttaacatcaaaaatatgctattgaagccgcaggttcaattagcagttcccattacttgtgaatgcggaatttctcacattcatgtaattaaggggcttaaagaattctttaagattatgtcatgagcaatatcgataaattatattctgaccttgacccagagatgcgacttgcttgggatactgatgtgtcaaaaacggtaggagcacgatcggttaaaaatagccttcttggaataataaccaccagaaaggggtctcggccatttgacccagcgtttggctgtgatatcacaaacgaattatttgaaaacatgactccattaactggtgatacgataaagcgtaatatagtctctgccgtgcgtaattatgagcctaggattaatcgtctatcggttgatgtgcttccgttatatgacgataatgctataattgttacggtgcagttttctatagtagacgaccctgatacgctagagcgtatacgcatacagatgcgtagtaatgctaactctagcagtagagtataatgggactagtccttccaaagaaacagtagagtggagatagaatgagattagaagaattacaggatgaattggataatgatttgattatcgaccagactaaactacagtatgaagcggctaataaccctgttctgtatggtaaatgggtgcgtaagcactcgacttgtcgaaaagaaatgttaagattagatgccctcaaaaagcaaaatcttaaagcacgattggattattacactggccgtggagaggttggtggtgaagtatgcatggatgtatatgaaaaatcagaaatgaaaactgttttaagcgctgataaagaaatcttgggtgtagatactaaattgcaatattggggaattcttttggagttctgtagcgatgcaatggatgctatcaagtcacgaggttttagcattaagcacattattgaccttcgtcagtttgaagctggcgcgtaataaataaacttgtaaactaaggagacaatcatgtcgaatacggtatgtgtcgtctgtaaaggaccaatcgatgaagcattggttgtccaaacagacaaaggcccggttcatcccggagcttgctataattatgcgattgaattgcctgtcactgaagacacagaagagcaattacaagaaacgcagcttttaatttagtctagtgttgatgtagccaattggctttgccccttcctttcggttggggcttttttatatcagaagtcttcgtcttcgtcatcttcagaatcagcttcaagagcctgtctacgccccgccaaagcatcccgcacaatgatgtcatcagaatcagcaagagtagtttctttagagcgcttatcgtaatacttctcgagttctttcagaccatctaaggtttggcaagcattaattttactcatgaagttatcgatagtagcctcacgaattgtggcttcgtaaatatcttcaaatttaatcatagatttaccgttttcattacgtagttaaatttttcatcagcatatcgttgaatacgctctaatgcatgttttaagcaatagtttaaatgtgtgtatttctttttagcattggctgacttcggctttacgcccaggtcatcaatgatatcccacactgtagccaaagatttatctttatgcttacgaagaacacgaccaatagtttggagtacgataatcttcgatttaactggatgggctaaaattacatgatgcaggtttttaacagaaatacctgtagaaaatacaccgtagcttgcgacgataataattccctttccgttttctgccatagcctttaaagcattacgtgtttcggtattaacttcgcctgacacataatatacatgctcatgacccgcagctttaatcatctcgaacagctctttaccatgagctacatgtttaaacatcacaaaggcattttcgtcacgcgctgcaagtttagtagcaagattagcaatccaacgatttcttttcttaacattggtgatgaatttaatttcttcttgatacgttttgccttttaaagcgtttgcggctgcatctgggtatcttaagaagattgtattaattttaagctcagttacttgtccatcttccattaacttagaagttgatactggacggaagatttcaccaaacataccaacatattgcatgatattagctttgccgtctttaagagaaccagacagtccgtacttaaacatgcaatttgtaagacctgcaatgattgttgaaattgactttcctgttgcaagatgacattcatcattcatcatcatgccgaattgagaaaaccattctttaggctgcttaacagcggtctgccaggtagatacataaactaatgcattcgaatcacgagcagtaccacctcgaatacccagcatagcattgcgaggaaataaacgataatcacaaaaatcatcaatcatctggtcaactaacgctgtggtaggaacgatgataagaaccttgccttcgtaattttctacataatatcgagcaagtaatgcctggataagagacttaccagcagatgttggaagattaagaattctacgccgattaactagaccttcatatacagcatctttctgataccagtgaggttcaatcttagttaatcctgaataaatttctttagttgataaccaattatcaaaatcctcccgcgaaagagtttcttgctcgaatatagctggatcgaaataaaccttatatccgaattggtcagcgaattttctgatttggccaacaagaccaaacggtaagagacgattataatctagcagacgaattcgtccatcccaatgtccatagcgatatttcgggttgaatctgtatccatcggcttcgaagctaaaatagtctctgagttcatagaaaatcgagtcatcacactcaatatgaacatgactaaaatctttaaatttgacttggatgtcgtgcactgtactatcctcagttataaatacaatcatatttatacattacatgaggcacacccaatgctagataaagactatattaaagaaattcaggcactcgataaaaaagaagctaaagataagctcgacgagtatgcccaaactttcggtattaaactgaaaaagacccgttcatttgacaatatggttgctgacttagaaaaagaactggctaaattggccaatgagcctatgccagaagataatgatgggctgtcaattgctgatttaattcaagcagatgatgaaattgagggtaaagcagtatttaaagatgaagcgtctgatgaggcaaaactactgtttgacgctccagttaatgttggtattaaaattcatgatattgacccaggtttttataaagaaacccctaaggtaaatgacccagggtttgaagtaaaaacaccttctatcaatgataaaggattttatgctgaagctcctattggagacagcgttattcatatagatgatgaaggacaagttaccaatattccggttagtatcacggaccctgaagaattctccaaagcaatggacaaagtagttaaaattattaaaacagacgaaatcattgagcttcctgaaaactttagtccaaatatgcaattgctaggtaagaacccaggatatattactcttccatggtggatttaccaatggattaaagataacccagattggaaatctcggccaacgtcgtttgaacacccatcagcacaccagacactgtttagtttaatctattacatcaaaagaaacgggtctgttatgattcgtgaaacacgtaattcttcatttgtaactttaaaataaggaacacctatggcttatagcgtatctattgctcctttggctgcttcggcagtcattggagcaacaaccaattttactgcaacaacttctggagccgcagctgaaggcacagaaacgtttgtatggacagtaaatggcgtaaaacaatcttctgtcactgcagctatgaattatgtcactgcaggacctgccggtagtaagactgttaaagtagttgctactgttaccccagcagagggtgaggtagaaaccgctgaagcagaaactactttgacagttaagaacaaaactatgcctgcgattactttaactttgagcccgacttctgtttctaaagaaattggacaatcacaagtagtcacggctgatgttactggcgcaccgtcaggagcaagcattgcttatgtttggaaacgtggctcttctgttatttccggtcaaactggtaaaacaattaccttaactgaatcaacggaaaccagctacacactgaattgtgaagtgacggtttctgctccagactataataatggaactgcaactaaaggtattgctgttgcttttactaaaaagaccatgagtggtgtttcagttactttgagcccaacttctgtttctaaagaaattggccagtctcaggtagttacggctaacgttgttggtgctccagaaggggcaagtattgcttatgtctggaagcgtggtactgtcgttattgaaggtcagactgctaaaacgattaccataactgagtcagcagaggctaattatactctgaattgtgaagcaacagtttctgcaccagattacaatccagtgactgtaagcaaaggtgctagcgtaaccatcactaaaaagacaatgagtggtgtttcagttactttgactcctgaatctattacagtcgagcaggggtctgatgcatcttttaaagccgacgttatcggttctccagaaggtgcatccggaacttattcatggaccaaagacggttcccctgttgaaggttcaactagtactttagtgattgacacgtctgatatagggtctcaagtgattggggtttctgttgaggtttccgcagaagattataactcagtcacagtaactacaactggtaatgtaactattaccaaaagggtagctcctactcctaacggagagcttccgtatattcatcctctgccgttccgtgaaacagcttatatctggtgcggttggtgggtaatggatgaaatccagcgaatgactgttgagggcaaagattggaaactcgacgaccctgacagcgattattacctacaccgatatactctggctaaaatgctagacgattatccagaagtcgatgtacaagaatctagaaatggatacattgttcatcgtactgcgctggaagcaggtattatctatccttaatattcgggagccttcgggctccctttttgctattcatagactggtttaatatgtcttcatcacatagatgaggttattatgaaagcaatacaagctcacttgatgcatgaaagtggtaaagatttccaagaaattgcgagagcattagatatcactccagcggaagctgctaaattgtgggtctcagttgagaaagcacacgaacggtttaagcaaaaagaaaaagtcgtatatcggaaacgcttaacaaacgttggtataaaatctcgtcataagaaacttgttaaacacatgaggactttatgatgtctaaagtagacccaattgtagtagaacgatttgaagaaatgctttctaagaaatttacgccagctgctaatggggtaaatgtctggttgtttgcatctaaatttgttagtaaaatgatggctgttcagagttcttactactataaaagtggtgcacgtaaaataacggatttgattaatgaacggtatggaaaaattgattggatgctgatggataaagatattccattagtacttgaggttggaagcaaaagtcaatttgaaatcatgctaactaaaagcggatatatcatgtatcgcttcgtgccgagcggttattaattgctttaaaaatcgatgtggtataatgggctcaggggaaatcctctgataccattatccttatcccaagatagatggactcctggttttatattatttattgagagaaaaattatgaaccttgcagatagaatggctaatacagctattaatgttgctacagaagaattgagtgcagcaaaagaagaagtattaacccagattgagaaaaccgctttagcgggtaagcgtgagctaattatgtatcctagcagtttagttaagaaacatatcacaaacgttcttaattatttgcatgatgaaggatttgttacaaattataccagtgcccagcgtaatggtgatactgactttatgaaaatcacattctaaggaaattataatgtttgcaaaatattctagtctcgagaaccattacaacaataagttcatcgagaagattcgtggtgctggttttgatatgcatactgttgagtgggtggctcgtgagaaaattcatggcactaacttcagtgtgattattacccctaccgaaattgttccggctaagcgtactggtcctattttagaaggtgaaagcttctttggtcatgagattatcatgaagaagtacaaggattctttcgttaagatgcagaacatgctgaacaccatggatttagtatctgttcaaatcttcggtgaatttgctggcggtggtattcagaaaggcgtagattatggtgataaagatttctacgtgtttgatatcctgtcggattccggtaacgaaaaagtttattgggacgattatgtagtagaatcgtttgctactggtcttggtcttaaattagctccactgcttggtcgtggttcattcgctgagctatctcagtatgtaaatgactttaaatctattgtcaattactataatgaacttgttgacacgactgaccttgaacatgcaaataaacatgtgttcggtccacaggcttcttctgaaaccggtgtagctgaaggctatgttcttaaaccggttaatcctaaattctttaataacggtacccgtgtagctattaagtgtaagaattctaagttcagcgagaaagctaaatctgataagcctattaaagctaaggttgaactcactgatactgataagcgtgttctggaaatcttttccgagtatgtaacctggaaccgtgtaagtaacgttctgtctcatattggtactgtaactgccaaagattttggtcgagttatgggactgactatgaaagatatcattaacgaagcagctcgtgaaggtcatgacatgctattcgctgataatccttctgctgttaagaaagaactgactactttaattcaaaacactattcgtagcaaatggcatgaggttttagaataatgaggctggcgctgattggttcaagagaagcgccacgcagagttctgagtctaatgactataatcggtcaacgcctctcggaagaggggcatttttcatattcaggtggagctccgggttcagatgaagcgtggttggcgaaatacgataggtcaaattcttgtaggattattccttattctggcttttgtggccatgttcctgatacaggtgttgttgtatggtctgaattatcaaacgaagccaaaatcaaaagcatcattaaggcgagagaagttacgtcgtactgggatgaatgctcgaagatagtacagacactatttgcacggaattctatgcaggtattgggcctagaatgcactgagcctgtagataaggtattatattgggcgcctgaaaaaagatgtgggagtgtatctggagggacgagagtagctgttgatatagcccgtagacatggaatagaatgcgtcaacctctatgataagaatgtgtttaaatccctcgaggaggaatactccccgaggtttgacatatttagtttataacaaaaaggggagccgaagctccccataaattagtccgcaataagcttaggtaacttaacaccgagcagtacagacatcttacttcttcctgccatcttatccatatccgcagcattaatcacacgagcttcgtcctcgtccaatcctacagtatatgggttaactgacaatgcatatcgtaccagtaaagcaacagaaggctgcaagctagctgggtcaacaataactttaaatgcaccaacatgctcagggtcgtctaaatccaagccttcggtatatggcgcataaaataaagaacctacagtttccttcccaccaaattctgccttaacaccaacaataacgtaatcaaccggactgttagtatcacaataaagaggtaaaccgttattcagcataccgtatgcgttttccggaatacttccatcattcttctgtgttaaccaaccggaagctgcaagcaccgcagcacaacgagtagatgctactgcataagtaccagaataagaagtattacgttgaactgctgaattcatttcacaaatgaaacgatacagagtacgaccttgttccggagcagaatcttgtttagttaaatctaatacacccttatcggatacaccagctactttaaaccgagaagaaaccgtaatcaatgattgcaagatgtctttattaatgtcttctgccatttcagtagcaagtaaatcatcaataagttctggagcatcgaacccattagcttctaaatcttgagctaattctaccgttaaatctgttttaagcttacgtgatttaacctgggtctgccatttatcaattttaaaactggcttcggtgattgggtctgaatcgggtccttcaaatttttcagtgactgcagcatctgacaacatacgaatattattagctgctactgcttcagacacaattccaaattcatcggtttctgctgtatcggtaaacgggctatctttaagtactttaaagaccacattctgatatttgaacatatcgtctttattgaatgagtctttatttgccatagtgagttcttcaattgactcacgttctggcgccccgatttgacctgcataagttgcacccgtattaaacgtcaggtcaccattagggttaagatatttgataccatatagcgctgctacaggctgtttagtacgctgtgtagcaacaagatcggtatagattaatttagtagttgcgcgcgttaatgcaacgagattagggcgaccaattaagttgctactcgttgtagttgactcgcgcagaagttcgttgattttagccattgcgctttcctctgtggatttataagtttatttatatccattaaaacaactaaagggagcccgaaggctcccttattggtattagatacctttaacccatacacgacggaagtaagcattcttaccaacagagttgacgatagaaggcataccagaggtaatacgacctttcggctgttgagcagcagaatcggcgaacgggttaataccgataccgtaacgggttttgaaccccatgaccggttggaagttcttcggatcggaaccacgcagcggggtcagtgcaacatacggagcatagtagataccagcatccattt

SEQ ID NO: 782 - protein, 440 aa, Unknown
  Description of Unknown: Bacteriophage F387/08
MKKNKLIEKWQPLLENEALPEIVGASKKALIAKIFENQEADINQAPEYRDEKIAEAFGSFLSEAEIGGDHGYDAQNIAAGQTSGAVTQIGPAVMGMVRRAIPNLIAFDICGVQPMSNPTGQVFALRAVYGKDPLAAGAKEAFHPMYAPDAMFSGQGATEKFEAVKAGAALTVGDIVVHDFAQTGRAHLQVVEDFTVDAGATDAAKLDAAVTAALEAGKVVEIAEGMATSVAELQEAFNGSKDNPWNEMGFRIDKQTIEAKSRQLKAQYSIELAQDLRAVHGMDADAELSSILATEIMLEINREVVDWINYSAQVGKSGMTQTVGSKAGVFDFQDPIDIRGARWAGESFKALLFQIDKESAEIARQTGRGEGNFIIASRNVVNVLAAVDTNVSPAAQGLGRGYNTDTTKAVFAGVLGGRYRVYIDQYARQDYFTIGYKGAN

SEQ ID NO: 783 - protein, 270 aa, Unknown
  Description of Unknown: Bacteriophage F387/08
MLKELLMTEAKTIDASVALDSIFESVQLSPEAKANFSTVFEATVKKHAVALAESHIEKIAEKAEEKVEEEKEKAKEEAREELKEAASKYFDHIAAEWMAENQLAVDRGIKADLFESMFVGMKELFVEHNVVIPEESVDVVAEMEEELAEQKAETARLFEEVSKRDEYINYAQREYAIQEATRELTDTQKEKVVSLTEGMDYSDAFSTKLKAIVEMVQGSVEQSVTESADINTIDKEADGLNFTTEAVEETPATKTPSVMDAYVAQAARLS

SEQ ID NO: 784 - protein, 216 aa, Unknown
  Description of Unknown: Bacteriophage F387/08
MENLNEQLLIEHWGQPGDVIDGKPMLESIIVEGENESGLKPGLYIEGVFMQAEVVNRNKRLYPKRILETAVSRYIKEQVATRQALGELNHPPRANVDPMQAAIIIEDMWWKGNDVYGRARIIEGDHGPGDKLAANIRAGWIPGVSSRGLGSLKDSGKGYNIVQEGFRLTVGVDAVWGPSAPDAWVQPKQISENTSAQVANSADDAFMALAEKLKAL

SEQ ID NO: 785 - protein, 141 aa, Unknown
  Description of Unknown: Bacteriophage F387/08
MLILPENHELVIDTVEALLPEAQARFDKLSAALSKDDINKIVENLVVSEPDLAIALGSINESLQLNEFIVKHVDSKGTITRTKDRKTRERNAFQTTGLSKAKRRQIARKAVKSKRANPSAQTRGLRKRKKALKRRQALGLS

SEQ ID NO: 786 - protein, 74 aa, Unknown
  Description of Unknown: Bacteriophage F387/08
MENYISAIESRDLVAAKKAFGAIMAERTSGLIEERKKFIAASVMIEGEEPDEDEDEDDEDEDKSDKDEDDEEDE

SEQ ID NO: 787 - protein, 522 aa, Unknown
  Description of Unknown: Bacteriophage F387/08
MAFHILDLFAPWEKRDEAEYKQQINNDLESITAPKFDDGAREVESNENEIQYNSFNQMMFGSNEPGMKTTADLINTYRSLMNNYEVDNAVEEIVSDAVVYEDGHPVVSLDLDSTDFSQAIKDRILEEFNTVLTCLNFERKGADHFRRWYVDSRIFFHKIVNTKKMKDGIQELRRLDPRNLQFIREIVTADDAGTKIVKGYKEYFIYDTGKESYYADGRLYSAGTKIKIPRDAIVYAHSGLVDCSGQNIIGYLHRAVKPANQLKLLEDALVIYRITRAPDRRVFYIDTGNMPSRKAAAHMQHIMNTMKNRVVYDASTGKIKNQQHNMSMTEDYWLQRRDGKAVTEVDTLPGMSGMSDMDDVRYFRTALYMALRVPLSRMPDANNQGGVQFDAGTAITRDELDFAKFIRRLQHKFEEIMLDPLRTNLILKKVLSKDEWEDEINNIKIVFHKDSYFTELKDAEVMERRINMLTMAEPFIGKYISHKTAMKDFLQMSDEEIEQEAKQIELESKEARFQDQENEEDF

SEQ ID NO: 788 - protein, 195 aa, Unknown
  Description of Unknown: Bacteriophage F387/08 sequence
MFCTYLTIYTGNKLPRRYIGSTSVSRIIDENYHGSVKSKKYKDLWKSEQHDNPHLFKTRILNTYETREEASKAELELQIKYDVVKSSSYINMALAQPNGFFGMSTKGRKMSEESKEKQRHQRLGIKRPDHSIKLSGRKRPDHSKAMSGERNPMFGKEHPNKGKKINQPRMTCPVCGVESTRSAIMRYHKACLSSI

SEQ ID NO: 789 - protein, 163 aa, Unknown
  Description of Unknown: Bacteriophage F387/08
MELTDITRAFESGDFARPNLFEVEIPYLGRNFSFKCKAAPMPAGIVEKVPVGYMNRKINVAGDRTYDDWTVTIYNDDKHEVRKAIIAWQAQAHAQGNDISGMTPADYKKVATVRQFSRDGKTITNEHTITGLWPTNVGEVQMDWDSNNEIETFETTFAIDWWE

SEQ ID NO: 790 - protein, 657 aa, Unknown
  Description of Unknown: Bacteriophage F387/08
MPLVSPGIELKETSVQSTVVLNATGRAAIVGKFQWGPAYQVTQITNEVELVDMFGGPNNQTADYFMSAMNFLQYGNDLRTVRVVNREAAKNASPLVDNIEWTITTAGSNYEVGDKITVKYADQTVDDTGSVTEVDSDGKIKSVFIPTSKIIAYAKSINQYPDLGSSWTTTITSQSSGVSAVITLGKIISESTVLLTEHETAHEEMTKTEFQTALAQYKMPGIVAAYPGELGNQLEIEIVSKAAFDKGEQLTIYPSGGQRASTAKAVFGYGPQTDTQYAIIVRRDGAVVESAVLSTSRQDKDIYGNNIFMDDYFSKGSSRYVFATAQGWPEGFSGVIRLGGGVSANESVTAGDLIQGWDLFGDREALRVNLLIAGACAGETDEIASTVQKHVSSIADERQDCLALISPPRSTIVNIPLTRAVDNLIDWRQGDGTYDSANMNINTTYAAIDGNYKYQYDKYNDVNRWVPLAADIAGLCARTDDIAQPWMSPAGYRRGQILNCIKLAIEPRQAHRDRMYQAGINPVTGQGTGEGFILFGDKTATTVPTPFDRINVRRLFNMLKNNIGDSSKWQLFELNDNFTRSSFRMETSQYLAGIKALGGVYDFRVVCDTTNNTPAVIDRNEFVASFYIKPARSINYITLNFVATATGADFDELIGPQ

SEQ ID NO: 791 - protein, 612 aa, Unknown
  Description of Unknown: Bacteriophage F387/08
MEQTQPFNVLSDAHPLNDGKLTVIRHPSEMETKIENGVRFFKSQWDDKWYPEKFEDYLKLHGIVKIRLQGEDPAHFQTFKDKNNKRTRYMGLPNLKRANIKMQLTREIVAEWKKCRDDIVYFAETYCAITHIDYGTIKVQLRDYQRDMLEIMAAKRMTCCNLSRQLGKTTVVAIFLAHFVCFNKDKAVGILAHKGSMSAEVLDRTKQAIELLPDFLQPGIVEWNKGSIELDNGSSIGAYASSPDAVRGNSFAMIYIDECAFIPNFIDAWLAIQPVISSGRRSKIIITTTPSGLNHFYDIWTAAVEGKSGFTPYTAIWNSVKERLYNDEDMFDDGWQWSLQTISASSLEQFKQEHCAEFHGTSGTLISGMKLANMDWIEVTPDSHGFYKFKEAEADHKYIATLDSAEGRGQDYHALNIIDVTTSEWEQVGVLHSNTISHLILPDIVIKYLMEYNEAPIYIELNSTGVSVAKSLYMDLEYENVICDSIVDLGMKQTKRSKAVGCSALKDLIEKDKLIIHHRATVQEFRTFSEKGVSWAAEDGYHDDLIMSLVIFAWLTTQQKFADFVDKDEMRLASEVFKRELEDMNDDYAPVVFVDAVNSAEYAPQEHGLSFV

SEQ ID NO: 792 - protein, 169 aa, Unknown
  Description of Unknown: Bacteriophage F387/08
MSELQLDMAKLLDIEGIPGIEGQEIPVYEKLELVEVKSNPNDRKPDLEDDYSVVRKNMHFQQQMLMDAAKIFLETAKNADSPRHMEVFATLMGQMTTTNKEILKLHKEMKDITSEQVGTGKGANPQQGMNIQNATVFVGSTADMMDEFGDAYEAQEAREKIVNGTDSTV

SEQ ID NO: 793 - protein, 274 aa, Unknown
  Description of Unknown: Bacteriophage F387/08
MFGHWYNSSLRRYIVLLGDLFSHVQIARWREDTGLKYIKVPITYASKEKFLSQLGKWTAIQSTENKAKIETVLPRMNLHLVDMQYNAMYKTSQLNRTKSYKTPSKITSQYNPTPIKMIFELGIYTRNQDDMYQIIEQIVPYFQPHFNTTITELYDKDTSFNRDVRIVLQSFSQDEAVDGDNITRRRLEWSLMFEVNGWLYPPVAEIDGEIRTIYLDFFANSKELTPEGNFESVDSEVTPRDVQHENWDGSSKQTYSHDIPIPVNPEAPGPRGEK

SEQ ID NO: 794 - protein, 258 aa, Unknown
  Description of Unknown: Bacteriophage F387/08
MSTFDSRLFAKLEDYRGYNKTNETEILNPYVNFYNHRNSQTLADALSAEAIQMRGIEFYFLPREYNNPDLLFGEDPSSKFTKAWKFAAYLDSFEGYSGDNTFFSKFGMMVNDEVNLTINPNLFKHQTNNSEPKAGDLIYFPMDNSLFEINWVQPYDPFYQLGQNVQRKITAQKYIYSGEQLQPELQRNEGINIPEFSELDLEPIKNIDALADISDIQYAESDEINKEASEYVHPYYVNNGRGLESPPKADSFDDGFFE

SEQ ID NO: 795 - protein, 313 aa, Unknown
  Description of Unknown: Bacteriophage F387/08
MSYNTYNPKTLKDAILRRLGAPVINVEVTEDQIYDCIQRALELYGEYHFNGLNKGYQVFYIGKDEADNARFLNGVFDLRGRNVFAVTQIVRTNVGSLTSMDGNATYPWFTDFLMGMAGINGGMGSSCNKSYGPNAFGADLGYFTQLMTYWSMMQDLLAPLPDYWYNSDNEMLKVMGNFMKGDIIVCECWTKSFMNTDAMVGNTAGYGFAGPQTADHWGLGDRYQNPDLRNNGQYAGEGNTNREGAYNNRWVKDYATALTKKLWGEILFKHQGLQLAGGVTVDGQTLKVEAQEEIERLREELDLLDPGCPILLG

SEQ ID NO: 796 - protein, 588 aa, Unknown
  Description of Unknown: Bacteriophage F387/08
MTKLVDSLPFVDGIPDDFQQRINWIKNTEPLNGASTRYGNDGELNRASVQIQKNVVQVHNDLNNVGTAVENIQVDVDQIKKSLEITGSSDAIEQVYINKKNIEKHDGQILKLEEDTEKLRTDLDFLEEDVGVYDSSKDDYYRTVRDNIVWVKREIGAYPGQDINGQPKQDSPGSGMKYRIINNASAIVKHDERIQALEDAYNDSDVGSLTIEVNDLRKEVGPKSGATSASIYARLVNNADAISAANNEIFAINQAIDFTNPVKIGARTTRLENDYRIVDATLNFAQTGLVPRVNNIDARLGSSDKPDTIEGKISSLSTDQGYISDVVGRDTSSGLQGQVAWINQQVGIVPSEQPIPPGSILARMTNVEGMQNSQQSAIQDIQVELGNNNEGLKGSVFTLQTQMNGDFSSENPVQRDGVYATVVELQDKFVTAVTDVEQAGAYLRKQGEWFKKPSSIGEFSKEDFTVDLSSDALVNPNSLVAAPFNAGIRIVDDIVVDDDGVFCVETDTVIEASDSDKGVKIVILVNNIEVFSYGLGVKAVTGEQLIKTKKLIEFSSGDAIKIVYRAASEESQVLVKIKSLDITIHPAV

SEQ ID NO: 797 - protein, 448 aa, Unknown
  Description of Unknown: Bacteriophage F387/08
MAQNNYNHYSDLAKYTIFDPTNTQWPVAIKDVQSALELIGSWARTDTGLPVASPTVAGVIRTATQAEVDAGTIGNAAVTPATLKSTVTRPEATTTVLGLTRYATNTEAAALTAGNRTITAAALGHVFKTVKAQENVDGTVRLTTAAQAQAGTDETTAVTPKRVVEMIGKFSVSPPSYTSATESNLGLVRVATQAQVAAGAVHDGYAVTPKTFMASKASDSVFGIVKFAKDSDVASATSNNLAVTPKSLQALKSTKDKYGLTRLSGSPTTDASLAAAATDAVFKTRRINGKTLDNDITITNNDINCYTRQESDGRYMPAGTRVGNVTWVEGQSWISRGATFTCNAPWEASSRLALNVNVKFERNNDGYDNRIFRFVVIVNGSQWGGELTLNIENTKGGRNGHSWRFEAYASSNFFFNNIPPNATVQIRPTEDSRIIFYDCMLTFCTNRP

SEQ ID NO: 798 - protein, 223 aa, Unknown
  Description of Unknown: Bacteriophage F387/08
MTIETKTREGAKVNSRLAAFSEYRVDPQNIAVGNTAPIGSLTFEQMDLGVWYPNTEAAINDLMSLQSAEIGTIICNDTGISPQPAQQITRATFSGVVALEPKEDGSVGDPVIIHILGLPIRIANGDDFAAVATRWYDKVKELEAVGKVVQQVTQSPATPQYVDIIHLDYQNHNFETYKKYGLTVEFTITSPAKAGYGQWDAIGNESKTFGANTFTFHYFRRMG

SEQ ID NO: 799 - protein, 607 aa, Unknown
  Description of Unknown: Bacteriophage F387/08
MKQNLIVGQSVDDGSGDYLRKGGLKINNNFDDLYSELGDGSVPFAAGAWKTFKASPTGTTLNAKFGQAFAINTQAARVNVQLPKGTANDYNKVIKLRDVWSTWRLSPITVIPAQGDTLKGSASPKIFNTNFQDLELVYCAPGRWEYIENKTVDKLTNGNLSTVAKKSIIATAGQTDFLNIFDGVEYNEDSLNVYRRGNILYYGETSVMDKANADYGSPGTVAGQLVELNGKDIRLKVPCVEGEVITFETFLDGIGVYRSSYNKLAIQIRDSAQTTSQTIPGSIIVDNLTALRRITLDDMGVLPGVGVNPNSLEISLNGKELLEAGTAGLPLFYCEGAEGGYAEDCINNGGQWVNSNQDYRLEFDSTGTNVEAIIFGEAFEDKDLLTVRWFNNNIGTTMDIDDIMAETDQVYMNAEQLVTLKNRIEYTNYDEPNQKNMRPVADDIMIKVNNIAAFFDVIYPIGTIYENAHNHANPADYMGFGVWKLYSQGRVTAGWNNDSSDPYFSRNNNNLNENGQPSLTAGGTVGDLTFTLGKEHIPELMSRDKVLISDPEHGSVVIGGCQLDPDAQGPGYSKYREDTVAVNNGVVPNDITKIQPTITVYRWIRVG

SEQ ID NO: 800 - protein, 303 aa, Unknown
  Description of Unknown: Bacteriophage F387/08
MYTDKGKKIIDVGEIGNASTGDILYDGGVKINDNFDAIYNAFADQRLFAAGGGALNQKIHATSYYQKIKFGDANSAGTVPMGSCIDADCSEGAVQIRLSKGKAGEAVFVVNSNGSASKARSIKITTNGEGVADAFKDGSRELIINTPRCRIELWCVEVKANGAAVWDYSISSMFGSTYSPLEATYNLTSSPINIRLGYNDDYSTVKLLLSFSANPGGQTIKRQSSEVMLMIDPTITSSAPNGRVFDTEYAVLRSGESSENEKMYSISYSINAQKDLICTASTSYGNARLAVKVIATQTVGVSQ

SEQ ID NO: 801 - protein, 341 aa, Unknown
  Description of Unknown: Bacteriophage F387/08
MSNSTRASSTRSTIYRAIITSKFRTEKMYTFYKSIGPGTDQNTLYVSFGKSTPWSDNESEPGFAPPYPADNGDGVVDVWTNMMGAVKIESSMLDCVVPRRDWGDTRYPNPRTFLIGDIVVANSAPYNRTDAGFGWMVYRCIDVPKDGMCSIGNLTSKEECIKLGGKWTPSTISGSAPRGRGDANGTVDLGDGYLWEYLYEIPADVSINRCTNEYIVVPWPEEIEESPARWGFQNNLTWQQNDFNLIYRMKCNTIRFKAYLDAVYFPEFSLPGNTGFRQLSIITNPLEVKPMPNSPNVKAEKGWYSASGLERQSGEMIYMENRQPIIRSMDQTEELNLIFEF

SEQ ID NO: 802 - protein, 1032 aa, Unknown
  Description of Unknown: Bacteriophage F387/08
MTIAPFVTSLRIHKLSANQVNIRWDDVGANFYYFVELAETRNRAGEIIPADNLSWSSLGYTADNDWFEQNRIEPLTYYKMRVQTTSAGFEPSEWVETEEFQTFEENAYTFEHMQEFSLVKEFIKQKFSLNNMSYVNFNTSAMMASLMTESFQFSPEYSHLSAIENFVVGESGYHEIQGPIEAVCVDKNRTMLGEIDGILYLFERFQHMVKVSNDKGQNWQYVQLFNDRVGNPVSRVVIYQSSTTSYVLGYDKIFYGRKSSDVRWSSNEVKFSDNEVTFAKLGDQLKLGFEVELFGTYASLPADVTKYAEAFTCNDDHLYVVAKDTVRRVKLKDAPIDTDPLSPTFGEKVFEKEASHITGNPKSVCFKMDSVGGKIFALITGEVKTLGLDPTDPRNVVDSATKGVYVYQEDTNTWKRVFGNTDEEKRRIEHLWTSMSTDGKEIFFSSANFKTTEYTQDIELETKYPELISTAVKNVNPIQYHSDKHYHMMSFRADEFSRWETFVPGPMRFYAEPWFVWMAREGNRCWISTADHAVVIYNDILYQKRVDAAAQGTTERVLSEVWDKGDATFYCPPVSFNGFLQYASGIMFHEPDGKLIGYYAFDYRVRDQVTLNWKPTDVMFKAFLQNQTREEDWTPEHTPGLRDPDLRPYLTKMMPDSYLLQDSNFEQFCKYYLQFLSDGNGTHYNSLVNLVKNKYPREENAWEYLWSEVYKRNIYLSKDARDAVVRFFEARKNDFYATKGIEDSYKFLFKLLYNEDVEIDIESKNTTEYDIIVESTNISDDLVGRTIYTASGRSNVTYIEREYRDGRLLWRITIHNLSGRFIEGQEIKSERTDFEGIIVQGVRGKDMLSNNIDYINRSRSYYVMKIKSQLPTSRFRDDVLRFVHPVGFGFIGITLLTMFINSGLNMKHVETIINKLKNYKWDAGLPSVYPDRVAIIASDDTIERDPITNEPRYSSRAQAGEPFPLPANYNQENNNSIIAGQNPGQRRKPLSPTFDQSAVTFANYRDLVNQRLKDDAGNPRDPENPTQVKIDE

SEQ ID NO: 803 - protein, 652 aa, Unknown
  Description of Unknown: Bacteriophage F387/08
MAIKEPLNYQLTRTANAIPDAFTGATFDEIKNQLINWLSGQKEFQDFDFAGSRLNVLLDLLAYNTLYIQQFSNTALYESFIGTANLRSSVVQAAQQNGYLPSSKSAATASIMLEVTHMNPSSTLRVVIPRGTKFLAYSKSDKANPYNFVVTENVVAIRDNDQKYWPIVNLAQGRIIRTQLSYDPKKPIVIRDQSIDRKQVKLWVDGAEWTNWTDRSMVHASSISTIYYMRETVDGNTEFFFGEGVAEASVAGGVLESNFIGGLKPTKGAQVVIEYIRTDGEAANGATEFSYADTLQYIVVNRIIENWSDSPDYVGADGGGEPEDIERIRELAQIKRESQMRCVSKTDYESFVSSRFGSIVQAVQCFTDQDKPGYAFIAIKPKSGLQLTAVQREDIQDYLKPFCLAPITPSVMSPDYLFIRHNIKASYALNKLQESEQWLQSKIIDSINRYYVDEVEMFNKNFSKSKLLTYIDDTDHSIIGSSVDIQMVREIVNYFTLPSAGIKYYNTITPRTLRSGDLVFTVTPTAEPYSVNIVGTDPDKNGKGNMVIGPFKPGDIKENTHIQPYTENDFDRTTIGERTRWYKIGEVDYYGDNIYWSLGAIGADPLQFEDQSIELYSTPTQDIVFARDGTLIVFENDLRPQYTTIKLEPITQ

SEQ ID NO: 804 - protein, 97 aa, Unknown
  Description of Unknown: Bacteriophage F387/08
MAGLSFNKCLTAGHSAYPPTEVNATQSKVFTGGIAVLVDGDSITPHTKTVDPHDTHGGVVQPRTSKVFVTGKKAVQMADPISCGDTVAQSSSKVFIH

SEQ ID NO: 805 - protein, 167 aa, Unknown
  Description of Unknown: Bacteriophage F387/08
MADILPINTTLREVIEGEYVEQYFTAQLSTNETLKSINIIDYQPVSDISVSETHYKGNYNSVFTFGNDVLKYREGDELKSASAWEDLPNPKTADLYLWKAPRTLEKTFTYTVEIIYTVTEESSGGSSGGSSAPIITEHKKQKIYSQTVKGNWSRWGDQLRAYVYAGN

SEQ ID NO: 806 - protein, 576 aa, Unknown
  Description of Unknown: Bacteriophage F387/08
MIEMNDSLKWFTGVVEDRQDPLKQGRVRVRVYGLHPFEKVQGAITGLPTEDLPWMSVIQPTNSAGISGVGSSITGMVEGTSVFGLWLDEFKTAGLVIGTYSAHRKTKPNYTEGFSDPTGQYPRQVGSDTNPLVQGDETGYSAIPNIIQDRNLDIGINPDDADLSDIPEDPNPAITITDMLNRDEGLRLKVYWDTEGYPTVGIGHLIMAQKVRDMSVINKTLSNQVGRTVTGNPGIITMDEAVALFKKDRDKMLSDIKTNSRVGPVYAKVNKSRQMALENMSFQMGVGGLAKFGKMLDAMLIGDWKTAYTEARNSVWFNQTKGRASRVSMIILTGNMESYGVPAPKPEGKNLSAAYVEPKSGGNPEDPWTPEDSRILFKEPESSYNGQYPYVHTMETESGHIQEFDDTPGYERYRIVHPTGSYEEVAPDGRRTRKTVADLYDMTQGDGNILISGDKKVNVGGNETYYNMYNRRQQIDGDNTLYVRGNETKTIEGNGTIFVKGNIKIVVEGNADIQVNGDATTKVDGNHDVTVGGNLTWQVAGTVNWNVGGAWTETMASMSSIAQGQYTVDGSRIDVG

SEQ ID NO: 807 - protein, 212 aa, Unknown
  Description of Unknown: Bacteriophage F387/08
MLFSFFSPIDYSAKTVKGAKAKAIPTADIFRNYRKYFDTVAENYLLQTYYISGAPRPEELAYILYGNSQLYWILLMCNNVYDPFRDWIKTQDACYQFAQQKYADVGGDQILYHVDAYGNRYYNLEQYPENSGVWYDKGDFNHQYPQYTGALAGVDIYEDSIIENEKLRQINIINPSDIEAFLSDIIREMEKAPDSEYESGRYKSQTTIGEVL

SEQ ID NO: 808 - protein, 149 aa, Unknown
  Description of Unknown: Bacteriophage F387/08
MAYSGKFMPQNLHKYKGDFRKITYRSTWEQYMMRWLDNHPDVVQWNSEEVVIPYFSNADGKKRRYFMDFWAKFSNGQQFFFEVKPKKETRPPVKPTKLTTSAKKRYIDEIYTWSVNVDKWKAAQATASKMGIEFRLITEDSLKKLGWKG

SEQ ID NO: 809 - protein, 275 aa, Unknown
  Description of Unknown: Bacteriophage F387/08
MAIFEFITEAAESPKAKSRSENQWVALGVEYSAARKKGMTSKSFAESKGINPATFSKAMARHASRIKTAIKVAEIEKKPANKMTKQERALVMVNSFRSSIKDKIRNEGAAVNNKSAKWFAETIKKNIRGHSVTKPQPGKLYAYMYDAKHKDTLPFWDKFPLIVYLGLGKQGTTTLMYGLNLHYIPPKARQQFLEELLKQYANTPVISNKTRLKINWSQVKGFAGADKMIKAYIPGNIKGALIEIKPADWANVVMLPLQQFMSKGKRYSATSVWKS

SEQ ID NO: 810 - protein, 200 aa, Unknown
  Description of Unknown: Bacteriophage F387/08
MSTGLFNQTNTTNFILEVPDGGLTQAFKANLQTAVVPGIHIPATDTVGSPQGMHRAKLPGSTFEFDAVPVRFLVDENLDSWVQMYKWMLSCQNYIDRDKSGWNNGGEGFPGAVLMHVLDNDKHDIVLTVRYIGGWVSDLSEIEYSLTEESDPAMVCVATLQYKYIEVEKDGIIITGRPSVNDTRESQYQQKVMGMHPSMR

SEQ ID NO: 811 - protein, 247 aa, Unknown
  Description of Unknown: Bacteriophage F387/08
LKLLFLIGKKRSGKDTTADYIMDNYNATKHQLAGPIKDALADAMLTEWYRDTSREFPRITRSMIEGIDYDREQDLNLSTKDVIRIMANAIEYVHHDLPLPGVVYDNKRKILDGDTMEVIRKVVINKPVEPWSIRRLMQTLGTDIVCDKLDRMYWVKRFTLVMADTFGDYDYFIVPDTRQDHELDVARAMGATVIHVVRPEQEGSKKDTHVTERGLPIREGDIVITNDGSLEELYSKINTILGIQNDY

SEQ ID NO: 812 - protein, 77 aa, Unknown
  Description of Unknown: Bacteriophage F387/08
MTTEQLQAQVDTLKVRVFDLSETIQGLSALRAQYEEVLQKLIAVSGVEIGEDGQVKLDDLVAKIEAQFAEETTEESE

SEQ ID NO: 813 - protein, 151 aa, Unknown
  Description of Unknown: Bacteriophage F387/08
MKFSDFSTGLYVAAKFSEKTLDAIEDLQRELKVPNPVPRHKIHTTICYSRVHVPYVCASGSFEVATSGKLEVWDTQDGRTLVLKLDSEYLKFRHQYARALGATHDFPDYSPHITLSYNVGPAHFEGEVQVPVVLDREYQEPLKLNWSEDLK

SEQ ID NO: 814 - protein, 127 aa, Unknown
  Description of Unknown: Bacteriophage F387/08
MKSYQEFLMETEALLESTLPDYMIVKSFNVKNGYVIKFPIASVKPGADMSNDAGISVKVNVQFINYNSAKKSYDAKMTFSGGEKVVKNIKLDYDESAESVKKRFGDKLVKSIMVHPTFKRDFTELYK

SEQ ID NO: 815 - protein, 59 aa, Unknown
  Description of Unknown: Bacteriophage F387/08
MKRCELIRNVASAICLTAVGTSIFGAIFMGAKEIMVVLVAAFLMGSISFIMDKISHEKD

SEQ ID NO: 816 - protein, 59 aa, Unknown
  Description of Unknown: Bacteriophage F387/08
MKKIKQWFVKTYDLGREEVTKYDYVTLGVGLGALLAALHSSLLAIAVLLILAHYSWKRK

SEQ ID NO: 817 - protein, 61 aa, Unknown
  Description of Unknown: Bacteriophage F387/08
MYALLTWSNYYPAPGSDQIRGVYSTVEECYEALQGTYQDYFEILNSRFETVAKGSTEAYKD

SEQ ID NO: 818 - protein, 116 aa, Unknown
  Description of Unknown: Bacteriophage F387/08
MNIRAAFNTFYQENYKLLSHEYYDAQGVPIPSDLVTPKHVKTDSLDNEIQPGDLVSYYCGGSLSAASVGILLGFTPKGYRVVPFHTSPIPEHRVLLSHMDSPHRVFLVKSKSSPIV

SEQ ID NO: 819 - RNA, 84 nt, Unknown
  Description of Unknown: Bacteriophage F387/08
ggggaguuagaccguagggguagcgggacagacuguaaaucuguugcucaaaaggcucgagugguucgacuccauuacucccca

SEQ ID NO: 820 - RNA, 74 nt, Unknown
  Description of Unknown: Bacteriophage F387/08
gggauacuagcucaguugguuagagcaccggacuuuuaauccggguguacgaaguucgaaucuucgguguccca

SEQ ID NO: 821 - RNA, 82 nt, Unknown
  Description of Unknown: Bacteriophage F387/08
gggucguuggcugagaggguaagcgacggacuguuaauccgugucagaaaugacuaggcagguucgauaccugcacggcccg

SEQ ID NO: 822 - RNA, 74 nt, Unknown
  Description of Unknown: Bacteriophage F387/08
agugcuguagucgagaugguuaagacacuccccugucacgggagagaucgcggguucgacacccgucagcacug

SEQ ID NO: 823 - protein, 132 aa, Unknown
  Description of Unknown: Bacteriophage F387/08
LTFDEWLSWWKATGKYHLRGRASDNYCMCRKGDVGPYSLDNIYCATNAQNAKDAGANGRIISTGFTGHNHSDETKIKISENHAHKLNADEISLRIDLYNSIDFTQRGALVKFANKLGISHTQARKFINKFIK

SEQ ID NO: 824 - RNA, 74 nt, Unknown
  Description of Unknown: Bacteriophage F387/08
ugcggaguaacuucaguugguagaauguugggcucauaucccgacacgcgcagguucgaguccugccuccgccu

SEQ ID NO: 825 - RNA, 72 nt, Unknown
  Description of Unknown: Bacteriophage F387/08
ugaaucauagccaaguugguaaggcaguagguuuugauccuacgaucccugguucgaguccaggugguucag

SEQ ID NO: 826 - protein, 57 aa, Unknown
  Description of Unknown: Bacteriophage F387/08
MMDGVNIDVVVVQLVEPEVVILDVTDSNSVGHPNNEGMVEKYTARKTLWLSLSELCL

SEQ ID NO: 827 - RNA, 73 nt, Unknown
  Description of Unknown: Bacteriophage F387/08
guggucguaguucaguugguagaacccgagguugugauccucgaugucacggauucgaauuccgucggccacc

SEQ ID NO: 828 - RNA, 82 nt, Unknown
  Description of Unknown: Bacteriophage F387/08
ggagaguagcgcuagugguagcaaaccggacuugaaauccgggccaccggaaacggugaggguucaacuccuuuacucuccg

SEQ ID NO: 829 - RNA, 73 nt, Unknown
  Description of Unknown: Bacteriophage F387/08
gggaguauagcucauuugguagagcucucgaccgauaaucgagcggugacugguucgaguccaguuacuccca

SEQ ID NO: 830 - RNA, 72 nt, Unknown
  Description of Unknown: Bacteriophage F387/08
agguucuuaguauaauggcuauuaugcugggcuccaaacccagugaugaggguucgauuccuucagggccug

SEQ ID NO: 831 - RNA, 72 nt, Unknown
  Description of Unknown: Bacteriophage F387/08
gcauccaucguauagcggauauuaugucuggcuuccacccagaagaugggaguucgauucucccuggaugcu

SEQ ID NO: 832 - RNA, 74 nt, Unknown
  Description of Unknown: Bacteriophage F387/08
cuccguauagcucagccugguagagcgcuccauuugggauggagaggucgaauguucgagucauucuauggaga

SEQ ID NO: 833 - protein, 50 aa, Unknown
  Description of Unknown: Bacteriophage F387/08
MKYYGFKTSHFGKAYRTENIDRRRAYYESLHKAGRSRARQEGQKQAKEIE

SEQ ID NO: 834 - protein, 121 aa, Unknown
  Description of Unknown: Bacteriophage F387/08
MNIFIGVANNVNAITVKLQWNRPTNFALGLCKSERDLMLHADFAYTFDERKGMWVWIKCRYEALIKYEYFSERDIQEVIAYHSGCKVSKLRQVIPFTNASNVEELITDFKRIYQAKYDERF

SEQ ID NO: 835 - protein, 77 aa, Unknown
  Description of Unknown: Bacteriophage F387/08
MMKDSKGRDVQVGDIVFYGERTYNKGGRGSMRCGRITDIASGLAKVDNDYVAMRSKSFVKVSPMFATMWENGTIFEI

SEQ ID NO: 836 - protein, 74 aa, Unknown
  Description of Unknown: Bacteriophage F387/08
MKRIALIVDQEAMFAATGKFHPVSKFVARSEKIVGLVETVAGDVIVSIKTSEISPVVKVAVENDFWEVADFMCE

SEQ ID NO: 837 - RNA, 74 nt, Unknown
  Description of Unknown: Bacteriophage F387/08
ggcccuguagcucaauugguagagcguuccccucauaagggauugguugcauguucgagucuuugccaggguca

SEQ ID NO: 838 - protein, 66 aa, Unknown
  Description of Unknown: Bacteriophage F387/08
MMRLVKVVVEESEYMGDSRMIEEFVTVEADSESEIVDKVYRHFDNMSDSYGTMYSIYRLDVIVHIN

SEQ ID NO: 839 - protein, 185 aa, Unknown
  Description of Unknown: Bacteriophage F387/08
MHIRFGQVIPKGLAMAITTWENDADRYSTQMVYGLEKEEINQVIHVLEWFSSNGRRGEYLGNNDYNHEAILEKLHTEQKYVTPEFSKKFFGVDVPAYDCTDEEFDAYLDNHYSCSNEVMYAIQAWLGNPIEYDYDFMRVFEKVEIFDIKEEIRIPDAPVAFHVGITYKQKESPLKVDWLKYVKEK

SEQ ID NO: 840 - protein, 149 aa, Unknown
  Description of Unknown: Bacteriophage F387/08
MDIGSGSSYPSCALSNFAPHKFIYDGVECASMEGFLQSLKFSSPEMQAHVCTLVGKSAKFKGKKKRWWPTQTLYWKGVPIHRASEAYQNLLTGAYDALSKNEGFRKALAATRNATLTHSMGKNKISETILTEREFCNQLYRLRNAINNQ

SEQ ID NO: 841 - RNA, 84 nt, Unknown
  Description of Unknown: Bacteriophage F387/08
gcgucgauguuggaauugguagacaaaggagacuuaaaaucucccgggauuaaacccguacgaguucgagucucguucgacgca

SEQ ID NO: 842 - DNA, 73 bp, Unknown
  Description of Unknown: Bacteriophage F387/08
  Description of Unknown: sequence
gcccuuauaguguaauggauagcacacgaucguuctaaggucgguaguccggguucgaguccuggugggggua

SEQ ID NO: 843 - RNA, 73 nt, Unknown
  Description of Unknown: Bacteriophage F387/08
  Description of Unknown: sequence
gccgauuuagcucaguugguagagcgcuucacuuguaaugaagaugccgcggguucgacuccugcaaucggca

SEQ ID NO: 844 - protein, 194 aa, Unknown
  Description of Unknown: Bacteriophage F387/08
MKFKDFLTEEELFEAAPGRMTKSKWRDALVLVPRGERHDFSKFAASVEKIYGIGISDPKDYAKVAAAFESLGGKVTTPARGASPAQAPAAKPAPVKAKPKNIPGLKISGDHGDIIGSGELFKAIDKALPLVRDNGPLYKAVQFYFDNLWKYRESQGAKPSARETQHIGEVKTLLAKLNHHLVELSRQTELSYNV

SEQ ID NO: 845 - protein, 96 aa, Unknown
  Description of Unknown: Bacteriophage F387/08
MSKFNFIQIERGYNNYGTPDRYRAIWIKGEHEHAVFNVAETRELKDLIKHVRKDWPAVEEYYVRVYHEEAPTETVQIKFAKTASALTKRIEAVINC

SEQ ID NO: 846 - protein, 197 aa, Unknown
  Description of Unknown: Bacteriophage F387/08
MSILKKLVEFIRSKFGTFVAQNTSVEDQYTMAANRIIDEITKLRTTHVKSVNEEKRLLKLADEKDQAGASKEREIRRLMAEGMNVETHAKLGLLYRRTAKALRDKAAEYKEMRAQIEETVVKLDDQRLDLAVKLEYIRETRNASALGITSADDVIEIAELAKVDVQDIMMKVETFSGTQPGIETTTADVQEYLESLK

SEQ ID NO: 847 - protein, 186 aa, Unknown
  Description of Unknown: Bacteriophage F387/08
MATPQIKELIAAGFPTEITDILGKFAYPDTRPENWKTRYNGYNTTVLPRAIVLKDYSKLKNLISNISSISDGVKLVDIFALRYGIYSFNDSPSNLKSARTNAGEYSTSGSTTYTIVIEIIHNKNSYRLGINLVKYVTSQDDYSNYLNYCVNELPSKVMSMFDSNNMVGKQLIIDEFIKYCRERVQK

SEQ ID NO: 848 - protein, 119 aa, Unknown
  Description of Unknown: Bacteriophage F387/08
MSNLYLPSEPPVYNYVYKFDQIDYALVPGIGATVGAMCTFAAIDIMHLTDITPAVLFGILLAWWGTSLLIMGLIECSRWVKWSRNNYKRKAEWKEQCKNLTLEWNRKKSFEFIKEVRRK

SEQ ID NO: 849 - protein, 98 aa, Unknown
  Description of Unknown: Bacteriophage F387/08
MNEYKPDGFWNQDGLAPGFGIVTWLLYCAFVIVGGTFFGLNVSEFMIMLLFLGVFAFSLMWMLIIALINCCTFLAYRMKYKKWKEKEDFNTWIRSCRK

SEQ ID NO: 850 - protein, 108 aa, Unknown
  Description of Unknown: Bacteriophage F387/08
MIKTCYRGMIKSDEPGYFFLFLLIWFSLSAFVGFGTFWGFYFFSPVFGDALYYIGWMSGVGTWFAILARWLQFVSQRQRGVFDKPKVKKEKSKDDSRSETLSWIKEMK

SEQ ID NO: 851 - protein, 78 aa, Unknown
  Description of Unknown: Bacteriophage F387/08
MAVAVHVKFENGDTRLLCYSDNESLSGIEISLKEELLGINGPICDFSVEGSDNCNDDLESMVYTAMEDILEESWNECQ

SEQ ID NO: 852 - protein, 150 aa, Unknown
  Description of Unknown: Bacteriophage F387/08
MPMKELSAGILFFTDDKRLLMGRMTNTYVQGRGSRWDIPKGHVEPGETPKEAAIRECKEETGFTEFDQDLLYDLGRHDYASNKDIHLFGYMLPVSPEMFRNCRCTAYHKDENGINFPEIDAFALIKPSQWKYVMGPSLYKIMTQMYSTAQ

SEQ ID NO: 853 - protein, 102 aa, Unknown
  Description of Unknown: Bacteriophage F387/08
MEEAVELGIPHIYKHELRFIHDGKWISIFHPRDKMSRILMKSRYVFSDSEYIKSAYYIAEQLYPGFSELPEDDKRDYVWWKDKWTPYEKCSLELFIAKCRAK

SEQ ID NO: 854 - protein, 164 aa, Unknown
  Description of Unknown: Bacteriophage F387/08
MDIFGMLRIDEGYDSKIYKDSEGYWTIGIGHLLTKDPSKSLAISNLDKLVGRSTGGQITQAEAEVIFAKDVEKAIKGIVANATLSPVYNILDDVRRAALINMVFQMGVSGVAGFPASMKLLLAKKWDAAAKELANSRWYRQTPNRARRVIETMRTGTWAAYQGK

SEQ ID NO: 855 - protein, 159 aa, Unknown
  Description of Unknown: Bacteriophage F387/08
MKTYQEFLNESRLATVGVMTESVGSNLLKFKKGQKMTATLEDGTEIEMDVVGYNYVVDGKLYNKSHAKFDSFDDFVSSVEDESSRKAVASGDARSLMAHGHMRIKSKQNKPGEDNFALVGYQSGKTSNGYQRTVTMYMRNGKIAFVNDRGAIRYAKSIK

SEQ ID NO: 856 - protein, 100 aa, Unknown
  Description of Unknown: Bacteriophage F387/08
MKTYKEFITEARVSAGKLEAAINKKAHSFHDLSDKDRKKLVSLYIDKERILALPGANEGKQAKPLNAVEKKIDNFASKFGMSMDDLQQAAIEAAKVIKGK

SEQ ID NO: 857 - protein, 177 aa, Unknown
  Description of Unknown: Bacteriophage F387/08
MKYLTPIYLTLMHAFKDAADRRLNNPNYSFYEPSCLMREYGTLRLDGGRQTGKTAALCQFATDWLLEDGSVIILSTRYTQSSELMEGILREYNSSHLINKLPANEIAKSIVPMTIREFLSNDSSYKFRGRKLGRALIIIEEPMKVPDMMKFYDMYQEAIRWSMPNDTLPLFFVIGMQ

SEQ ID NO: 858 - protein, 103 aa, Unknown
  Description of Unknown: Bacteriophage F387/08
MMTQTEIVDMITVMENTGFADMKQLITMVTAGNLLEYKRYKFLSGPFKGAEFISNAPNTKWMNRYPNFRIEFISGKLKGVISSSLITYDQRIQEKTMQWLKLL

SEQ ID NO: 859 - protein, 114 aa, Unknown
  Description of Unknown: Bacteriophage F387/08
MAEIVIRCPPHLVESFCEWFSNSGEQDFYEAHQNGTWNETTKQWEEATTYIGTRGYGVNEPIEIVEYDKETDEEVTYHEDKITYLEAAAKFHSDEWNKMSVITAYMRGWNKESN

SEQ ID NO: 860 - protein, 120 aa, Unknown
  Description of Unknown: Bacteriophage F387/08
MKAYQILEGELKGTIYIEDGDDARVIVSKVLKEDTITDAETFYGYKAREVEIEYQPTVKIEGGQHLNVNVLRRETLLDAVEHPEKYPQLTIRVSGYAVRFNSLTPEQQRDVIARTFTEAL

SEQ ID NO: 861 - protein, 93 aa, Unknown
  Description of Unknown: Bacteriophage F387/08
MAIEDIKGYKPHTDEKIGKVNAIKDAEIRLGLIFKALEEEHVEKYMNLDVSTMSDKEFDLAHERITQIRNAIQHLKEASMWACRSVFQPEEKY

SEQ ID NO: 862 - protein, 152 aa, Unknown
  Description of Unknown: Bacteriophage F387/08
MSTNPEVFIRRTKLRRKFEEAFRSLNLSVRARAKAEGKEPFFTKYSDHLLDRAIQREIDEEYVFSVLSKIPNHLKEINEFLAMPWLPIDPKDIDENIEYKPMRLEITDGNLWLGFTMDIPRPGKGPSIKCRMAFVNDKRLKGKISTKVIHIN

SEQ ID NO: 863 - protein, 181 aa, Unknown
  Description of Unknown: Bacteriophage F387/08
MKKALIGLMALCSTAFGSEPTFSNVQLDNLHYAYNFGEQYQKSGKEKSPHNRYDNNGLGYIMAAISWKESSAGANLKAGKGHHSYGVFQNYLPTVKARAKLEGKNLSDSEIRKMLKSRQNSAEWAYIELSYWLNIHNGNMRKALASYNAGWNVKRGNSYASDVLEKANFLKKHKMLHTKVE

SEQ ID NO: 864 - protein, 106 aa, Unknown
  Description of Unknown: Bacteriophage F387/08
MVKYAALLGLVLAFSANAENSMTDSLRIAKTFCNTNSECVDILALELDSAFSDGVKDSRSPAQWTTLINRKAKSMKDLCVNAPNENICLMYRDQLMARYMSGLSSK

SEQ ID NO: 865 - protein, 130 aa, Unknown
  Description of Unknown: Bacteriophage F387/08
MKKAAILLCCAFSVNAWEKLPGYPETVLAAQGTKIESNGPFKNNIEIAFVPSSRKLLMSFYNYQDKDDQVIVPLVEYNARGCGMQSDGVSVDGVMHPKEQGVLNPILNCNNAIFLRVYNNLNEYATYKIP

SEQ ID NO: 866 - protein, 155 aa, Unknown
  Description of Unknown: Bacteriophage F387/08
MITGYIKGNIVELFMKHECDIAHGCNCFTTMGAGVAGQLAKAYPPILDIDIDEDRYYDNNLAKLGTHTRAIHKKGTAYCYNLYTQYAPGPNVDYGAIFNAFHELNSGRIVYNRPLYIPKIGAGIAGGDWELIEKLINLATPDIDIMVVEYEEAKS

SEQ ID NO: 867 - protein, 55 aa, Unknown
  Description of Unknown: Bacteriophage F387/08
MITEEQKTKLWQLIDDYAGAEQVVAISAIYGNGLPEEYDELIRSKNAISDFMETL

SEQ ID NO: 868 - protein, 199 aa, Unknown
  Description of Unknown: Bacteriophage F387/08
MAQLYFNYASMNAGKSANLLTAAHNYKERGMGTLILKPAIDTRDSATEVTSRIGLRHEANTVDESIDILEFFKWAQTQRDIHCVFVDEAQFLTAEHVLQLCKIVDLYDVPVMAYGLRTDFRGELFEGSKALLSVADKLVELKGVCHCGRKATMVARIDENGNAITDGEVVELGGEDKYVSLCRKHWCELVGVYNEAKNV

SEQ ID NO: 869 - protein, 64 aa, Unknown
  Description of Unknown: Bacteriophage F387/08
MKPRTYNTILMLVLSMLFIWMGVAASIQSDRREELQNRLDSGCKVLAQGKDFIANTNGCYIKYE

SEQ ID NO: 870 - protein, 127 aa, Unknown
  Description of Unknown: Bacteriophage F387/08
MSRTIRRKGWHVVKSSKWNDQNNNEFAYIKSYNEYVKTQKDKENQQKYVELRISENSERPLEAKKLIAKSKRDGFWKTLRWTRYAMPVPRLFHKAEIKRALKYDEEYNWDEAGARTIEQGICEWLWD

SEQ ID NO: 871 - protein, 70 aa, Unknown
  Description of Unknown: Bacteriophage F387/08
MQHLSEKQLRNLTVEQLDELRREIGHGISHLQEEIRQHSSKADYTRKRTLEKYLKEVKAVLQHKRNTGQK

SEQ ID NO: 872 - protein, 95 aa, Unknown
  Description of Unknown: Bacteriophage F387/08
MAFNHICLALVLGCGISFPAASHDDISDYNSYVEGALQVYAKFKEPSKQESEQFYAFVQSKWKSESCSKDCDSLGRSAGEEYANRMRIQFDNEVQ

SEQ ID NO: 873 - protein, 128 aa, Unknown
  Description of Unknown: Bacteriophage F387/08
MKFNDFVKDGKLTPQDEFIGLLMVSQAYFHSAHFDTKSYARHKAYEVFFNEIPDLIDAFGEQWLGFSGKSYTPALPSQKELPKDTIEMLDFILAKADGIYKSVPAALQSVLDDITGLCYKTKYLLSLQ

SEQ ID NO: 874 - protein, 162 aa, Unknown
  Description of Unknown: Bacteriophage F387/08
MIKLTTELQPGKIFYHVCGVNRTETKPGEITRYIVASGTYDVELGLSGVYSRKSPFFQVICEYENYAGQTESYSTERSAHDMGIFKPGEKRSVHNLNRGFWTREEAEQFIKELQENKFSDPDDQAYADRLTPSEDFRRQQEFMDSYLDSCDYDYYDFDDGEE

SEQ ID NO: 875 - protein, 88 aa, Unknown
  Description of Unknown: Bacteriophage F387/08
MNGWGPSDDGFATREATIADGIEWARLQKQLQEQRESEEFCVDCDEEIPVARRLLVKGCQRCVECQGKWDTVMTSAYNRRGSKDSQLR

SEQ ID NO: 876 - protein, 63 aa, Unknown
  Description of Unknown: Bacteriophage F387/08
MESILDSTNLDNPYSDVHVKVVNSYFTKKLSRVVLKQGNDIIHLDTKQIDSLIQFLIEAKDGE

SEQ ID NO: 877 - protein, 77 aa, Unknown
  Description of Unknown: Bacteriophage F387/08
MASKLVWDGKPRKGDAVIEDESPHVIDLYLTVFHTYEHNTIIEIERDGDCVAIDKSDAIELVKYLTAMIPTMKQDNL

SEQ ID NO: 878 - protein, 166 aa, Unknown
  Description of Unknown: Bacteriophage F387/08
MNINKNSWHFKMNLWFKSGNIWKMPKTLCGYFWTTVLHILFSSAIAIFIGSVAWMFGWPLIAQTGILAWIGVSLSAFWLNVVAVPVGAVFIATFVLAFVAIVFGFIFGLEKFKEYRKNKQFTKKLARVKAGLPAESEPLVFIQYLKARKRKVCPMIDYVEGKTSEE

SEQ ID NO: 879 - protein, 74 aa, Unknown
  Description of Unknown: Bacteriophage F387/08
VKNDQVYIVNGRKAVFRAKTERGIISTYPIAEFTFEDGEQIKIKYVPLSQTYRFIGGEIDLDIYYEGGVWKLKS

SEQ ID NO: 880 - protein, 140 aa, Unknown
  Description of Unknown: Bacteriophage F387/08
MEIEIVTTKKKLSMSLLKQMKMASSSEIKFAMFDRVHRVLGYVNAFKWNKMDIQVAIINTGNDWALVPMYDTHVIKTARREPHPDGQEYHFHDVVYYHTMQKIGNVHRNSKKSTDKEHVEACAKASNDLIKFAKGNHIYL

SEQ ID NO: 881 - protein, 336 aa, Unknown
  Description of Unknown: Bacteriophage F387/08
MKTIVKSYFGSHLYGTSTPESDVDFKEIFVPHPRDILMCQAMNHTNCNTNNSATKNTKDDVDHELFSLKYFFKLAADGETVALDMLHTPPELVVASDLPEVWKFIQDNRARFYTTDMKAYLGYVRKQAGKYGVKGSRLADLHKVLDVIRDVPEWKYDDRPQQKGINERWKVQDIAEKLPLGEFLEWTTFVDHKSGEQKFYNVLGRKFQTTITIKEMKYSLEKLDAEYGERARKAEANEGVDWKALSHALRAGLQLQEIYMTGDLQFPLTHAKMVKMVKAGELPFKEVQELLESVVDEVEILAHTAEKNGMPKKVDMKFWDDFVEKVYLENHNSYYK

SEQ ID NO: 882 - protein, 62 aa, Unknown
  Description of Unknown: Bacteriophage F387/08
MKVFLNYGRPHKGRRWYLEAVCRETGRRENAKFSARPTRKQIHQFMSWAGETLRFSLYWAEI

SEQ ID NO: 883 - protein, 79 aa, Unknown
  Description of Unknown: Bacteriophage F387/08
MILLWSVVVPIVVAIIYFIVGWSVCKHLIKNGTIEKVGEYWFYLIFWFPAFIVGAIIMFFRWAGKLPKRIAENAINKHA

SEQ ID NO: 884 - protein, 71 aa, Unknown
  Description of Unknown: Bacteriophage F387/08
MKTLEIVVNNIDKAFKAAEAHGVEFEPMMVGEAFSKLAIIRGETDNLIDFVDDFYLGSKVRPYYINEILEK

SEQ ID NO: 885 - protein, 325 aa, Unknown
  Description of Unknown: Bacteriophage F387/08
MSTITIKKGIYFGKEISGTYELLGEWFPDSLSAEDSRQGDGKVFVELNGKKRGVWVFKDDITIDGVAAKIEVVESVDEMKERIKKRFNVMGLMTNGLIHGNIRSLIISGAAGIGKTYSLDKALQHAHDTNAIDYKSVNGKISGIGLYCRLWESREANSVLLIDDVDVFSDMDILNLLKAALDSGEKRKVCWSTASSFLEDKGIPNEFEFEGTVVFITNVDIDRELERGSKLAPHLQALVSRSVYLDLGVHTNEEIMVRVQDVIMTTSMLQNRGLRNSEVIEVLEFMKDNVNRLRNVSLRTALYIGDFVATDRKNWRTIAEVTMLK

SEQ ID NO: 886 - protein, 48 aa, Unknown
  Description of Unknown: Bacteriophage F387/08
MATLISNDVKRVLFKGGMYIVDTPKGDTSSWTINEWINYIDENGAWVQ

SEQ ID NO: 887 - protein, 141 aa, Unknown
  Description of Unknown: Bacteriophage F387/08
MSLAAIKDIECWLNDIKVYPPGHIFAGKPKGKAEKACEAICEKLYKFNFGDKKNVLAEVHSSYHELRVMVNVFRAPPFIELRKEYANKVFDTFLANVQDAVKHLDEMHKQHQDLNAYYKPWRKSYQELKNRIELIRYEVLK

SEQ ID NO: 888 - protein, 112 aa, Unknown
  Description of Unknown: Bacteriophage F387/08
MKNWVMTESEAYAAYVSPDDRRSELFGYYGSYCVAEEAVKGQSWWGSDGTVNRKPTELITFTDENGESWTFPKSAAISVQEETPEAKRKRLEKIKESALAKLNPDEREALGL

SEQ ID NO: 889 - protein, 106 aa, Unknown
  Description of Unknown: Bacteriophage F387/08
MSKEFSTTRMVDAFGYPCNGYREFIHPEVENQFKEVVRNILLNAFKTQGTNPRDLGIYLEEAIRDVQKSVSAKLHWAEENIAWSNKKRSDLNWPADREQIVNYAKG

SEQ ID NO: 890 - protein, 96 aa, Unknown
  Description of Unknown: Bacteriophage F387/08
MFNTIVSIHAYYEGQLNAARTKYKRGMEESVECLKDIQTFAQKTQNLILMDRKQVSLAEELKASKMIIEDNRKHQLKLLKRRQHQSPWFNSDFRSF

SEQ ID NO: 891 - protein, 54 aa, Unknown
  Description of Unknown: Bacteriophage F387/08
MKAPTWNELQEMFNTEEAFGTISEMVENLVDSPSEDNLLCLAQFIIETYIENQK

SEQ ID NO: 892 - protein, 88 aa, Unknown
  Description of Unknown: Bacteriophage F387/08
MTVYVDVLMNHGWKMRGHQVKNCHMFSDNLDELHAMAEAIGMKRSWFQDKRVPHYDLRDVRRKQAVALGAVEVSRRDAVLLWRKFFTK

SEQ ID NO: 893 - protein, 262 aa, Unknown
  Description of Unknown: Bacteriophage F387/08
MKTLTEIISALVEENRVARQAHRAKVEKRAEELNAGWAKTRFGREYFDKVVAPTWGKDDRPHAPFDGYLWENELGEVEAYHAGSYLPYVTELDSLDKPEYTGDHGWWKIRLTQEEYKELREYGYPLEVRIPYKEWKLQDGTNVVMAEVRAHKSILEAIQEHSKEVFDNIFNELNKNKGDAPEGRVTVSGTVTSVKVYEDYYGVQCKMMVVLENGATVYGSLPKSIPFEYRGKVQFTATFELAKDDKTHAFYKRPSKVIMLDE

SEQ ID NO: 894 - protein, 324 aa, Unknown
  Description of Unknown: Bacteriophage F387/08
MNKNELKMFVEAEFNKLKDKTLTKREKHVKVLSALHDLNPRAYDVAIAGNVARRVLNSMASHEANYAGFVVENIRRSRWLGAMSAEKQLKKFAIGNAKIYGQRYSFAAGAFKTEERHDRSAAQIFCSEFNANLRRILNRSICLLKGDDRVKYQASSTSSRNPKGVSFIRAEELDNVTVRIHINSHLSSGKYPARALLAQVRTALDHMDVVKKSCCKQQGENSSVLEVHLDPFKIFPKTLSTTPVIDEDVAHMYLNVVKPLPLTPVNHIEIAKNSITAEMESVKRFIDTKEAELAKHELTMADLVKSLNEYKERYESLEYARSLL

SEQ ID NO: 895 - protein, 86 aa, Unknown
  Description of Unknown: Bacteriophage F387/08
VKNQLKEDMVVDDNDLEIEFEYPPVPEFKIDWDACLEMVDRREAAAKQVVPCEKCGSIQVQLVDWTTDILKMKCRTCKHRFERKLK

SEQ ID NO: 896 - protein, 104 aa, Unknown
  Description of Unknown: Bacteriophage F387/08
MITKTITGANTKFFVEYANNLIKDKNFDNIIADMILDAYESGIDPMQLKEYLRATMDFTVLNMMLRTDTEFNEMIARRNEGKFNLTDDEVLACAAHEAWKKVIK

SEQ ID NO: 897 - protein, 111 aa, Unknown
  Description of Unknown: Bacteriophage F387/08
MKTTGALWKEFYNDEAFWEGYYHDDTLILFDDVEVEEYEDPSPDAVVKIESGYVYKTDDDSFTSHDLSLETFFKRWKKKQTTRTMVVTVDKDDFAKVFETISNIPGVKKVK

SEQ ID NO: 898 - protein, 170 aa, Unknown
  Description of Unknown: Bacteriophage F387/08
MIDIKLDTYAVRQLFPEGTAARAQLQQSVINNIVKEMVLKDSQNKLKQAVQSEVNIAAVTIPDVRAEVKKQVQQMFHTRGWNDMSAKEEMSQMMRNAAQSCAKNAIDDMVRQTIDDAVKQAEGRIKMSIERANLRIQEIIVNAMNKNFADQINAAIAAKLAEHFPVTANG

SEQ ID NO: 899 - protein, 57 aa, Unknown
  Description of Unknown: Bacteriophage F387/08
MDKIDFSKLNIPRMGIPDDIAKQLASVQPMPDNCIKDIFDALDGKTLVITTKAENGS

SEQ ID NO: 900 - protein, 96 aa, Unknown
  Description of Unknown: Bacteriophage F387/08
MARKRYMEEAERVMLLMYSVYYNETGQIVDSSKLKGAMTRGRGFAQAAIDKEIISRLGIKYSSKMYLHPGWNQVQAQVFKEIEEDVHSFWLRQQHP

SEQ ID NO: 901 - protein, 89 aa, Unknown
  Description of Unknown: Bacteriophage F387/08
MFTVFGYDSNIHKCVFCDNAKRLLDVKKQEYAFINVMPEKGVFDEVVISDLLRRLGRESQVGLTMPQIFAPDGTHIGGFDELRKFKFNA

SEQ ID NO: 902 - protein, 62 aa, Unknown
  Description of Unknown: Bacteriophage F387/08
MHDYRGTLLREGDIVALYYGYGGLETGEIKQIKNHRAKVEVTYSNGVKVMSKWKYGECMVKL

SEQ ID NO: 903 - protein, 56 aa, Unknown
  Description of Unknown: Bacteriophage F387/08
MSYDIGDLKAPCTVTISAEEFIRLQAIEELLWEIECALPSGLESWIDDEDLQKLRG

SEQ ID NO: 904 - protein, 129 aa, Unknown
  Description of Unknown: Bacteriophage F387/08
MTNAELVKEIKHIAGVTGEWDDNYDFEYPPNAPDDDAEEIFVLVEDDEWTQDHKYQSRSQIWYYPARGVHFMVSESRSGSYHTDWYYNPPEVDIVTRHEKVVTRTEVEWRIEYDSVNDSAPAPCKAAKA

SEQ ID NO: 905 - protein, 52 aa, Unknown
  Description of Unknown: Bacteriophage F387/08
MQSSKGIKPWYTARWETVEPEEDAIPEEDYNTSEPTINELLDYEDKVNGTYW

SEQ ID NO: 906 - protein, 150 aa, Unknown
  Description of Unknown: Bacteriophage F387/08
MELIGKQFEVIENDDELTEQFPQFVPGFKFQVINAVNEDDLETCGITAVIDLLTNKIITINDPTPFGESWFWCFYSEDTMHQIKEIGQGEDVPNISEIKLDHFHGKIVPITKALYAFAGQENCDSEEYDLMQKAADYIVALETRLGVQYV

SEQ ID NO: 907 - protein, 102 aa, Unknown
  Description of Unknown: Bacteriophage F387/08
MSKSCVTKTITVKILDFCDIHRIAREILRSHGYKIGDIIKFSNGYYDDDIGGMAWPKMSIIHKETNSYIEFNADDYEGIYAFCTSFCIKESNHNIYSSYSLI

SEQ ID NO: 908 - protein, 157 aa, Unknown
  Description of Unknown: Bacteriophage F387/08
MLLTGKLYKEEKEKLYQAQNGLCPCCKRPLDEDIQKNHLDHDHALEGDNAGKVRGLLCNLCNAAEGQMKHKFNRSGLKGQDIDYLEWLENLLVYLRQNRKDSNIHPQYVADMAKRFSRLGKPEMIAEMELHGFTYEESDGKSQLASKYKKQLRKSLK

SEQ ID NO: 909 - protein, 612 aa, Unknown
  Description of Unknown: Bacteriophage F387/08
MNIELEIQGLINKTNKDLLNENANKDSRVFPTQRDLMAGIVSKHIANQVIPFSVMEAHKEGVIHFHDMDYSPALPFTNCCLVDLKGMLQNGFKLGNAQIETPKSIGVATAIMAQITAQVASHQYGGTTFANVDLVLAPYVEKTFAKHVRDARKYQVALVKDYAISKTEKDVFDAFQAYEYEVNTLFSSNGQTPFVTITFGMGTSWEEKLIQRAILDNRIRGLGRDGITPIFPKLVMFVEEGINLRKEDPNYDIKQLALECAAKRMYPDIISARNNRAITGSETPVSPMGCRSFLGAWRDSSGKPVLDGRNNLGVVTLNLPRIALDANYKSSDDSNKLFKLLDERLDICKEALLTRIKSLEGVTASVAPILYQEGAFGVRMKPDDEILELFKNGRSSISLGYIGIHEFDMLTFKGSGKLVLKYINTKLNKWTEETGYAFSLYSTPAESLCYRFCKIDQAKFGDVKGVTDKGWYTNSFHVSVEENLSPFEKIDREAPYHSIAKGGHISYVELPDMKRNLEGLEVVWDYAIEKLDYFGVNMPVDKCLSCGSTHEMTPTENGFTCSICGETDPKKMNTIRRTCGYLGNPSERGFNLGKNKEIMHRVKHVRETNEAS

SEQ ID NO: 910 - protein, 77 aa, Unknown
  Description of Unknown: Bacteriophage F387/08
MLEKPMKQVDWNQLSEWGLIWKINKEVLHPLGIAITRDPESGLSAGAIQTDEPWKYDAEVEARNEVRFNEFRQNLPF

SEQ ID NO: 911 - protein, 156 aa, Unknown
  Description of Unknown: Bacteriophage F387/08
MNFDRIYPSDFVNGPGCRVVLFVTGCLHKCEGCYNKSTWNARNGQLFTMNTVKEIASHLSKSYIQGLTLTGGDPLYPQNREEISNLVSWVKARFPEKDIWMWTGYKFEDIKDLDLLQHIDVIIDGKYEKSLPTTKNWRGSDNQRLWVRNGSTWTHD

SEQ ID NO: 912 - protein, 44 aa, Unknown
  Description of Unknown: Bacteriophage F387/08
MVLPGHMIEEIYMLTYKIMFTLNHMATELFGPEFLAMTAFILTI

SEQ ID NO: 913 - protein, 70 aa, Unknown
  Description of Unknown: Bacteriophage F387/08
MKFINAIRKFISNVIALVALTAGAFVAIPFIVLIIIADWINPTKKDEKLSNEEFQKRVNTLTAKLQQVMK

SEQ ID NO: 914 - protein, 100 aa, Unknown
  Description of Unknown: Bacteriophage F387/08
MIEIYGIPEEVWRCPGCKAVRDLLDKLQLPYEFYNVINEVDGQPVYDRPLIESLAKRIGCYPSLAIRYPVIFMDNVKQYDIPTFKTNLIAAGHDPDIIED

SEQ ID NO: 915 - protein, 62 aa, Unknown
  Description of Unknown: Bacteriophage F387/08
MNWLNWQEALEAMSKGCKVKHVHFTDDEYFLMKNKVICDENGYDMTRWYKGESWQNEHWYIA

SEQ ID NO: 916 - protein, 80 aa, Unknown
  Description of Unknown: Bacteriophage F387/08
MKTFAVGDIVRTRIWDGLQFEVVVYVGSDGVLLHRINNLIKWHLERFVKYHEFNSYHCTVAPVASKEYYDMLEELKSLKD

SEQ ID NO: 917 - protein, 110 aa, Unknown
  Description of Unknown: Bacteriophage F387/08
MSQAIKNALNAFAYYKVSAMLEEGRCVTPSLLDQWEVELHGTMKEEGQKIGKARIRELVVAYLLSEFGIKAFGVEPIVVGVGEISESAIRKMKNQRKKGFRDVKAVKAAK

SEQ ID NO: 918 - protein, 91 aa, Unknown
  Description of Unknown: Bacteriophage F387/08
MKLNQNGCPSRVRFCILELRSNIVVIDEYTTIVGVQQYLDRRFDTRTHMKYGFPGKCKFYPMSADHQSVVNDEYKWAEGLTLKELEEYLDA

SEQ ID NO: 919 - protein, 93 aa, Unknown
  Description of Unknown: Bacteriophage F387/08
MRKVILYTEIFTSRWVFDSVRISNASKEDVRNAQRLAYDEAGKSPAFVKIEYIITDSALIHNVSESVLKKFCVDRINKGTSMEYFLLARELKW

SEQ ID NO: 920 - protein, 74 aa, Unknown
  Description of Unknown: Bacteriophage F387/08
MVEEQIAEIGLLGWFVSKTKDGRNLIETPEGEFIIEEDFDAFWIYERSGENEYTSVDAFSKFEDAIDSVKAWLK

SEQ ID NO: 921 - protein, 92 aa, Unknown
  Description of Unknown: Bacteriophage F387/08
MAKVNQIMIVVEGIGGFTIDSYMGVWFDNEEGMYWETHASMLNETHYESLYSSFMEMMHEVDESDWFELSLVEFKRIMEQLFQCYRIMKGEL

SEQ ID NO: 922 - protein, 81 aa, Unknown
  Description of Unknown: Bacteriophage F387/08
MKIQLTLTHENIKGVFCLENSQITFAQDGTYWYAESDDIAGYGMERVFEDFEAVIDVPLDFTYNDFYRIMMKLIACAELIK

SEQ ID NO: 923 - protein, 182 aa, Unknown
  Description of Unknown: Bacteriophage F387/08
MSNYVNNKELYKSICSWKEKCRESEAAGGPRVVKQNDTIGLAIMLIAEGLSKRFNFSGYTQSWKQEMISDGIEAAIKGLINFDETKYDNPHAYITQACFNAFVQRIKKERKEMAKKYSYFVHNVYDSRDDDMVALADETFIQDIYDKMTQYESTAYKAPGSAKKSEPTSDGPNLEFLYEAED

SEQ ID NO: 924 - protein, 76 aa, Unknown
  Description of Unknown: Bacteriophage F387/08
MRLKINLDGFLEDVQDLDAIPYLLKMYLREVLDLDIHIDPKNPHDADFRSDSAIIEHSYNWTDTEFTFEINYHPKE

SEQ ID NO: 925 - protein, 100 aa, Unknown
  Description of Unknown: Bacteriophage F387/08
MNNITQEERDELQQKLMEAAEEQAIARANKIVRKNRREIERLKAHAGDAVLDNNFPAYKYAIEKLRTILKQPFTDEIILTCWNTSRKSVWDILNAGTSKI

SEQ ID NO: 926 - protein, 65 aa, Unknown
  Description of Unknown: Bacteriophage F387/08
MLVQVKFKRVRKDAGFTLNTATGTMAVKVADNQYRVLGSTEGCKLIDKNSLVWVDTFQVKRWYEW

SEQ ID NO: 927 - protein, 81 aa, Unknown
  Description of Unknown: Bacteriophage F387/08
MGSNPGHDWPEGNYACRCSNCSERYTGPKRSYFCYKCDTARREAPAPDYEAIRNAKIDMLKRFEEAKRICEAAGYVVYKKI

SEQ ID NO: 928 - protein, 398 aa, Unknown
  Description of Unknown: Bacteriophage F387/08
MKINILMARGLEGCGVTKFSLEHREWLVKHGHEVNIIYAKDKAFTRNRAHSYKDVTIPVSLADDYDKTLSLLNACDILIINSVPAVNAPEAAIDNYKKLIENIKPEVRVVVYQHDHRALSLRRNAGLEETVKRADVLFSHSSNGDFNTVLMEEYFPSGGLSFFDDSDSAPPVYNFQPAMNIKAIRDKYWKDFSAIDFDIHRWIGRTTTWKGYFLMFDFHESHLRPAGKTTILEGLERSPAFINIKERYEIDYCRHYHQVKTGPGLNPQVLDRYVNSEMLERMSQSGFGYQLSRLPDKFLERSLEYTHLELGACGTIPVFHKATGDALKFRVDGKPLTSHDSGILWLNDENKNEVFERMKHLSSDQKLYDKERNKAFEFLVEHQDSEHCFKEQFELMTK

SEQ ID NO: 929 - protein, 340 aa, Unknown
  Description of Unknown: Bacteriophage F387/08
MKIIHSGDWHLGVRADDPWVQDVQRHGIKQHIDYAKKHGIKTIIQYGDIFDVRKAITHKTMEFAREIAESLEKEGINLITIVGNHDMHYKNTLTPNASTEVLGKYKHITVIEKPVTMDFDGTLIDLCPWMCEENTSEIMKHIKESSAEYCIGHWELNGFYFYKGMKSHGLEPDFLKKYKQVWSGHFHTISSAANVKYIGTPWTLTAGDENDPRGFWVQDTELSTFDFVPNEITWHRKLIYPVTGQVDFEEFRNLAVRIIITAVDEDLPKFESELEKVVHELRTVSKVDNSVESEDGEEVEVKSLLDLMEEYIQALEDLSADDIKALKVMSKQLYIEAQNQ

SEQ ID NO: 930 - protein, 560 aa, Unknown
  Description of Unknown: Bacteriophage F387/08
VKTFKLNRVKYKNIMSVGQAAIDIQLDKCQKTLITGKNGGGKSTMLEAITFALFGKPFRDIKKGQLINSFNKKDSVVELWMEYDGHSFYIKRGQKPNVFEILRDGNKLDEAASSKDFQSYFESLIGMSYTSFKQIVVLGTAGYTPFMGLSTANRRKLVEDLLEVSLLADMDKLNKTQIREINQQIQVNDVQREALTNEIKTHHEYAEKQKKLSGDNVARLQAMYDEQVNEARGYKAELETLQRELLELVIGDDPAESIQEVQGKTFKIRSKIESYSKVLGLYDKGGHCPTCLQDLHSNDTLITKINHHVEECNTILGELKTRQSELDELAREYNTVRARARDIKTQMGSLKQMTITAVEKARRIKAAIDKASQEFIDNSDKIKLLQEELDKIILVKTNLVMEKYRRGILTEMLKDSGIKGAIIKKYIPMFNKQINSYLKIMEADYSFTLNEEFSETIKSRGREEFSYASFSQGEKARIDIALLFTWRDIAEKVSGVKINCLFLDEVYDSATDAEGVKAITAILNKMVDANVFIISHRDHDPQAYGQHLQMKKVGRFTVME

SEQ ID NO: 931 - protein, 64 aa, Unknown
  Description of Unknown: Bacteriophage F387/08
MNEFTTGQHLLAFPELKRYVLVNLFSDERHLVTEEMLRDAFTGNEYNRVMSNRNPGWMVEDYYD

SEQ ID NO: 932 - protein, 125 aa, Unknown
  Description of Unknown: Bacteriophage F387/08
MINFVDVKDIQVKNVRADSNPNNQNRIRKSWVLALTEETKQAIKDKIKDSEARFAFYKSIDDEVAEKWIELMRKHYNESIKAGAKIVTDRHGGERLENDYCVDADEQLVAAGQIVAEELTATFAA

SEQ ID NO: 933 - protein, 233 aa, Unknown
  Description of Unknown: Bacteriophage F387/08
MKFSKETLNILKNFSTINSGIMLKPGNFIMTRAVNGTTYAEATISDTIDTDVAIYDLNSFLSILSLVGDDADIIMQEDGNLAIKDARSTIFWPAADPSTIVFPTKPIPFPVANVIIDFKGEDLQQLMRVSRGMQIDTIAITNVDGKIVLRGYNKVEDAALTRPKYSLTLGDYEGEGNFNFIINMSNMKMTIGDYKLMLWAKMNGSKKQTAAKFEGASASYVVAMEADSTFDFE

SEQ ID NO: 934 - protein, 320 aa, Unknown
  Description of Unknown: Bacteriophage F387/08
MKLTVNEADFMWEQKYRPGTISECVLPAEDKEIFSALVAKGKIPHLILHSTSPGTGKTTVAKALCNDINAEMMFVNGSDCKIDFVRGPLTAFASSASIAGKQKIIVIDEFDRAGLAESQRHLRSFMEAYSTNCTIIITANNLDGIIKPLQSRCRVINFGKPSPSDVKPMQIEMLKRCLAICENEGVVVEDKKVVAALVKKNFPEFRKTINMLDHYSSKGVIDAGILSIVLNDRGSIEDVIEAIKTKNIKELRALAPKYAADYTWFVDKLSSELYTMVTGPSIIRMYEIIGENNQYHGIAASIELHLVYMLIQLVVEMQWK

SEQ ID NO: 935 - protein, 188 aa, Unknown
  Description of Unknown: Bacteriophage F387/08
MSLFEDDDQYNEHQIAWLGKDWTKVQELSDSYKEKAENQFFTIIGSINEKQEHLNISTMDYSKFMVENALSQHPDCMPSVYVMNLVGQGLSDQAHYNYMMASVPRGRRYGKWAKLTENIQDALILQVIMTYYKVNAIDARMYRETLEAKNKLKPALKKMKGLVTDELVKTITKNVKEQKNLKKTALEW

SEQ ID NO: 936 - protein, 123 aa, Unknown
  Description of Unknown: Bacteriophage F387/08
MVKMIEITLKQPEDFLKVKETLTRMGIANNKDKVLYQSCHILQKQGRYYIVHFKEMLKLDGRPVTIDLEDEIRRDSIAQLLADWGLLSINRGQTLAQMQNNFRVITFKQKHEWTLKSKYTIGA

SEQ ID NO: 937 - protein, 66 aa, Unknown
  Description of Unknown: Bacteriophage F387/08
MTDQEFYDKLKNIRITAPEWFSLPIDEQIQYQVKETLEKYPGRKVMMCFTYDKNRVPRIQKQVIEV

SEQ ID NO: 938 - protein, 902 aa, Unknown
  Description of Unknown: Bacteriophage F387/08
MKEFYISVESLGNDIVERYIDSTGEERMRRVPYSPVMFSHCMEETKYKDIYGKYCKKNTFPTMKDARDWMRRMEDMGMEAMGMDDFKLAYISDTYGSEIVYNKKFIRIANCDIEVTASQFPDPMKAEYEIDAITHYDSVDDKFYVFDLLHSLYGSVSEWDKKLAARLDSEGGDEVPQHILDRVVYMPFNSEKEMMLEYINLWEQKCPAIFTGWNIEGFDIPYIMNRVKQILGERAMKRFSPLNKVSSKIITNMYGDKEIYSIMGVTILDYMDLYKKFSFTNQPTYKLDFIAYYETKKGKLAYDGPINKLRETNHQRYISYNIIDVESVQAIDAVRGFIDLAISMSYYAKMPYQGVMSPIKTWDAIIFNSLKEQDKVIPQSRSHVKQSYPGAYVKEPVPAAYRYIMSFDLTSLYPSIIRQVNISPETIVGQFKLHPLGEYINKTAPRPSDEYSCSPNGWMYRKDVDGVIPVEIAKVFYQRKEWKNKMMGAKRNQELIKKVLNDKKFGTIDKFAEVNVYEDFSDDMKAELLTYTEECLDKLMFECKHAEILGNTNQLNRKILINSLYGALGNIYFRYYDLRNASAITLFGQMAIQWIERKVNEYLNKVCGTEGHSFVVAGDTDSIYVCVDKVIEKVGLERFKETNDLVEFLNQFGKKKMEPWIDQSYREMCEYMNNKEHLMFMDREAISCPPLGSNGIGGFWKAKKRYALNVYDMEGTRYAEPHLKIMGMETQQSSTPTAVQNALEESIRRMLQEGEESLQQYYKQFESEYRELDYKVIAEVKTANNIGKYDDGAGYPDKGTPYHVKGALAYNRATAGFEGITPIMEGEKVMVIPLREGNPYGEKCMAWPSGTELPQEIRQEVLVWLDHSVLFQKSFVKPLTGMSEAAGLDYEEKSSLLDMFDF

SEQ ID NO: 939 - protein, 147 aa, Unknown
  Description of Unknown: Bacteriophage F387/08
MKSLLAVIVALTLTGCQMPQGDIVPASSVGQVRAIGGTVGYYRASNQVSAESLAVERRLAKEKANPNRQLSAMELDMIEQNKHELEEIKRLRKTQKERTCTAQAAAVNDQIRLTDFANGGLSYNEHKQRMEQLKSLQNHIYNKCMSN

SEQ ID NO: 940 - protein, 68 aa, Unknown
  Description of Unknown: Bacteriophage F387/08
MEAVFGLIILFFIYFLPTFVACSRKHKSRGGIFITNLVFGWSIIGWLIALIWSASNAQQNTIIIQQVK

SEQ ID NO: 941 - protein, 244 aa, Unknown
  Description of Unknown: Bacteriophage F387/08
MIVTPMTVQDIRQEFADALLNKEFVIDKTGVKTIEIVGASFIADENLIFGAVNDGYIARELEWYKSQSLFVKDIPGETPAIWKAIASKHGEINSNYGWAVWSTQNYSQFANCAKELINNPDSRRGIMIYTRPQMQYDFERDGMSDFMCTNNVQYLIRDNRVHAVVNMRSNDVVFGYRNDYAWQLYVLEQLTKLLNASGKNYSVGDIIWNVGSLHVYSRHFYLVDNYAHTGETHIAKKDYKGEWK

SEQ ID NO: 942 - protein, 278 aa, Unknown
  Description of Unknown: Bacteriophage F387/08
MIQFVIPSYKRAGAVTALTMFPEGYVPHLVVRESEKEAYETWHGHAAKIVTVPDDVDGIAGTRRLITEMYAGQRIWMLDDDTTIHLTEIRERDDRRVPLGVGEAMSQEVFDDMVKYVETAMDCGYYHGHARLPIFKITSSWGHYRENSFGFTNTFYDLTKLTAEDIGYGIIDLNEDAYAFLKLINMGHPHLALFKYLVKSGKVQSPGGCSTQRDTARQNRALEQLHAAFPNQARWKSKDGERRGLFGDDEPLKSIRMCINTRVKSQAFHEFGKVEPYL

SEQ ID NO: 943 - protein, 83 aa, Unknown
  Description of Unknown: Bacteriophage F387/08
VRAKALQGPLMNIYDKSDVAGNIFKAEEFRCFVCKSDEFVHEGTTGSDGMHCWWHGMCVGCKIHYEIDMETVVYNTKKKWNFC

SEQ ID NO: 944 - protein, 391 aa, Unknown
  Description of Unknown: Bacteriophage F387/08
MSDLKSRLIKASTSKMTAELTKSKFFNEKDVVRTKIPMLNIAISGALDGGMQSGLTIFAGPSKHFKSNMSLTMVSAYLNKYPDAVCLFYDSEFGITPAYLKSMGVDPDRVIHTPVQSVEQLKIDMVNQLEAIERGEKVIVFIDSIGNMASKKETEDALNEKSVADMTRAKSLKSLFRIVTPYFSIKNIPCVAVNHTIETIEMFSKTVMTGGTGPMYSADTVFIIGKRQIKDGSELEGYQFVLNAEKSRTVKEKSKFFIDVKFDGGIDPYSGLLDMALDIGFVVKPKNGWYAREFLDVETGEMIREEKSWRAKDTSSTEFWGPLFKHEPFRDAIKARYQLGAIDSNAAVDEAVAEMINSKVSTKVDGVKLPESGSVSAAEVEDELENFMNED

SEQ ID NO: 945 - protein, 116 aa, Unknown
  Description of Unknown: Bacteriophage F387/08
MKTEFDLESELEKFEQESPSEEGDFERQERVFKKSHEIIQEAMKTVIQEIVIKLNGQSHLVYVHKLNISPSGEVTIEFSTPSEAHKDELYPHVEACVKQQIQSALKTKKKSLWKIF

SEQ ID NO: 946 - protein, 479 aa, Unknown
  Description of Unknown: Bacteriophage F387/08
VVETILANLIYNQAFFTKVWPYMDKEYFEQGPAQTVFNIIKKHVNEYTAIPSKTALCVALDNSSITETEHEGAKKLIDKLSDAPEDLNWLVKETEKYVQEKAMYNATSRIIEIQTNAQLEPNKRDKRLPDIGAIPDIMREALSVSFDSYIGHDWMEDYEARWLSYQNKARKVPFKLSILNKITKGGAETGTLNVLMAGVNVGKSLGLCSLAADYLQMGHNVLYISMEMAEEVCAKRIDANLLDVSLDDIDDGCVSYAEYKGKMEKWRSSSTLGRLIIKQYPTGGANANTFRALLNELKLKKNFKPTVIIIDYLGICASCRIRQYTENSYTLVKAIAEELRALAVESETVLWTAAQVGRSAWDASDMDMSDIAESAGLPATADFMLAVIETPELAQMKQQLIKQIKSRYGDKNINNKFSMGVHKANQRWVEIEQQNDPTKPNPSNTVREGAGAQNRVAESNRQERVSRSKLDALAEELKF

SEQ ID NO: 947 - protein, 77 aa, Unknown
  Description of Unknown: Bacteriophage F387/08
MIFVFSVIRDQSGRSFVVTASDSVHRGVIAYNKADLSSYDYGEVKAYNDEGIWVNSAIYLPTKNLTSDEVLEKLFKR

SEQ ID NO: 948 - protein, 97 aa, Unknown
  Description of Unknown: Bacteriophage F387/08
MKKIVLALIFAVSSCSAVPALANYDKDLCEWSMTADEKDVAEQIRADVGHIIDNTDPSKMKEVQAEISNDGAAIKLNYALYCDANFDNFTIASWILG

SEQ ID NO: 949 - protein, 72 aa, Unknown
  Description of Unknown: Bacteriophage F387/08
MITYVLVMAIMTGAGGVSTEKLSFTGMNESSLAQKCEDAGKQFTGIKADSGFGSPSVYTTYKCIRIDGGNNK

SEQ ID NO: 950 - protein, 55 aa, Unknown
  Description of Unknown: Bacteriophage F387/08
MKTFKEFVKLNEEMVAGDAGGNPQNIASGTTSGAVVNKGPETLPKKKRDKSKPET

SEQ ID NO: 951 - protein, 340 aa, Unknown
  Description of Unknown: Bacteriophage F387/08
MSWVDNEFAIRAISHLPKFRHVTTSSTFKLNCRCPICGDSQKDINKARFWIFDAGQGLRCHCFNCEYNKWLSQYLKDNEPDLYREYLLEKRKEQVFDKPKTVEPSEKINAKLPVIEKLNFCERLDRLPKEHPIVKYVTARCIPSTSWKRLWFTNQWPSLVNSVNPGTYKNETNEPRLVIPIFNKKGEIESFQGRALRKNAPQKYITIKAHEHATKIYGLDTIDESKLVFVMEGPIDSLFIDNAIAITGGSLDLAQVPCHDNRAWIMDHEPRHPDTIKRMKRLVDAGEKVVFWDKSPWKSKDINDMIMKEGATASEITDYINQNISQGLMAKLRLDKYAKI

SEQ ID NO: 952 - protein, 63 aa, Unknown
  Description of Unknown: Bacteriophage F387/08
MSEVKRECKDKGGFGRYLYVGIATAALAAWNYVVVPLASTHGLVLPPMPLEKVVSFIMTGGLL

SEQ ID NO: 953 - protein, 173 aa, Unknown
  Description of Unknown: Bacteriophage F387/08
MPHFNECSQLIAGADKAEARYAGIVRKVGGDPLQVMLDMQKSLQVRLANDKPGTNMHPDELAQAGDIVQWLRNQKDYIDDEFRELLTSLGGMSNGEKAASAVWKPWKSDHVKMQETYIKDLSDKDQLEIKFEMIDILHFVLNMFMALGLDSEEIFKLYYLKNAENFARQDSGY

SEQ ID NO: 954 - protein, 45 aa, Unknown
  Description of Unknown: Bacteriophage F387/08
MAKRISKRRLKIIRKQKERALVLALREEITREIDKEILKALTAAI

SEQ ID NO: 955 - protein, 78 aa, Unknown
  Description of Unknown: Bacteriophage F387/08
MAYVNIKTFDHTTADGEVKGTEVSVAFKVYSDSHRIANAQYQIFPSEKAAYSTVVDDAATWATTNAKMFEAVPSDAEV

SEQ ID NO: 956 - protein, 63 aa, Unknown
  Description of Unknown: Bacteriophage F387/08
MICYTKPWYQSSLKKSHFDCWYRGVRAAALLLKAAPALIKANDKWFEDNNMTEGALCGKRKNL

SEQ ID NO: 957 - protein, 174 aa, Unknown
  Description of Unknown: Bacteriophage F387/08
VANAKIYNAKIYKVSLQRAVQSRSDANGVLRLDQDRIFTVALYSTFDKDFKDLVNKFEAFGWCPSEDYGIIKTAHVFDVDTVPGSPVAILRALHLKGYTNVCHETSLYEYENDIISRGKKIIIDSTDSLIEFTKLVWLYMGADFIKLTPSPLLQKAADGYNSSSCLYRNNEWFM

SEQ ID NO: 958 - protein, 62 aa, Unknown
  Description of Unknown: Bacteriophage F387/08
MDLFEMMEEPQEEVQVHPVISKDIKDEYRIIIQKYGIKAPEALLDELASIWSDPPPWSPWAK

SEQ ID NO: 959 - protein, 229 aa, Unknown
  Description of Unknown: Bacteriophage F387/08
MAISLNPSISVKLSKVIPIEKPIRSIDVLNFARESKGLPLYDLSVWEALANRFDCKEQSILWQCMNNKIGEEFHKKLDSIVRRHQIDNSDILYRGLSCRESKAFYDALIKGEKFGFGKVASFTTDETIAREFAGKWHYSTFVVIEVNNCHQSFDYHTNMKSLLITAPDSEFMRPNDVIDNIAQRRSADIEMIDKEQERMLPMGTKFKVVGHNKVEKSGLLMDYFSVTIA

SEQ ID NO: 960 - protein, 252 aa, Unknown
  Description of Unknown: Bacteriophage F387/08
MMKFTAETAKIYTRLITTLGSAQRRNKEFNLTPEYLFNIMQQTHCAYSGEKFGTVKGNHPDSMTLERWNNDLGYVMGNVIPVKQKYNTLRGNNTIEGLERKANEIAARIVRSSDSVKPTSDKEASRLEKIREYEKTITSIKTNLHNRENHLSQFVQKEKNGTATSADLELINALRTRISGGKSELAKVERKLSAILASVPNRPSDAEIRVQSIRLIVSSLRRLEECSMLDKLKLKKGLPLTASFFQLLRGKM

SEQ ID NO: 961 - protein, 104 aa, Unknown
  Description of Unknown: Bacteriophage F387/08
MQHYGYVVAYKDKDGFDHPVTTDMYDGERCVVFTNEESANKARIRTMSVLTDKLAKGNFTGKSKTKGMLWWKTTELVYEPLSDVEREKLKAKIKNLHVVRVKVA

SEQ ID NO: 962 - protein, 443 aa, Unknown
  Description of Unknown: Bacteriophage F387/08
MITFDQLKESQKAIFNKVIEMVKQGAKGQHITINGPAGTGKTTLTKFIIDALISQGISGIALAAPTHGAKKVLSKLSGMQASTIHSLLKINPTTYEENVLFEQKKVPDMASIRVLICDEASMYDRKLFKILMATIPAWCIVIAIGDKAQIRPVEPGSNEPALSPFFTHKDFLQLHLTEVMRSNAPIIEVATEIRNGGWIRDCVVDGHGVRGFTKGTALKDFMLNYFNLVKTPEDLFENRMLAFTNKSVDKLNEIIRRRIYETERPFVVGEIVVMQEPLTKELKFEGKKFSEILFNNGQFVRILDAIETTSFLGARGVPGEYLVRHWVLDIETYGDDEEYAREKICVISSEEEMNKFQFFLAKTADTYKNWNKGGKAPWSEFWDAKRKFHKVKALPASTFHKAQGISIDRSFIYTPCIHMADASLAQQLLYVGTTRGRYDVFYV

SEQ ID NO: 963 - protein, 84 aa, Unknown
  Description of Unknown: Bacteriophage F387/08
MFELKLEDLQTMIVGLQESKFEAPDNVKRAINIKIDIVLNELRDIADNANAITWFTGYDPKVYLSEYIGCQLREIKFMLEAQNG

SEQ ID NO: 964 - protein, 229 aa, Unknown
  Description of Unknown: Bacteriophage F387/08
MAKDFIIDFETFGNVSSSSVIDLALITFDSDPEVLESFDELVKRGHRIKFDLKSQKGHRLFGKSTLEWWKKQSAEARANLASTPDDLSVIAGIKEAQQYLIDNGIHPWDSFGWCRGQSFDFPIFVDCLRDVQRAQGISEEEIDTFKEEPCKFWNQRDIRTAIESLLLTRGLTTTPLPKGTLNGFIAHDSIHDCAKDILMLKYAQRYALGLSEAPSPEDTDPLSLPKGRG

SEQ ID NO: 965 - protein, 55 aa, Unknown
  Description of Unknown: Bacteriophage F387/08
MEEFEFDENFEEWFNREILPKISPTMVLVAKALMAKGWDAGYMFGVDVGCEISHR

SEQ ID NO: 966 - protein, 147 aa, Unknown
  Description of Unknown: Bacteriophage F387/08
MMKNLVVGENVKVIGGKHIGKEGVIVGIFNRSNKMSSYLLQLENEDKAVYSLQKFVVALESRDLLDSMFNESYLRKWVHVNSLDNVITQSVSSTNSATNLSLHKNVLVTDEWEEDGKTLVNVVFQGNYAVLPKADVEPTESQRQGLV

SEQ ID NO: 967 - protein, 71 aa, Unknown
  Description of Unknown: Bacteriophage F387/08
MKTENTVKITAEAFEDILFNPDLIVVQKEKTFGKEEHWTWLYVFANHGDIVPVRTFARVITVDGPEYMEIV

SEQ ID NO: 968 - protein, 121 aa, Unknown
  Description of Unknown: Bacteriophage F387/08
MNFKEGVQYKFVNDEAEEEFSSRYEVNEDFVYELYENGGSFTVTKVDRQNNRVSGIMWANGTECDEVGGEDLVIFDSEFKYFTEVGTSANVIPTDLVMNLSIHNRGQAIAAIAALQSAYQC

SEQ ID NO: 969 - protein, 111 aa, Unknown
  Description of Unknown: Bacteriophage F387/08
MLNLAPIFEASKLSYPIPNRSIGNVMLQLSSETGEMCDWINRPWRQKEEFEGECADVINCVVDALWLHFRNRHKNDTHVSDDEISMMVTRALNEQIMVKTQKWKDAVNANV

SEQ ID NO: 970 - protein, 58 aa, Unknown
  Description of Unknown: Bacteriophage F387/08
MPMYDYKCEVCGKKIEIMRKISHRDYTVNCFNPKCEGQMKRVVSAPAVHYDGLKSGDY

SEQ ID NO: 971 - protein, 82 aa, Unknown
  Description of Unknown: Bacteriophage F387/08
MKKILITALAFMMIGCTDADNATRVLENAGFTEVDITGYKFFSCSEDDFQHTGFKAVGPTGKTVKGTVCSGIFLKNSTIRFE

SEQ ID NO: 972 - protein, 65 aa, Unknown
  Description of Unknown: Bacteriophage F387/08
MKYIILTLIALVISIGVLVSLADSTESSNEVQKSSIGIGVNGQVGVKISDNLCVNPSTGAAEVCF

SEQ ID NO: 973 - protein, 612 aa, Unknown
  Description of Unknown: Bacteriophage F387/08
MIKNEIKILSDREHIIKRSGMYIGSSACEAHDRFLFGKFQSVKYVPGIIKLIDEIIDNSVDEAIRTNFKHANKISVDIKGNKIIVTDNGRGLPQAPVVTPEGETIPGPVAAWTRPRAGGNFGDDAERKTGGMNGVGSALTNIFSVSFTGATCDGKNEIIVRCSNGSENISWEEHPAKDKEFIKDKTGTVVSFIPDFSHFESTGLTDVDQSIIHDRLMTLAVVYPDIEFKFMGKRVQGKFKAYAQMYDENAVVQDSDTCAIAIGRSDDGFRQLSYVNNIHTKNGGTHVDLVLDELSNELIPALKRKYKLEVNKARIKECLTVIMFIRDMSNMRFDSQTKERLTSPWGEIRSHIDIDYKKLANAIMKSEDIHMPIIEAMLARKLAAEKAAETKAAKKAQKAKVAKHIKANKYGKDADTTLFLTEGDSAIGYLLTTRDRELHGGYPLRGKFMNTWGMSAADAMKNKEVFDICAITGLTIGEPAENTNYRNIAIMTDADVDGVGSIFPSLLAFFSNWPELFEQGRIRFVKTPVIILTKGKEQRWFYSLGEYEDHKDDFKGWKLRYIKGLGSLEEDEYERVIQDPVYDVVSLPENWKELFELIMGNDAAPRKTWMSE

SEQ ID NO: 974 - protein, 50 aa, Unknown
  Description of Unknown: Bacteriophage F387/08
MQRYWITLVSGDYGYMFAEKKPLPGTWVTIWVENSDGSKHEVYGRVSRVH

SEQ ID NO: 975 - protein, 82 aa, Unknown
  Description of Unknown: Bacteriophage F387/08
MKSTIISILRTEALKYSVDPSNEYQELLIKRLLNSIADRLESNQSVPINHSLFAMKVIRFLRPDIKIADMVKVIKSSGAVKC

SEQ ID NO: 976 - protein, 69 aa, Unknown
  Description of Unknown: Bacteriophage F387/08
MLKKSYVPNKELFDDAIYREYRIIQRFFDIQAAEEFKDRFKQISDKIFTTNTATAEELLEVAEIIKRHN

SEQ ID NO: 977 - protein, 725 aa, Unknown
  Description of Unknown: Bacteriophage F387/08
MKIKCDDEVIIGSSDAEDSTFTIKASGKAFDILSNKLYKYKVRAVVRELSTNCDDAHKLNGNENRPFYIKAPTRLDPRFVIRDYGPGLNHNDMMTMYKTFFESTKNNSNDFIGALGLGSKSPLSYTSTFNVVSYHNGKATGYTVMKNRGEPTIRPMFVDDMKEDEETGLEITVPVKVEDIDTWHYEIAYILRTFGAVPPKVDSLRREIEYFPVDKTDWFSVNSSYESYGLYAVYGKIVYPISGVDVKADWLLNRYGKVYVHFPLGELDITPSREELSLDEETIANIQKRVNALEEEVITADIKAFEAYESDREFLREFNKLSSKERSILQSRGITIGNRDIKQVVAKYNLDKIRSYYVDNEVSVYVSCDEPARRKVSSSSWHRHNQVNISDICGVDRTKAFVLIDDKAGKRIATVRALCKSGLVPIWAHITVIKDNEDELHVIDELKKIMDTDEVVVFRVSELEAQRKALPDYDTGPKEKRPKSPNVSLHWIDKDGYWEEDRQTLLSSEITELEGYAIGRNRDEIHTFPDNVWWWNMSITDMRSLAEACGIKKFYAIRPSAMKAAAKADGLLSFDRFIIDQYIKCIDKVDYDQYMPSNATGNRICGNIAHYDKLNFLSSKFTASGMKNPFLTKLNKIAKVCRTSKIKDENDENNDLALCNKIYNKLSSDAETIFYKKIEQFKDDYPVIASVLDTWRTDSKLVDDIVKIMELLDGASTQNSENKGE

SEQ ID NO: 978 - protein, 303 aa, Unknown
  Description of Unknown: Bacteriophage F387/08
MAVTCLSEIQKDAIVKNFKNGLYTKKELAENYGVSRDTIRRVFKEREARAAAAAVPAKVEAPVEREFKWAASSKFISITEGRTTYNADSQHPGFKSALQKLVDGDIAGAIDHINLEQGIKKFVQGNVRIEDGTLFYKDIELKSGLTERIVRAMEDGEDFKRYLPFLENLMLNPSRRAVYRLFDFLNANDIDITDDGHFIGWKVVRSNYFDCASNTFDNSPGKTVTMPRNQVDEDDQRTCSTGLHVCSKSYIGHFGSGSDRIVSVKVHPRDVVSIPVDYNDAKMRTCGYVVLEDVTDRWGSELR

SEQ ID NO: 979 - protein, 98 aa, Unknown
  Description of Unknown: Bacteriophage F387/08
MINPFNVSHSKVVNLRGTHHAATVFCHHVVKHEGDVHYAWLHCDELVELGDDFVVEPDTCNHDDRVYFGELHIRGIYGIDEQSPAEIEPTPDIYPRFE

SEQ ID NO: 980 - protein, 195 aa, Unknown
  Description of Unknown: Bacteriophage F387/08
MALMNKALQRLNQLRTFTLDLNKLRGEAKVKIIDTARYSLDIDPSQDRIDVLKRCRIAIPAEYVVADFLDGYVNDQVVDHNNNDPYEWAWDVLAHPHYQGVRVEVKTHFVHDRANHKPWINVTTGKDGPFPDGSGINLGPMFKHKVADCIIIFVAEEVSQNVIRYTPMFAGGIEQLMEVVKPSRVGAGGYIMHKF

SEQ ID NO: 981 - protein, 79 aa, Unknown
  Description of Unknown: Bacteriophage F387/08
MSYLELKSLRAKRGNASIKAELLKEYRILESMNWHYAIIACDNGDSTYGGLYPNGAAAARDEHKDKVKALEEKIRNLCI

SEQ ID NO: 982 - protein, 63 aa, Unknown
  Description of Unknown: Bacteriophage F387/08
MIRSSFDRRFNLMRTVVLSFIVAVALGIVAIFGFGIYFAIQAVDIIQTDGLKSLVETVWEGQK

SEQ ID NO: 983 - protein, 151 aa, Unknown
  Description of Unknown: Bacteriophage F387/08
MRNIMTFADLDNAGAELIGSIRNGDWAAGAPSREITEREGFYFLMFNDGKAGYIGASARFFVAKQRSKAGFESVLSHIRSGRSQLGRTLRSNCVTYGVFWIPANKMKPLTTGYGKGQLALAFTRQHSSAAQTYSELNRILNDNFIFTLQKY

SEQ ID NO: 984 - protein, 47 aa, Unknown
  Description of Unknown: Bacteriophage F387/08
MIKGIAGGIWAALCVSTLTTGETSVISQALAQGTLSIILIIAAFSND

SEQ ID NO: 985 - protein, 46 aa, Unknown
  Description of Unknown: Bacteriophage F387/08
MIKKILIGAALVAALLLILYYGMIYGMIYIVLFISDVIVQIGSLIW

SEQ ID NO: 986 - protein, 462 aa, Unknown
  Description of Unknown: Bacteriophage F387/08
MDIFDTLLKQAGSIDDLAKASNLRHRDLKSIIDNEAKEYAIYTVENRAIPNLIDGFKPVQRFVIARALDLARGNKEKFHKLASVAGGVADLGYHHGETSAQDAGALMANTWNNNYPLLDGQGNFGSRLVQSAAASRYIFCRISDNFRKIYKDTEIAPVHKDKEHVPPAYYLPVIPTVLLNGVRGIATGYSTSILPHSFESVLECTKAALRGEMMEPEVQFPKFNGKIVQTEDGSVELHGVYKETSRNSIYISEIPYKFERASYVEKVLDPLEDAGYITYDDDCSKTGFGFKVKFRKDYALSEDPEQRHAKIMKDFKLIEKMSQYIVVIDENGKLNDKFKTSGELIRHFVEVRKTFTAKRIEHKIAETKQAFNLAQAKAQFIKEVIAGNIVIQGKTRKQLTKEIEQNELFKDHSEKLVSMNIYHITDDEAKKLAQEAKRLAQEVKYWEKTTPEAEYLKDLEEL

SEQ ID NO: 987 - protein, 87 aa, Unknown
  Description of Unknown: Bacteriophage F387/08
MITSLKSDIKNILYISTQADGTRLSHYVKGNIVVLDEFEVNREYPMRQVIQASNYEDGEEYQVVLCVYDDFWVLKLENGDKFLIFNV

SEQ ID NO: 988 - protein, 214 aa, Unknown
  Description of Unknown: Bacteriophage F387/08
MSKVTYIIKASEDALNEKTAAILVQVAKKDFITSSELREILEETMNASSVNSNIGVLIKKGLIEKSGDGLIITGEAQDIISKAAVIYAEENKPELLKKRNTRKARPLTEDMNEHKDLMMKLLGEMEDILPLKELTVYRSNYIAVLEKRTFGIRSLEVNNKGTFRIFGYKISEEHQKHFTDLGMSCRVAATGNTYLDIARTAENIETIIRSIKEL

SEQ ID NO: 989 - protein, 56 aa, Unknown
  Description of Unknown: Bacteriophage F387/08
MELWEIIYEDDVNIRGSIFIKALDKYHAIELFEQLQQQTYINESRYLIKLAMFLVE

SEQ ID NO: 990 - protein, 113 aa, Unknown
  Description of Unknown: Bacteriophage F387/08
MNKFKVLNELQRCVEKVNLNANIPTDCWDVWFRGHFIGYIDKKFTKCYAIYNADGKHIMDVDNYQKALAKFVPLAEAVNSMEWLEKIQGEPVIRQIGIREKKSLWQKIKGFFK

SEQ ID NO: 991 - protein, 141 aa, Unknown
  Description of Unknown: Bacteriophage F387/08
MSKFSEQMNKFVDASRHGALINEPEEVSIPEICFKVADWWDGRLLQRRIVCAANRFELKSGGTIVVPGTRHYSVDMANVLDMFRDKLVSDHVHGDNQGFVDQWGEYFTREEALIIATHAGQVNTVRPKSGPANELFSEDLY

SEQ ID NO: 992 - protein, 100 aa, Unknown
  Description of Unknown: Bacteriophage F387/08
MISTLKNNITLLKIQRKSLQRSLEMMDDNWGTYTNEAGFKMADSKFMKTLMDKEYICPFSHPFNGGAKPFLAEMYKIMTEEMIKDIDYYIKELECKEDKV

SEQ ID NO: 993 - protein, 70 aa, Unknown
  Description of Unknown: Bacteriophage F387/08
VRAISAKADYFNSLNRSEKAQIKRFILELGYVHAGDLKAHIQECGIAKRFDITRNCLNEVIAHVQPSSEE

SEQ ID NO: 994 - protein, 41 aa, Unknown
  Description of Unknown: Bacteriophage F387/08
MYNPVAKNDFNKGGAHKDKKRAAKESKRKQKHKGKDNAHSE

SEQ ID NO: 995 - protein, 40 aa, Unknown
  Description of Unknown: Bacteriophage F387/08
MVHDWNNGTFTVAIIANVEPEEVLEQFQKCVDAYDIGDYL

SEQ ID NO: 996 - protein, 108 aa, Unknown
  Description of Unknown: Bacteriophage F387/08
MNTETLRREDEAKAYHKRVELLSAIKVEYTLQVRLKVLNSWANDLEVKHLEQAVMFTFTQEASKPFSLSADFHTYGIITIKAKDRGDIISGVEYIESILGNRGEVVLA

SEQ ID NO: 997 - protein, 88 aa, Unknown
  Description of Unknown: Bacteriophage F387/08
MSHNLESVIESQRYLEALMNKIALGSLIDLSFQEAMDVCHWMNRRVRPIGKEWYLTAKVKDGRYGLWMSSGAEYITTKEDLNSRWELA

SEQ ID NO: 998 - protein, 90 aa, Unknown
  Description of Unknown: Bacteriophage F387/08
MTKFEIVQEIVTVASILTKFNAEHIMEKRDEFIAFLNEIGIKNEQGRQLNQSNFRKMVSELTDEEKRILVEEYNEGFESIYRTMAMHSNK

SEQ ID NO: 999 - protein, 218 aa, Unknown
  Description of Unknown: Bacteriophage F387/08
MASKQSIPFFDMFLGLLELLFKDGATGRVLFSRVFVVILLALLAFAGYKSDSLITAYVDSTYDKYDKLVQKDRDTRFDNTALEQLQIVHISSGADFSAVFTFRPKNLNYFVDLIAYEGTLPSTVDSKNLGGYPIDKTSAEYSTHLSGRYFWTDKEFVFLPTKRKPPEISYMFSCPYFNLDNVYAGTVEMYWYNSKPALSNERLTSICGQAVRALGRAK

SEQ ID NO: 1000 - protein, 179 aa, Unknown
  Description of Unknown: Bacteriophage F387/08
MAVTGPWVGSSAKAETGEPWMAQAGAKLRLGTPFWMSNMIGRSVFNFSLTVQYRNWNNIYYRGSWQVGGWNWSPKPTTKNTVQGNFEGKEVTLFVSVSGQGGVNYWNGDPQGTTLGIRNGDAINLRVMMSDGTTFDFTPGKMDGDVRNYQIASNDEANKLKNWFSDRTDQYWQGLITRR

SEQ ID NO: 1001 - protein, 1525 aa, Unknown
  Description of Unknown: Bacteriophage F387/08
MADQNLKQIQFKRTSTENKAPGADIVARGEIVLNTHGRTLAIYTKDEADNVVQLAGKGVPFLDTAGNLNVDGITTLKDNVTISPNKAINFEATDLSGAIVRHIVGKCATNDGWYIGAGGTSNSGILEIGTIDDGAETIQFVQRGSGNVEARKLVLLDGSGNTTLPGDLRLSTNKTVKINNGSTLVLEMGVGSNDAYIKNQRGVGVLQLTNDSNLTFRNSQVYYAMNGRGPGKSGTLLTNVENNRQAWQYVISAATAGTPRWVKVATIKHPGDASSQLDLMITGGIDSGHGRHYVDFITLSGRNLTSWSTSNLDNWVEWRRIGSPNKGNVPEYYVVKNDAATDSEASFDFYAKVPRYGNGLYVTVLNTAEYNGQDSGKVIIYETGQDTGATTPSGSILVSMKQVFDSISKPDFSDTTGTLPVNRGGTGATNVGDARNNLGLRTAAVRDVGESSGNVMEVGAFGIGGNGKSLVDITSDVDLMTRLKALGGTTFRANVASGYTGAPYYSHGAGFFSRTGDTMSALNIDYATGNVRVFAINDSGLASGRVNSNVLYGTANKPSKADVGLGNLTNDTQVKKAGDTMTGDLTVPNLHASGTGTASVYVNAGSGNAHVWFRTGGNERGVIWATPNTADLGQINIRAKTTGDVSAGDFSFRSDGRLDVPVAVKVGGAAMLTKDGNITSGSMFGGNLNNYLTSIKNDITTGDSKQVSKTGDTMTGNLTINANLKVENPNGSMVDLGSENSDKYSRLTLARKVGSGAAVAMLKITPEGYVQFGYQDAVATPAPSKYIRVKPDGLDVEGDLVFNQTYRGTEDAINITDKTNDLNNMVIKGSDLGTRQLYKCVSSGGGSNISNKPTSDGNFVLEVLSLRKISDSDWTCKQTFTTKNGNVEGTYVRYCQNGTWSAWKEVVAGVQPINLGGTGATSVAAARNNLGVGEGQSVKFGWLVVNGVGTSDPTITFKNGAVVREAQGGSTGALIMSASATAAASAKYIAFRPFGDSSGSEIRVKANGSEPLLEWSYGPGIRSNDSGAFVIYAKTGQALHLRPNGDDSNQATVIDQKGKMTVGGEFEAQNSKITGNLNVSEDNRMIVLGKNSDIGLVKKNGMPGKMAIGKSNSFTVMVSANTNNQINPADTFSDIFKVDASGNQTVYGNAQINRQLTVTSNTNLNSDLIVKGNSRFSGVINADGNINVASGKFVIAGQAPTDNSHLTNKKYVDDKVASAISNAGDTYLPLAGGTVTGTLIVTGNQLKTTSLWTTGDAAVNGVLTVDGKARFNQEFSVSTSVNVQNTGNSHVFFRKADGTEKGLLWADEPGNVSIRAGGASGPVWNFWASGSCQFPGAISNYNGISSTTNYPAGQPNGTYNNTAGLVSRFSNGAYASLYFQEYVGNFHQAIINVNGFGRDDSFYFRAGGDFICTRNGSFDNVEIRSDRRAKSDIKVIENALEKVETLSGNTYELHNTSGGTTRSAGLIAQEVQEVLPEAVTQDIEADGGLLRLNYNSVIALLVESVKELSAEVKGLKAEIEELKSK

SEQ ID NO: 1002 - protein, 220 aa, Unknown
  Description of Unknown: Bacteriophage F387/08
MADLKAGSTVGGNPIWHAGTFPLVPAGNSLTYRGKKVYTEIDKPQAADNDFVSKANGGSYSRTVTFETGLRVQTTGSGGMELVNGGVDGATLNGVNAKIKTWWGLGFESNSGSNGITIAFDLRSGNITTKGGITSNNQVSVAAAAPTANSHLTRKDYVDELINTVSNVANAAVKKAGDTMTGVLRANAGVVIVNKATSGEYAPRLDQVISRGVTIDFGTY

SEQ ID NO: 1003 - protein, 378 aa, Unknown
  Description of Unknown: Bacteriophage F387/08
MADPILMAAFGEDFVETRILSEANSVKYWLKAYATHSNAVPNKPELNINGAFDMTSSLRRGINVVQVNGDRFINFKTFDVTTDDNNANNKAFVEYANGLTSGLYIIMTHERFQSSPLIDRWFKNKWSASWPGSDFSKSFPNSAYVGVLGAAKGRILIESFYGNDGKVKEDSRAKVDTVYDNVGDVGYTGCPYRSIEDTNEYSDSTGYEYKRYPVQNESISKIADYGLSPGDSVFLVCDMYASKSLLDAGSTTRASLRWFKGTSLLSSNVSLEVPKNGADRWLRFERFTAVPTDADGFTIVVSRYPKTSVVGDSKIKNLVFVQTSHGEQLNSVIQEFGVNGIRMNKGVEGGTTMIMELPNSKVDPSGVIPVQSFRETSD

SEQ ID NO: 1004 - protein, 1281 aa, Unknown
  Description of Unknown: Bacteriophage F387/08
MSDLLKQHFRATNGLDAGGNKVINVALADRNVKTDGVSVEYVIQENTIQKYDPTRGYLTDFAVTYGRRIWIANKDIPKPAGEFNQANWTSLRVDPNWIYTVRKGEFEIQSGQFINVDSNAAGNATLLLPLAPDEGDTIVVRDIGGRPGYNGILIKAQDTGASIVFGESRLREVRLTRPYSQIMLTFSNGAWRASLTDFGDTAKMVVPNGIVPTQVQSGDNVVRRYTSNSEIFITLPLFANSNDIINFTDLDGTSPINHMTVRTFDPTISIGTPGQTEIQVRTSGSGFLVYDAIDKIWRIFENDLRTRVRIITSDVTLMPNEHISVFGADNSTVKTINITLPTDVAVGDTVKIAMNYMRKGQTVVIKASDGDTIASNLNLLQFPKRSEYPPDAAWVQSSSITFNGTTSYVPVLELAYIEDKASGKSYWIVTESDPTVERVDAKDNTTRARLGVIALATQAQANAESNPEKELAITPETLNGRRSTETQTGIARIATSGEVNQATTASYLDNVIVTPKKLNERSATETRRGLAEIASNAKMDAGTDDFTIVTPKKLLYRTTSDSRLGVIQLVKTGGAPNTTADRSSAGTGIFDHSDYKNAVTPKTLREYKATVNQSGIVWLASDSEVRNGTPASSNIPTVVTPESLHKKVATDGAIGLIQIATQTEVNAGGVTNKAVTPKTLNDRTATNDRTGIARFATPGAQGEFEAGTSSTVMVNPKLLFDKFANTSRIQVNTSSGLTITGNLWDHYTINIQEASTSQRGTTTLATAAEVRTGTDAKKIVTAATLHAKTATEGAIGLAQYATQAQVDAGTLSDRIVPPAYLKQTIQVTESWQATDSVRGTVRLSTGDGTWKGNDTNGSTLPDNGYASKGVAVSPYELNLTLKHYLPRLGKAYDTGMLGGQTPDKYARRDIAQTISGAWTFSQDTVFNNNISVQNILYANGGEVKISPTADTGNAHVRFQNRDGTERGIIYAETQTASAGNLKVRVKNGTGTTAASQTYTFGGNGTLDVPNEVSTKTLRSSGNTIVGGTVMVKDTVLLTIETQNAIIGARSHSAFIDTRDADTQIFARDNTNSYPILTTKNYARLADGRYVKKAGDTMTGNLNINSSAIVITGSESWYVPTNDTVLRQGSWTAEIKDATKLKGLRGYMVPIRTPIDPANPSTLVVTGYEEKTAAGGVLTQVGVTTNNTYQLWTPYPPTTETADKRFAHTVWMRIYNPNLNKFDDWMRVFTSATPPTAADIGAPSSVSTQVKTLEVLEWIKLGPVKIWPDRPNQTLKFEWVGD

SEQ ID NO: 1005 - protein, 308 aa, Unknown
  Description of Unknown: Bacteriophage F387/08
MSDLNCLFAEEDQVKEGVILIDLSQIAMATILHTYKEGDKLTTPMVRHLILSTLKFNAFKWKKDGYTKIVICVDNAVNGYWRRDVAYYYKKNRAKAREESNWDWEGYFEGLRTVIDEFKQYMPYYVIDIDKAEADDSIAVLTKKFSLEGHPVMIVSSDGDFTQLHKYPNVKQWSPMQKKLVKSKTGSPALDCMVKIIKGDKKDNVASIKVRSDFWYTHVDGERTPSTKMTFVEECLDAGENIKDLLTEEQYKRFLENRVLIDFDYIREDIVANILDCYNNYQLPGRGKIYSYFVKSGLSKLMKEINNF

SEQ ID NO: 1006 - protein, 90 aa, Unknown
  Description of Unknown: Bacteriophage F387/08
MAKKEKEQVVFDEAVHGQALRDMIKEASGNKLKAESYLELNKDIKDRAKKELGVEGKLFNQLLALFHKGTRDRFETEKDEVVEAYDSIFA

SEQ ID NO: 1007 - protein, 99 aa, Unknown
  Description of Unknown: Bacteriophage F387/08
MTLFSLKDEGDTSPSESINQLLDKQANGFAIESMVTELGMGYLEATTQWLEENSIPEGNFSRYIPPAIIEKIMSEALEENMLRPSFSQTHKTNSLDFLL

SEQ ID NO: 1008 - protein, 220 aa, Unknown
  Description of Unknown: Bacteriophage F387/08
MIRLRMPQNNNRYVNGKSVYLLYLMLKQHFAGRYDVVKYNWVMRVSDKAYQKRRDKYFFEKLAEKYTLKELTLIFMSNLVANQDAWIGDISDADALIFYREYIGKLKQIKTTFSEDVKNIYYFAKKVNVDKLHDIFEYNEKVGTSYVFKLLQSNVISFETFIMLDSFLDIINTHDTATDNLVWSNYSTKLKAYKKLLNVDGAEAKKLFISIIKSCKEISI

SEQ ID NO: 1009 - protein, 305 aa, Unknown
  Description of Unknown: Bacteriophage F387/08
MFKRKNPAQLQQQLAGLKGGSSFSNEDKNEWKLKTDNAGNGQAVIRFLPGKDENSLPFVKLINHGFKHAGKWYIENCTSTHGDFDSCPVCAHLSKNDSYNSNPAEYKLLKRKTSFWSNILVIKDPANPENEGKVFKFRFGQKIMDKINAMVEVDVDMGETPVDVTCVYEGANFVMKVKKVGGFQNYDECKFLGQSEIANINDEETQKFLTENMADLSEIVAPSQFKSFEVNEAKFKQIMGTAALGGAAAKAAAQADKIGDDLDSFDKDLSDFESKPTSSRSADDIMGDAGDSVGDDDLNDILNDL

SEQ ID NO: 1010 - protein, 85 aa, Unknown
  Description of Unknown: Bacteriophage F387/08
MGKLNIDIVAEPYINKSGFCTDLIFEDGSRFYDTDHGIDFDLVIKEGPGGGWPNIDLRGSKEAVRAWLEANEWEDIDLMMEDWKE

SEQ ID NO: 1011 - protein, 73 aa, Unknown
  Description of Unknown: Bacteriophage F387/08
MAQVTVEIYDYEHFIETIEKYGLIEVSNKSAPWGGNEITVEGDTPTLWLWLEQEYFPGMDDECREDTLTTFSG

SEQ ID NO: 1012 - protein, 121 aa, Unknown
  Description of Unknown: Bacteriophage F387/08
MKLNTEYRIIPSLAAEWDLSSSGNRRMRLMIEEHGGSFFPTKMLDEDNSFITEVKFKDGTTADAEGFGDAYFEISDYEFKYFEPVYEIGSAIQPGPTRLDLIVTPENAEEMIDLIKKVFKK

SEQ ID NO: 1013 - protein, 92 aa, Unknown
  Description of Unknown: Bacteriophage F387/08
MKLQRQSIKLGSEYRGKWNFCICDKNPEELERVEEVLCQMEAPFTMGGETVYWNDYCDNCPCYEDGYGSGFWIPVEDVEEFKKAFKLAKAKK

SEQ ID NO: 1014 - protein, 106 aa, Unknown
  Description of Unknown: Bacteriophage F387/08
MSKFSVTGYPRVNIRCQFDEIPGVTHIELVFDPHSRCNQVSGKIDSAYGEFLINDQVVVSAISGEQAGSLYILKREVFEEISEAIKEGFKTLQSMIKASEYKSCGF

SEQ ID NO: 1015 - protein, 54 aa, Unknown
  Description of Unknown: Bacteriophage F387/08
MENFAVDDYDDLIWWDGREWVTICAMSNIDSAIKRLQELQQKWEDGNVERVEFY

SEQ ID NO: 1016 - protein, 199 aa, Unknown
  Description of Unknown: Bacteriophage F387/08
MIQIVYAFAPTKTVDGKNENAFGLGDGLPWKHISQDMKNFANRTRDTILICGAKTFMSFPEPLPGRKTIVVQDMSRALATAKNGFFADAYVSELEFIGFLGGDIMAAHTSYNSTITFNRDLNYSIIGGAGIIQKAYPYADRVIQTIIRKSHRVNSDVTLPAEFVTAPTWPESGFITKENHWYHIDEVTNISEVVYERKL

SEQ ID NO: 1017 - protein, 105 aa, Unknown
  Description of Unknown: Bacteriophage F387/08
MSANYDITQLSEDKVQKRWKRFPFKHGIHLLVFSYNGLSTYNGSTTVYNRNGNIPIEIERDYKKMFIGMSHGNVTVNDDVVSIIGRFEKRGDQLFFTPLQEKFNA

SEQ ID NO: 1018 - protein, 286 aa, Unknown
  Description of Unknown: Bacteriophage F387/08
MREYQELIKDIFENGYETDDRTGTGTIAKFGTQHRFDLQEGFPAVTTKRLAWKACIAELIWFMCGSTNVHELRLIQHDSLLEGKTVWDDNYENQAKDMGYSGGELGPVYGKQWRDFMGVDQLKLIIDRIKQLPYDRRQIVTAWNPVDLDKMALPPCHLLYQFNVRQGHLDLQWYQRSVDVFLGLPFNIASYAALVHIIAKMTNLKPGHLVFTGGNTHIYLNHIEQCKEILRREPKELCELEIAFPDTYETWQTSSQIRWLEQFARPHHFELVGYKSHPTIKGKMAI

SEQ ID NO: 1019 - protein, 68 aa, Unknown
  Description of Unknown: Bacteriophage F387/08
MNIRFVRKGHQSKTVLGEMQDAFSSDLPEVNDTIVFDGTEQRVLSVIKSYEWSIGKTQLICWFEVDIT

SEQ ID NO: 1020 - protein, 101 aa, Unknown
  Description of Unknown: Bacteriophage F387/08
MKICRVVNKYHSDFDVNIQRGTMWGNYVGKDCDNRPDAIAAFKDDFIAKIRNGEIKREHLETLRGMRLGCTCKPLPCHGDIIALVVNKLFKDTFELEDLCK

SEQ ID NO: 1021 - protein, 748 aa, Unknown
  Description of Unknown: Bacteriophage F387/08
MQVIKSSGVSQEFDMQKIIKVLEWACEGTKVDPYELYEIIKSHLRDGMSTADIQKTIVKVAANSISIDEPDYQYVASNAAMFEIRKRVYGQFEPPAFIDHISRCVNANKYDKEILSKWSAEEITLLDSYIKHERDFTMTYAGTMQLIEKYLVKDRHTGELYETPQFAFMLIGMCLHQDDGENRLANVIRFYDAVSTKKISLPTPIMSGVRTPTRQFSSCVVIEGGDSLNSINEAAASITKYISKRAGIGINAGMIRAEGSKIGFGEVKHTGVIPFWKHFQTAVKSCSQGGVRGGAATLYYPIWHLEVENLLVLKNNKGVDENRIRHLDYGVQINNLMIERLIKNDYITLFSPDVCLGALYTEYFRDAQAFRTLYEELEKNPDIRKKRIKARELFELFLTERAGTARIYPYMVDNVGEYGPFIRDVATVKQSNLCLEIALPTSDVGQEDGEIALCTLAAFVLDNFNWQDQEEVNEIAEVMVRALDNLLDYQDYPVDKALKAKDRRALGVGITNYAAWLASNFASYADANDITHEMMERIQYALIKASVKLASEKGPCALYKETRYGRGELPIDWYNKRIDQLAAPNYVCDWELLREDLKRYGIRNSTLSALMPCESSSQVSNSTNGIEPPRGPVSVKESKEGSFNQVVPNVEHNASLYDYAWQLAKQGNKPYLNQVLIMQKFVDQSISANTYYDPANFPKGKVEMSVMMDDLLYFWYFGGKTLYYHNTRDGSGNDDMIQDSADCAACKL

SEQ ID NO: 1022 - protein, 213 aa, Unknown
  Description of Unknown: Bacteriophage F387/08
MNYQNVYNSLISRARARESLLGYKETHHIIPRCIGGSDDKENLVELTGREHFIAHWLLCKIYEAPGLKKAFGLMCLTGKNRSYKVSSQLYELGKRRLSEAATGRKASIETREKISKSLKGREFTEEHLANMRKPKTEETKKNIAAAKVGVLNPMYGKISPTRDVPHTKETRDVISLRTKQGTEYPPCPHCGKKVNKGNALRWHYDKCKFKDPK

SEQ ID NO: 1023 - protein, 380 aa, Unknown
  Description of Unknown: Bacteriophage F387/08
MSTVFNKEPVDIMNEPMFLGSGLGIARYDVQRHKVFEELIEKSLSFFWRPEEVNVMMDRGQFEKLPEHQRNIFTDNLKYQSLLDSIQGRAPAAVLSALISDPSLDTWNQTWTFSETIHSRSYTHIMRNLYVDPAKIFDEIVLDEAIMKRAESIGVYYDDVIAKTRAWENAKNRCFNQDNIEIKEAKRDLMKSLYLCLHVINALEAIRFYVSFACTFNFHKNMEIMEGNAKIMKFIARDEQLHLKGTQYILRQLQTGTDGEEWVEIAKECEQEAIEIFMEVNRQEKDWAIHLFRNGGLPGLNVKILHDFIDYLTVSRMRSCGLPCPITDAPTRHPIPWIREYLNSDAVQSAPQEVEISSYLVAQIDNDVTDDVLIGFKRYL

SEQ ID NO: 1024 - protein, 138 aa, Unknown
  Description of Unknown: Bacteriophage F387/08
MNDIANEFSFIKYVQLELEPDFSIKPVLVANKLNVVYAIAVDDELVYIGKTKNLRKRINYYRTAINRKDQTSDSAKSAKIFEALMAGKKVEFYARQCFNLLINNELGEMSISTMDLEEPMFIKKFNPPWNTQHKVKKC

SEQ ID NO: 1025 - protein, 383 aa, Unknown
  Description of Unknown: Bacteriophage F387/08
MLELYKNLMNLCESSEVAKFFYKDFTGPMDGKFRVFSYHYASYSEWLKPDALECRGIMFEMDGDTPIRIASRPMEKFFNLNENPLTMGIDISDVEYIMDKADGSLVSSYVDDGYLYLKSKTSLYSDQARQASALLNSEEYSSLHQVILELALDGYTVNMEFVSPNNRVVLAYQEPQLFVLNVRNNTTGEYIKYDDLYANAKIRPYLINAYGISDPTTWVEGVRELEGVEGYIAVLNTGQRFKVKTEWYSALHHTKDSITSNERLFASVVSANSDDLRSLFAGDEYTIKKISAFEQAYLDYLGKSLELCQSFYDEYRGRARKDYAIAAQKATVNQRHLFGVIMNMYEGTVDVDKLLKDLERVFLKYWAGYVPKEYEKEIEISEE

SEQ ID NO: 1026 - protein, 169 aa, Unknown
  Description of Unknown: Bacteriophage F387/08
MDMQAITLDMVVNKYGTHSDGIFVWNGTKKVGFVTDLRTHMARKEAARKKQKEYTNRVNEQRAEALPEAVDEMIDFLDNHLAKYGAEVFKNITQPNVHANGCKCYVIVDPIYGKHRLGIMHRELNYSEMAEYVEACFKCSPSESSDRHILISGLSRDDIVEVILKLCSK

SEQ ID NO: 1027 - protein, 117 aa, Unknown
  Description of Unknown: Bacteriophage F387/08
MLKINTTWLLIGVLALSAGGLKYLSWRVENLKADLKVVQDESDRQAKEIENIGVSIKNLQTTYKGYQENRAARDTSNAKMNKDSKRGNVVAAKPGLVEKQINASFNKFAEDIQEATR

SEQ ID NO: 1028 - protein, 95 aa, Unknown
  Description of Unknown: Bacteriophage F387/08
MKRSLLAMCIISLLAGCSSSAPDVPVLHPEWPDPIQKWEGHWEVKVIDGKAWVGMPFEESQEYRIWMNDILRYTKDANGMICYYRSELKEPRCVK

SEQ ID NO: 1029 - protein, 161 aa, Unknown
  Description of Unknown: Bacteriophage F387/08
MEPSHFYSYFVKDASHLLSIKNTQLRNMLAVGSCQLTPLAKKATVIPENISNGYVYTVRVSVPGALKERLFELNDQTRISFDVWFKLFMVEFMYPDFLKFVQRKEALKEAISELEDASIEFGKALQFVESGGVEQDAVNGFLKKYGKRRSLAHRNLSKMVM

SEQ ID NO: 1030 - protein, 70 aa, Unknown
  Description of Unknown: Bacteriophage F387/08
VNQEQYETLKGLIAENELACIVFGRAAENYDKNDILSMNKPLRAIKEKYRANWGEKSKALHDFIDTLKDV

SEQ ID NO: 1031 - protein, 297 aa, Unknown
  Description of Unknown: Bacteriophage F387/08
MKKLVLTQGAPGSGKTTWANEYVAANPGWYVLSRDDLREGIFGLDKRNDYKYSKLREKSVSVCQFSMAKTLLEMETTKGVIIADTNLNPTTIKKWQELAYEIDGVKWEIKRFDVPWTELVKRNLYRGANAVPIEVLRSFYSKMHPYDLYIPDESLPKAVIFDLDGTLADNNHRSPYDLAKCGKDHPKEMVIEFLKMLRNKGYKILTVSGRESGTKEDPTVYQRITKKWLLDHVGETGEHFQRKQGDSRKDDVVKEEIFWDRIADRYNVKLAVDDRAQVVEMWRRIGVECWQVAHGDF

SEQ ID NO: 1032 - protein, 94 aa, Unknown
  Description of Unknown: Bacteriophage F387/08
MFPKYSEVVKVSFTQVVANHLTDEFTPAEVAKMHAEFLSAMNALIPNGEVVKFSIDRLGGSSEIKISCGEGEHDWFIVGIIANFETQQVETYVV

SEQ ID NO: 1033 - protein, 78 aa, Unknown
  Description of Unknown: Bacteriophage F387/08
MLSDAKFSHDEFISKVKIFAQEVANRVPGSKVTLRRESSFNYVDAYIITVNNGKSNQHTQLALTGTGQVEMTNILGHI

SEQ ID NO: 1034 - protein, 114 aa, Unknown
  Description of Unknown: Bacteriophage F387/08
MTLREAVEALLIEHARGIKAEISPNGIRLISAVIGSDQGVWSIPREEYDAILYSNVNVKEGQPMYGYVFSDSLERGNHPFPDGTGIRTSRVESFASPTDELKLVKTNNTTYLVI

SEQ ID NO: 1035 - protein, 189 aa, Unknown
  Description of Unknown: Bacteriophage F387/08
MKASTVLQIAYLVSQESKCCSWKVGAVIEKNGRIISTGYNGSPSGGVNCCDHAAEQGWIGEIPYKSTGLRQDGFQVKKVGLLKEHRAAHSAWSKVNEIHAELNAILFAARNGSSIDGATMYVTLSPCPDCAKAIAQSGIKKLVYCETYDKNEPGWDDILRSAGIEVFNVPKRNLDKLNWYNIKEFCGIE

SEQ ID NO: 1036 - protein, 66 aa, Unknown
  Description of Unknown: Bacteriophage F387/08
MKLRIVEINKLNLSGDVVISYSVERRYWFKWKPLATFKFEDQAVRLLKELSKRKSVIIKTIKETSK

SEQ ID NO: 1037 - protein, 102 aa, Unknown
  Description of Unknown: Bacteriophage F387/08
MKLTTEQNIHIRETLKAVLSMGESQIVFEKADGTIRTLRCTRDKDIIPSDLVESTTKSARAESTTSLPVYDTEKEGWRSFAFDKLISVNGMKVEHLLQMIGK

SEQ ID NO: 1038 - protein, 107 aa, Unknown
  Description of Unknown: Bacteriophage F387/08
MELPIKALGEYVILVSEPAQQGDEIVSPSGIILGKEEQGQLPDMCEIYSIGDDVPKGFVEVGDLTPLPVGNIRNVPHPLVAAGVKKPKEIRQKFVTCHYKSLACVYK

SEQ ID NO: 1039 - protein, 82 aa, Unknown
  Description of Unknown: Bacteriophage F387/08
MNKQLTKALELQRNAWNSGHENYGASIDIYAEALEVLKGFKHLNPAQAEFRDTLEAMDELKYAKHLGSAARKAVRHFVVTLK

SEQ ID NO: 1040 - protein, 63 aa, Unknown
  Description of Unknown: Bacteriophage F387/08
MEDDKMAKQAKAKTAVKEVVGTSKRAGYKRGSNKRINQTVEKIMRRARAVLRDDASRFGKPKA

SEQ ID NO: 1041 - protein, 119 aa, Unknown
  Description of Unknown: Bacteriophage F387/08
MNFTNFNRKYVQNNAWDVSTTLLWEHNNGTVAQIDMYWEDNYVFFSFENGPTLDIQFNGSEIKVGFHDEVRKRDLSSHPSWNTNRQLLVKIYLRHILGRKTTEEQREAIWDIVSNEIKF

SEQ ID NO: 1042 - protein, 160 aa, Unknown
  Description of Unknown: Bacteriophage F387/08
MEKGKFYKLKKTPSLSPGALIKGVFEQIGNNPIKITRTFKYAENTGLVEFEIIKPDGEYKRVSIDEVRFSRMWCIITNQEFQHYFEETTHKEPEPKTDDGSNDWGVWTSNKGNDTYKGGLTKEEAVNLAKVQRLNATKDTKVVIMQPFAVPVVHVNIRPF

SEQ ID NO: 1043 - protein, 92 aa, Unknown
  Description of Unknown: Bacteriophage F387/08
MIVSAFYDSRKKKVETIISDTRDGTPANKNGVKAYIDKYCPPEFRMIDGVDSLSINIINAKIEFINETVPIGYSDGDGSNAKMPKEKFITKF

SEQ ID NO: 1044 - protein, 56 aa, Unknown
  Description of Unknown: Bacteriophage F387/08
MIVSVPKSKDGIFSCGLKNHPMVDIMSANVKQHTVEYEIDAPDFFELPEWAVRLDA

SEQ ID NO: 1045 - protein, 66 aa, Unknown
  Description of Unknown: Bacteriophage F387/08
MKYHIFNTVRLANGIPGVVCDTAPAIKAYSVEPWYEVNWVDGNRSIHAESELYPITQLRAANDDVY

SEQ ID NO: 1046 - protein, 69 aa, Unknown
  Description of Unknown: Bacteriophage F387/08
MSINPHFGHMVARRITREMLKTAEYYNIELIDIEPSDAPGLIWFNFTGAANSVAKFKQALRNFPECQNQ

SEQ ID NO: 1047 - protein, 280 aa, Unknown
  Description of Unknown: Bacteriophage F387/08
MSKPVIATDVDGIIVKWQSGLPYFAQKYNLPVEHILDMMTTEKFIKPAELFDCEEDLAVKLLLKYNNSDFIRYLAPYADALATVNKLKEKYDFVAITALGNSVDANLNRRFNLNALFPDAFTEIMVCDYDESKDALLEKAKVKYGDRIVCYVDDLPKHIAAASKVFEDTETRVFYMPRGEREGSVTAPGIMVEDWHQIVTCLESLESVKKPQKSLSRLWEEAIKDQIRKEQHPFNWPPRQVPGDWWKQPIIPFSPSPHVPPGNDWWNNGRITCDNHQINC

SEQ ID NO: 1048 - protein, 68 aa, Unknown
  Description of Unknown: Bacteriophage F387/08
MFVVHTKVGKRWLSCDYGHVNQFYRWNPIWREAKACPIWNECINNGFVYIDGLTYHRSVSELSKELGE

SEQ ID NO: 1049 - protein, 490 aa, Unknown
  Description of Unknown: Bacteriophage F387/08
MIFDIIKAIEDAKGSKAKTQILIDNKDNVDLKRAYLLAYSGRFKFFIKKVPEYTPVKYPNVPSKTFSDGLDYLQDILAARVLTGNMAIQGLVDLLSKMNEGDASVLVRVLLKDMRCGASGSIANKVWKKLIPEMPQMLASAYSEKALSYIKFPAFAQLKADGARCFAEIRGDDLDDVTLLTRSGNEYLGLDKLKRQLIEMTKEARERHPNGVMIDGELVYHVEVKEEENDLFDMFKEPELPELSKAKEFQQTARTESNGLANKAIKGTISAEEAEGMRFQVWDYVPLDVVYSEGKVPGFAYDVRFRALEMMSKGYDKIILIENHVVHNIHEARAIYKTYVDQGLEGIILKNIGAYWEDKRSKNLVKFKEVITVDLKCVGSYEHRKQPGKMGGLMFVSECGRIRVNAGSGLKDKPEELHELDRTHLWKIRDSLPGTIWELECNGWVTAEGRDDGTVGLFLPIIKQRRYDKEVANTFEAAFGVNFTEATGIK

SEQ ID NO: 1050 - protein, 59 aa, Unknown
  Description of Unknown: Bacteriophage F387/08
MKVLYEVIAKTDDGRGGISVHTEVLDFDNIDVFKNFKENIEEYESVNGLQVWRTATIIN

SEQ ID NO: 1051 - protein, 708 aa, Unknown
  Description of Unknown: Bacteriophage F387/08
MELLNEVFDEENSKIYPVENVKPKLKVPQVFLIKVPGNNNLMIRLVHGSGQGDAVKNIKMGDKFIQVYVFSVSEKGNIGALKGGLGQDPIGAINTIFETVNKVVKQIKADAVMFRFNPKKMQGQDKAIQRILARLITTRTGGRFNLMKDMAYYKGKYAYSIMVHKGKKLEEIEGIPEISDELYTKVESKVGEIYVSKETGESVTKAEALANSIGEKEDKKSELAVMSKMKVSRKDLIRAQYGKFVSYVDEDWPENKRERWYELTTNTPVLNAEGDTVDLQKDIKAGLEKSIPFYVDDIKHYRVRGGYGSNFGDAVERLFVGQMSRMHDDWKVFIPSGSDKMKIAEQRISDVADVIAQAKNPASMETMRKIVEVATRGFDMPPADDFGALRQYQNLVNYMISAYVSIVGDSISKAIEYNREMQSRLSEEERDAIHHYCGSGYSFVNNYLIGMESLGDPIIDKKIRPLDSAFEKGLRLEPGTLLYRGQRGKYEDFKDNIESKMFYFQNYVSTSLSPIIFGAYSNAGDSLMPDAPSSDLENKETTANAVSSVIGTDNLERVDRGEEVAYGDEFKFGFVIHGADKVKVVIPGVLSSFSDEAEVILPRGLAMKVNKVWGTPFRNGVGVANNKTFMVEMTVVPPEQIDESVHLYDGDILMEQGKVEPLEESKFKGFLNEIYFSPDRSTDKVSYTRTMELLAGAINLDGIPEKLA

SEQ ID NO: 1052 - protein, 92 aa, Unknown
  Description of Unknown: Bacteriophage F387/08
MKHVFRFNGIEWSADVKDAEKFNEEVLIMLEGFNEGTPTVLIQDIFRKPTEPSFVEAVLNGKAEGIIPVKVVWTTKEMKLLRTEPGFIGCIA

SEQ ID NO: 1053 - protein, 308 aa, Unknown
  Description of Unknown: Bacteriophage F387/08
MFTLEEFKSQAADIDFQRTNMFSVVFATVPSSKTQALLNDFGGELYNNMGLDGNWLGLTPGEFNQGITTIVTQGTRQVVRKSGVNTFMIGAMTQRVVQSLLGEFTVGTYLLDFFNMAFPTAGLMVYSAKIPENRLSYEMDKFHNAPNIKITGRDMEPLVLSFRMDPEASNYRAMQDWVNAVEDPVTGLRGLPQDVECDIQVNLHARNGLPHTVCLFSGAMPVACGAPEFTYDGENTIAVFDVTFAYRSMQTGSVGKQAAMDWLEDKTIQKIETINPNQGLSTSASRLSRLGGAGGGISNITTSTSRII

SEQ ID NO: 1054 - protein, 350 aa, Unknown
  Description of Unknown: Bacteriophage F387/08
MIFEELADGLENIKKSGTRISQGKSKLTNAPTTKVAQFPAERSAGNDSAQDMRVHDLYRNGLLFTAYDFKGRTTPDLRSFRRDVMLSSVFDSPMSALANSSSSTTSTAPVANILLPRSKSDVDSVSHKFNDVGDSLVTRGSGTATGVLSNVASTAVFGSIESLTQGLMADNGEQIYNTARSMYAGPDNRTKVFTWDLTPRSADDLIQIIRIYEIFNYYSYGVTGNSSYAKEVKAAIDEWYKGTLKSAAPDGAKVENTVFEQITSFLSNVIVVSNPTIWTVRNFGYSTSMDGREDIFGPCQIQSIRFDKTPNGHFNGLAIAPNLPSTFTLEITMREILTLNRGNVYIGGIE

SEQ ID NO: 1055 - protein, 577 aa, Unknown
  Description of Unknown: Bacteriophage F387/08
MTKKSEMNSMRRRVIADSAPQKKAESQADAQINTLEDIGRRLDDQQASTDLISDVIETKSNEIIKSVEDVSAGVELTAEASERTTDAVSKLNDTASLINDKLTKLADLLSKKHDVQQDVQKTGTGTSLETITEQVPDAPVQQPLEELLERLIPPQDDRRPDADFFPNTEEQEERKEPNKETEDKNKKFLGLKFGELIKSVKSGFGKTISLTDKISSMLFSYTVSALAQMAKTAAMVLGVIMLIDLIKVHFNYWTKLFEKNFVEFNKQAKEWGPLLTAISEMSNEIVKSFVKGDWGGLAKAIGSGLVDVIDKLGETIMLGMSKLLAGMLRALGFNDSADNIEGAALDRFQTVTGAELDEEDAKMRAKYVDRQEREYDEQPEWKRKLSAKFQKFTGQIDDDEYNKLLSGEKKQSAYADLPEDERLKIITARNNAEAELKRTKAYVEKTDASDSTRLDSAKDAVQSTTTRYKELEKLSPEVAKDLKVELDQLQKLLDSKISEPAPTAEAIPATEQPEVKQSASIKAAADSREAARTRESNTQSQPIQVNTAVNKNSTYVYRTPPQTSTAAPGMQGAMKTS

SEQ ID NO: 1056 - protein, 175 aa, Unknown
  Description of Unknown: Bacteriophage F387/08
MNLNVILPIKKIVINEKTISIPKLGLKHHNLMKDVKGPDENMNLLLDSICPGLTAAESDIVVLHLLAFNNRIKETVVKDDFTYDLNKVYICQRLTQRLDGKEFKFRAPPRYSKLGSVDSILSEFLESVDGKPMDINFMKLPAFVTKWADDLVNTIAIDGPEGPIKGMLNVMEIFE

SEQ ID NO: 1057 - protein, 380 aa, Unknown
  Description of Unknown: Bacteriophage F387/08
MTAQRLGYPNISIKLYSGYDAWLANRFVELAATFITLTMRDSLRGTNEGLLQFYDSKNMHTRMNGDELVQISVANSNTSRTQTRIYGIKHFTVGVDDKGDSIITLQLGTLHDIMNLKFSRAFFSSAYETIKEMIGAMYVDQPLIAPPINGINAYVPRVPWTSTLKDYLRYVRNVGISTDNDQFIFAWEDITGINMMDYESMISQNPNVFMFGAPQTIGQFAAGLKYPLAWDFEWLVKSNRYNRNPMKNATFYAHSFVDKDVTRIINGEGQNSVFINRSGGYSDMIFRNGYEEALRISTMAQYDGYAQTKCYGNFELTPGMKINFVDLKDQFRTDFYVDEVIHEISNNTSITNLYMFTNGSALEPVDLIKVKNELKRDSSY

SEQ ID NO: 1058 - protein, 252 aa, Unknown
  Description of Unknown: Bacteriophage F387/08
MANIVRCELPDGVQRFKPFTVEDYRDLLLVRNDMNTKSEEEQKQLIAELMDDYFHDHPAEYRPYIFLKVFLSSIGKTKIPVRMKCPKCGKYKQYLFNLNQPPLVNPKVEVAGLTLKFKKPIEIIDDTGKMILDNIISVKDSSGEYAWNELSDSNKLTVIDAIDVETLEKILSQMKPFNFELKTSCCDTTTILKYDNIVDIFKLLLHPDEIFTFYQINHRLVSQGKYDLNSIMKMLPIERGITLSLIEKDLKS

SEQ ID NO: 1059 - protein, 209 aa, Unknown
  Description of Unknown: Bacteriophage F387/08
MNITYKFETRINGKNIQCRAFTLEEYANLIAAKKNGTIDECIKALLRECTNATELNKQESELLIVILWAHSIGEVNHEVTWNCTCGRKIPVPLNYTHAQIDPPEDLWYDLKGFKIKFKYPSLFDDSDIPMMISKCIDYIVVGNEQIYFNDLNDAEIDDLYSAITTEDVVNIKNMLLKPQVQLAVPITCECGISHIHVIKGLKEFFKIMS

SEQ ID NO: 1060 - protein, 136 aa, Unknown
  Description of Unknown: Bacteriophage F387/08
MSNIDKLYSDLDPEMRLAWDTDVSKTVGARSVKNSLLGIITTRKGSRPFDPAFGCDITNELFENMTPLTGDTIKRNIVSAVRNYEPRINRLSVDVLPLYDDNAIIVTVQFSIVDDPDTLERIRIQMRSNANSSSRV

SEQ ID NO: 1061 - protein, 138 aa, Unknown
  Description of Unknown: Bacteriophage F387/08
MRLEELQDELDNDLIIDQTKLQYEAANNPVLYGKWVRKHSTCRKEMLRLDALKKQNLKARLDYYTGRGEVGGEVCMDVYEKSEMKTVLSADKEILGVDTKLQYWGILLEFCSDAMDAIKSRGFSIKHIIDLRQFEAGA

SEQ ID NO: 1062 - protein, 55 aa, Unknown
  Description of Unknown: Bacteriophage F387/08
MSNTVCVVCKGPIDEALVVQTDKGPVHPGACYNYAIELPVTEDTEEQLQETQLLI

SEQ ID NO: 1063 - protein, 80 aa, Unknown
  Description of Unknown: Bacteriophage F387/08
MIKFEDIYEATIREATIDNFMSKINACQTLDGLKELEKYYDKRSKETTLADSDDIIVRDALAGRRQALEADSEDDEDEDF

SEQ ID NO: 1064 - protein, 500 aa, Unknown
  Description of Unknown: Bacteriophage F387/08
VHDIQVKFKDFSHVHIECDDSIFYELRDYFSFEADGYRFNPKYRYGHWDGRIRLLDYNRLLPFGLVGQIRKFADQFGYKVYFDPAIFEQETLSREDFDNWLSTKEIYSGLTKIEPHWYQKDAVYEGLVNRRRILNLPTSAGKSLIQALLARYYVENYEGKVLIIVPTTALVDQMIDDFCDYRLFPRNAMLGIRGGTARDSNALVYVSTWQTAVKQPKEWFSQFGMMMNDECHLATGKSISTIIAGLTNCMFKYGLSGSLKDGKANIMQYVGMFGEIFRPVSTSKLMEDGQVTELKINTIFLRYPDAAANALKGKTYQEEIKFITNVKKRNRWIANLATKLAARDENAFVMFKHVAHGKELFEMIKAAGHEHVYYVSGEVNTETRNALKAMAENGKGIIIVASYGVFSTGISVKNLHHVILAHPVKSKIIVLQTIGRVLRKHKDKSLATVWDIIDDLGVKPKSANAKKKYTHLNYCLKHALERIQRYADEKFNYVMKTVNL

SEQ ID NO: 1065 - protein, 264 aa, Unknown
  Description of Unknown: Bacteriophage F387/08
MLDKDYIKEIQALDKKEAKDKLDEYAQTFGIKLKKTRSFDNMVADLEKELAKLANEPMPEDNDGLSIADLIQADDEIEGKAVFKDEASDEAKLLFDAPVNVGIKIHDIDPGFYKETPKVNDPGFEVKTPSINDKGFYAEAPIGDSVIHIDDEGQVTNIPVSITDPEEFSKAMDKVVKIIKTDEIIELPENFSPNMQLLGKNPGYITLPWWIYQWIKDNPDWKSRPTSFEHPSAHQTLFSLIYYIKRNGSVMIRETRNSSFVTLK

SEQ ID NO: 1066 - protein, 469 aa, Unknown
  Description of Unknown: Bacteriophage F387/08
MAYSVSIAPLAASAVIGATTNFTATTSGAAAEGTETFVWTVNGVKQSSVTAAMNYVTAGPAGSKTVKVVATVTPAEGEVETAEAETTLTVKNKTMPAITLTLSPTSVSKEIGQSQVVTADVTGAPSGASIAYVWKRGSSVISGQTGKTITLTESTETSYTLNCEVTVSAPDYNNGTATKGIAVAFTKKTMSGVSVTLSPTSVSKEIGQSQVVTANVVGAPEGASIAYVWKRGTVVIEGQTAKTITITESAEANYTLNCEATVSAPDYNPVTVSKGASVTITKKTMSGVSVTLTPESITVEQGSDASFKADVIGSPEGASGTYSWTKDGSPVEGSTSTLVIDTSDIGSQVIGVSVEVSAEDYNSVTVTTTGNVTITKRVAPTPNGELPYIHPLPFRETAYIWCGWWVMDEIQRMTVEGKDWKLDDPDSDYYLHRYTLAKMLDDYPEVDVQESRNGYIVHRTALEAGIIYP

SEQ ID NO: 1067 - protein, 75 aa, Unknown
  Description of Unknown: Bacteriophage F387/08
MKAIQAHLMHESGKDFQEIARALDITPAEAAKLWVSVEKAHERFKQKEKVVYRKRLTNVGIKSRHKKLVKHMRTL

SEQ ID NO: 1068 - protein, 108 aa, Unknown
  Description of Unknown: Bacteriophage F387/08
MMSKVDPIVVERFEEMLSKKFTPAANGVNVWLFASKFVSKMMAVQSSYYYKSGARKITDLINERYGKIDWMLMDKDIPLVLEVGSKSQFEIMLTKSGYIMYRFVPSGY

SEQ ID NO: 1069 - protein, 85 aa, Unknown
  Description of Unknown: Bacteriophage F387/08
MNLADRMANTAINVATEELSAAKEEVLTQIEKTALAGKRELIMYPSSLVKKHITNVLNYLHDEGFVTNYTSAQRNGDTDFMKITF

SEQ ID NO: 1070 - protein, 335 aa, Unknown
  Description of Unknown: Bacteriophage F387/08
MFAKYSSLENHYNNKFIEKIRGAGFDMHTVEWVAREKIHGTNFSVIITPTEIVPAKRTGPILEGESFFGHEIIMKKYKDSFVKMQNMLNTMDLVSVQIFGEFAGGGIQKGVDYGDKDFYVFDILSDSGNEKVYWDDYVVESFATGLGLKLAPLLGRGSFAELSQYVNDFKSIVNYYNELVDTTDLEHANKHVFGPQASSETGVAEGYVLKPVNPKFFNNGTRVAIKCKNSKFSEKAKSDKPIKAKVELTDTDKRVLEIFSEYVTWNRVSNVLSHIGTVTAKDFGRVMGLTMKDIINEAAREGHDMLFADNPSAVKKELTTLIQNTIRSKWHEVLE

SEQ ID NO: 1071 - protein, 182 aa, Unknown
  Description of Unknown: Bacteriophage F387/08
MRLALIGSREAPRRVLSLMTIIGQRLSEEGHFSYSGGAPGSDEAWLAKYDRSNSCRIIPYSGFCGHVPDTGVVVWSELSNEAKIKSIIKAREVTSYWDECSKIVQTLFARNSMQVLGLECTEPVDKVLYWAPEKRCGSVSGGTRVAVDIARRHGIECVNLYDKNVFKSLEEEYSPRFDIFSL

SEQ ID NO: 1072 - protein, 426 aa, Unknown
  Description of Unknown: Bacteriophage F387/08
MAKINELLRESTTTSSNLIGRPNLVALTRATTKLIYTDLVATQRTKQPVAALYGIKYLNPNGDLTFNTGATYAGQIGAPERESIEELTMANKDSFNKDDMFKYQNVVFKVLKDSPFTDTAETDEFGIVSEAVAANNIRMLSDAAVTEKFEGPDSDPITEASFKIDKWQTQVKSRKLKTDLTVELAQDLEANGFDAPELIDDLLATEMAEDINKDILQSLITVSSRFKVAGVSDKGVLDLTKQDSAPEQGRTLYRFICEMNSAVQRNTSYSGTYAVASTRCAAVLAASGWLTQKNDGSIPENAYGMLNNGLPLYCDTNSPVDYVIVGVKAEFGGKETVGSLFYAPYTEGLDLDDPEHVGAFKVIVDPASLQPSVALLVRYALSVNPYTVGLDEDEARVINAADMDKMAGRSKMSVLLGVKLPKLIAD

SEQ ID NO: 1073 - protein, 78 aa, Unknown
  Description of Unknown: Bacteriophage F387/08
MDAGIYYAPYVALTPLRGSDPKNFQPVMGFKTRYGIGINPFADSAAQQPKGRITSGMPSIVNSVGKNAYFRRVWVKGI

SEQ ID NO: 1074 - DNA, 144994 bp, Unknown
  Description of Unknown: Bacteriophage F125/10
ctttgttcaaattcctatatttagtttaataccaatactaaggtataaattagaagaacaaggtataggattaatagaaacagaagaatcctacacaagtaaaacgtcttttattgataatgaaaaaccaatcaaacataatgtttataaaggtaaaagagtaaaaagaggtctctttaaaacagaagagggtagaatattaaatgctgatgtaaatggtgcatttcaaataatgaaaaaagtattccctgatgtagaaataccaagggataatgggtttgtgtataacccattcttaataaattgttaaaaaaacaacaaaataagaaaaaatttctcaaaaagtagcattatgtgaagagaagtgttacattattatcgagaattcaataataaagcatagggaaggctttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaactattcttataccctgtacaaacagatggtaaaggtacattaaatgtaatgaagaaatcacctattgcttacactgatggggacaatatccatttcgtagtaaacacagtagtagacccttataatcactcatttatccgtactgaagatatcaaaggattagataaaggtaaacaacttattcaagctttcttagctttcgttgaagaccgtttcaaatttggtgtttataacgtatttgttgcaaacagcaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagagaaaacagaaggaaaatcaacaatcacgattgagaatttagatgctaatacggattatcctaaaggtacttttaaagtatcattctcaaatgattcaggagagtcagagaaggtcgatgtccctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgctgtaacagttaaggaacctattcctgaagcacctgcagacgtaacagttgaacctggtgaaaatagcgcagatattactgcataggaggacaataaagaatggaaaagacattaaaagtttatagtaatggtgaagttgtaggctctcaagtagctaataacgatggagctactacagtatctattacgggcttagaagccggaaaaacttatgctaagggagcttttaaagtagcatttgctaatgattcaggtgaatcagaaaaagtagatgttcctgaatttacaactaaaactcctactgaagaaccttcaggagaagcatagtaattaagaccaactaaaaagttggtctttttttattgacaatttataatatctatgatacactatataagaattaagaaaaggagggaaagtaatggatattccaacaatattatttagaaatccatatgattatacgaaagtaaaaaaactaatggaaaacaaagagcagtacattgtagtaaagtttgattctgtttctgttcataatttaaatgttcaaggtatgatgaatgtcatccaagattacctacacatctatggttatagggttaaagagtacgggcaagaaaatgcttctaaagatgatgaaagagacgttaaaggttacttatatgaaagagtaggtgagtaggatatgggaattatagtaaactccaaccatattcaatcagacactttatatgagtatgatagcttttttgatattgagaaagtagatacatttgaagaaggattgctttcaatacaagatgaaccaactgttttagcaggattcatctatgatgacatcacatttaataaggttattaattctaattcagatattgatgattatattaagaataatgatatttattatgtctctgatatagggttactccctgatacttttatcactgttgattctgataaaaaatattattcattattacaacaggtagttgagttaagtaaagacccttttcctaaatgggtagaggatgatgcaaaaggcttaactaagtattataactttcaagactttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaagagcatggtattgttattatcggttcacagacacgttctaataatgatatactgactttttatgttaaaggtatggatgctaaagcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttacgtagtagctaaagaaaaagaattgtctcacttaagagaacagcgtaagcacaataggcatactgcataccctcaaattatgtttgatgaacttaaagaacatatggttaaagaattacaaggggaaacattagtagaacatcatggaagtaaagctaatattaatgatacagagctaattgtgttattatcagatttccatattggaagtattgtatctgatatgactaatggtaaatatgattttgaagttcttaaagcaagattaaatcattttattaatacaacagttaaagaaattgaagatagagaaatttctaatgtaactgtttactttgttggggacttagtagaacatattaatatgagagatgttaaccaagcatttgaaacagagtttactttagcagaacaaatttctaaaggtactcgattacttattgatattctgaatgtactatctaatgtagtttcaggagaattaagatttggtattattggtggtaaccacgaccgtatgcaaggtaacaagaatcagaagatttataatgataatattgcttatgtagtgttagattctttattattattccaagaacaaggattactaaatggtgtagatattattgataaccgtgaagatatttatactattagagatacctttggcggtaaatctattatcattaatcacggagatgggttaaaaggtaaaggtaatcatatcaataaatttatcctagatagtcatatcgacttattaattacaggtcatgtacatcatttctcagtaaaacaagaagattttaatagaatgcatatcgtagcttcatctccaatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagactatttgatttatggactaccgagaaaaaaatggtaagtcaaggacaacccccgctaagtaattttgagtactatcatgtgatagtaccttacttagtaggtgttattgttattacactaagtattatttttagagattccttgtattccgcacaatcagggttcggtattattattacaagctttatttacatgctagtttatgttataattggtcttgtagggtcatttatacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatccaatttgataaaggtaatgataagtatttatttaatgttattaatgatggattcttgaaagaaatgacaaacggtatggtagaccatcctgaaggtcagccatactcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatactccttattactttattgagcatgtagaagaagaaatgtctgagtatgttattgtgtatgacatacatgacagagaggaaaaagaaaatcctcagaagaaatatagaatagaaccttaccaacgtacaatacctgggggaacacctcttagtaacttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatatacaggtgtttttataggtctaacaagtgttaagtggaatagaacatatacccctctagaaagtgttgttgagtactacaaaagggttaaaggggataggttaaatgtctaatgatgtagttaagttttatgaaaaagatattaaagaccttatcagaactaaaaaacacatgttcaaagacgatgaaataactagtgatataaacgatatacgaatctttaatgagaaagtcatttgtcaaggtaagtgcagaacagattgtttagtactagaccgtaatggtacagtaatgggtatagagataaaaacagaacgagactctacacagagactaaataaccaattaaagtattatagtctagtatgtaagtatgtatatgtaatgtgtcatgataaacatgtacctaaagtagaacaaatacttaaaaggtataaacataatcatgtaggtataatgagctacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgctagtggtagatatagtggcggagaaggtaatttctcccaaacaactcaaagtaaaagaatgaaaaaacctgctattattaatcaaataattcattatgtaggggtagataatacttataaactctttacaagaggtgttatctatggttataataataggtgggaagttatagaagaagatttctttaatactatgaagaatggggtaagagtaatcaatgagcaaagacaaaccaaatagacgtaaagagatacaacatcagcctgttaactttgcccctatgaatactctaacaggggctaataatagtttctttgctaaaaagccttcagagcctaaggatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaaaggtaaacatttgatatttatattcaaaacaagacatagagttaaagcagaaaggaaagataaataatgttaaaaggattttcagaacatgtagacaaacctacaactactaagaccttatacaagaccttaacaagtggtaaagtagaattactaggtgtatcctacgatagtgattacttcccttcaggtgttacagtacaatcttacattgaggatataggtaatgaagatgagggtctacagtttgttaataagataaatgtagtagaatcaatgaaacaggctgtagtaggtatgaataatcagttaggttcttcaggtcttggctatgtgagaactgaacaacttaaaaaagagttagaagagactggactaatgacagatttacttgctagaggtactaacttaacctctactaagaaagtagatattgtaagtacttttattgagcctgaggtaacataccaggatattactatagctaaagatattaaactacgtttgtataaattagaagaagaatcaccattaaatggttacactcatattgtatacttacttactacagaaaagctatatgatggtcaaacactattcggtatgctctctaaaaaagataagttatctaaaggagatactgataaattattagcattcttcagaaacaatagcttaataagtaaaagtgtattttgtgttaagttattaagtaaagactactactttaatttatataacacacatgagacagggatattctttttagaagacacagatgttattactattgcttgtggtcagtcatatgttaaagttaatactaaagatattaaatctagttatgttaaaattgaagacaagactcataaattaactgagctagtaattaacttaaaaggtgacgacacattaactattttattctaagagaatgttataaatatgtgataattaagtataaatatacgttatatgagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacaccagttaccataaataaatgacagttaaggagagctatataatggctagaaaaaagaatttacgaaataaaaacagtgatataaaagttgttcctgataaagaaaaagaaagcatattatctaagctatatcataataaattactacgctcaaaggtagataatgcattagatgaagatatgagttatgatgatattatagaattatgtaaagaatatgatttagaattgtctaagtcagctattacaagatataaaagtaaaagaaaagaagctattgaaaacggttgggatttagaagaattaattgataaacgtaaaaaaacaagtgtaaaagatattaaggaaaaagaaactcctatattagaagaggagcaactttctccatttgaacaatcaaaacatcacacacaaacaatttacgatgatattcaagtactagatatgattatttctaaaggtgcaaaaggactagaatttgtagaaactttagaccctgcgttgatgatacgtgcaatggaaacaaaagataagattaccggaaaccaattaaaaggtatgtcatttattggacttagagagttacaattaaaacaaacagctcaagatacagctatgagtgaagtattattagaatttatacctgaagagaaacatgaagaggtattacaacgattagaagaactacaaaatgaattctacaaaaacctagatttagatgaggaaagtagaaaattaaaagaagctcttgatagagtaggctacacaatttagatagtgaggttagagtaatggcagatgagattagtttaaatccaatacaagatgctaagccaattgatgatatagtagagattatgacatatttaaaagacggaagagtactgagagttaagcaagacaaccaaggggatatccttgttagaatgagcccagggaaacacaaatttactgaagtatctagagacttagataaagaatcattctactataaaagacattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggagaaacaatgctctttgatgaaaataaattaaataaagttaaagattagggttgacagcttctatagtttatgatatagtatatgtatactaaaaataaaggagctaacaattatgtttatttcattaaatcaagaagagaaagaattattaactaaagaggaaagtaaatacacaccactagaaacatcaagagagtttaacacacctaaagaagaattcattgtaacaagttataacgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtagaaagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctccttctgaagaacctgaagtagaagaagaaaaactatatactttaaatgagttaaaagagaacttactagatgctcaaggattaaaagatgttgtagctgattttcctgcatctaaagatttatatgaacctaataaactatatatctgtacaatacctaaaggatatcagtctactgaagtacaaccaggacaatatattggtattagtactggattattatcagagtcagaagacttcagtcatttaagaggtcaaatgcctagaaatctttatgaaacttctcatgttttaaaacctttagtccgtattaataatacaagtatcgaatatcaacagcatgagttacttgaagatattaaagaagacaagaatgtatatgatgttgaattagaagacttgagattagcaacaggagaagaaatttcttatttagagattgttgatagtaagttttttgaaagtcgtattaatgaagttcttgatttttaccatgaactaacggattccgatgatttgcttgagtattataacaaattacgagagttagtcggaaatgatagaatgatttattgtccgcttttaaataaatgtgttaaaattatagattaatagtagtctcctcttatattataactgtaagaggagacatttttgtatagaggtgttaattatgtcaagaaaagcaagtatattttatatactagtggttattgttttggctttctctatctcatcttattatatatcttctttcatgtatcacgacaaagcaaaaaatgaagtctctactgagttatcgaacacaggaaagattaaagaagaaaagaacgtagaatttgttggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaattatggaaatggcagatttagaaagatttgatgcatttgtaagactaatttcagatgatgagctttcggaggaaagaatactggagttaagcgtagacttactaaacccgatactagaaggaggtacagcttacagagctaaaaaacgtattaaaagtaaatttggtaagttagaagcaaaaaactttaaacgaaactataaattcttacttaagtcgatagctcaaatagaccaaaggagataggacaatgacagaaagggaaaaattaattaaagagattgaagaggctaacagagacatacagttacagttaaaagaagtagataattataaggatagtatacgctctaaaggaacaagaaattatatctctacaaaggtattagattctattacggttggtttcatagttagttttttaatactcattataatgcgtgtacttgaatactttgtaacaggtaatgctgtttattcacctttagcgcctgcagttatcattatgtttgttttagcactcggtacatggaaagtaagtaagatgaacaaaatagtatcttatagaggaactattaagatgtactgggagctaagtaatgctgagcaaaaacaagctaaggtatttaagtatcctaatgatgaagtagatattgtatcaaaacataacttaaggcaaataacttttagtgagattaatatacttcatcttaaatatatgagatataataaagcagtagaacagcatactaaattatctaaagaactttttaaaaaagataaagaaacggttgacaagaataaataagtgtagtatagtattactaaaggaggagagatattatggttatacctagtattaaagcacaaaacaaattcaagaatgaattagagtattataaacaaggtcacattagtgaaagtaaaatgttagaattagcttttgattacatccaagaattagaacaaaataacgaatacgttactaatttgctagaagaggagagatatggtgagtaaatttatcggagtgtacttatttaatttactagtggtagctctagtttacacagtaggatttttattcttttatggtgtagctagcttagttattattttaactcatgctactattgacccgttcgtattagctactttcttaggaataggattcttagttattagaactgcacacagaattatggcacgagtaatcaatgacgcagtagcccaagccattaaggataaagaaaatgaataaaggggaatttattatggataaaacattaccaaagtttagtgtatatgaagttattgtaaagactgtaattatgacaccaacagaaggaagttctgacctagaatcattttacttttcaactagagagttagcagaaagatttgttgaagagaacacagtggaaacaaaaaacggtaaacgtgtatcttttgctgttaaagaacgtaaagtaaatcaaccaggctaacattaatttgttagcttttttttattgacaaatcattttatatagtgtatagtaatattatacagaaaaggaggaattattatgaaagtttcagaagaagtaaaacagagttacctagagaataaagctaatactaaaatggataagataagttggtctgagttaaaagctagtcctttaggtattaccttaggtgatattatattttatagtgtagttattatagataacattatagctattattttaactttaaccttgataggtactattactgactcaattgagagtactttagcccaaataatcgtaggggtgttcataatcattactatatatggaatcctatcagcgttaatacctattctaattcataaagctgtatcaccgggatggagttatactgaatggaatgaatcctattacatcagattacctggggaagagaactacaaatactatagtaaatggtatttagatttattaggagttaaagaattttactataaaagagatagtggagaagaagtaaaagaaaaaaatatatcatgggcttttcaagctgaagtgaaaagacctgaagatgttaaccactggaaaaaccagttgcttactaatagacctttaacaattttagaatataaaaaattaaagaaattagataaggaaagtgaaattaggaaacaagaagatttagaagaatacaaacaatacaatagtaattaaagaggtggaaagcaatgataagctcatttgatagtatactacttgtcatatacattattatagcttttgcagtagctatggcaattatctacttagtatttaaaggtatgactattttactagataaactaatgatgttattattaagtaaaactacattagatgtagaagcttgttctatgataatggcagtcatcagtacaattgtgtttggaattattgtacttttaatatggctagcagtaaacaatattttactataaggagttttattatggattttaatgattttataaacagtgaatcggatagagtaggtaatcctaaacaaaagaagaaggtagagaataagctaccttcttctattcctattgaagatagagaaaagaaattaaaagagataagaaagaaatcattatatattgatttaaggagaaaaagaaatgactaaagaaacaaatgtactttacaaagataagtatagagattatactatagttgtaagactagcaggtaatattattgttactgaggtagataagaaacataaaacagcatttacacctattatatttgacaatggtgtagaaggcgtagagcttgtaatgcgtataggttctgtagagcttagcatgacagatttacgtgagttcacaaaggaagtatctacagctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcgtactttgtattgatgtttggaattgagttttgtaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgagttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcgtatcattacagtgaagctgtagaagaagcagattttattatagacataccaatttcatatttagatatacatgcaggagtagaatgggatgttgataatcctgtagatatgctagataggaatccggattttatagaagctgtaaataaattaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaaggaactattaaaattgtaagtggtgaaacaaaagcagtagaagttattgataacttagttcacccacactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactgggactgggattaatacctatggacttattaactattgcttctgttgcttttatagctgtagtcattattgatttgattaatgatgatatgagctatatgcttactggtactgcaatcttaataaatatttgggcaggattttatggatggtttttcttactacaagcaggtatgttacttttcttactattagctaggaaagttaaagatgataaggagtcaatactatactctagtgcttcattaatatgtgcactaggaatgataataaatcttctttcattttcttaaaaataagtattgacacctttgtacttttgtattatacttagtatataacaagtacaggagatgattaatatgagtaaagaaacaatcagaagacaattttcaaacgcaattgagattatggcaacaactaaggaatggtggaattttcctaaaagttttaatacaagtaaagagtttaaaattaaaacttttaaaaatgacacacttgtatttgaagttagggaaggtagtagaaatttaggaagctttgtaatttttacaaacattgattttgattacgataaactagaaggaacttcaacacaatatatgattaattactttgctaagaaattaactaaagatatgtttaactatcataagttacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctacgaaaaactaaaggagcttcaaggaaagagaattcaatttgtaggtactgtttataagtatgttaaacatgctagagggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacttaattaaccctaagaaaacaagttattctaggggagtagttattgcacatacattccctgaaatgattagccaatcaagaggagaccttaagaacggtcatgtgtgttttaaagatggtgaccgaagtaattgtcatgtagacaacatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattacgacaaagtaggtaaaaagaaaatacctaggcaaattaaagctcacagggatgtatctgtattagaggatttaaaagatagattagaagaacaaaatcctaaagaagaatacaagattaaaacaacaaaagaatttgataaggagagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagcaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgactacgatattctctctttacgcaatagttgcaggtataccaactgatattatgagattaattaatccggaagtttatgcagtaaaagatttaattgagcaagttaaaggaggaaattgatatgaagcagagagattttgaatttgaagaggattttgtattaacttacgagtgtgaggattgtaagcattttgaagactggggtcatgatgaagagcctgaagaatgtagtgaatgtggaagtagtgacttaatcaataatacaagtcatgaagatactgagtgtgatatgtgtcgaggatatattgatatgtggcaagatggatatagatatatgggagataataaagagtatattgaaaaagaggaatcaggtttaatttgtgaagattgttatgagaaattagatatttaataaggaggaaattaatatgaataaagcagtagaacaagcaagtaatgcattaggtcaaggattttcagctatggtatggcatcaagtattagcagggttagggtttattttattaggattggtattatctttactggtttgggtattagtaaaaaaattccatgtaccttttaatcacccgacagcttttgtagtgtactcaattatgttagttagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagacaaaagaaaattttaacattaacagtaagtaactttttaattctagccttagatactgtagcactaattagatataaaaaaggtaaaattaaacaagagaattataacacagggcaaattacaagaatgatagctacaacagctaactcattaggtattctttacttagaagagcaagagcgtaaagaagttaaagatattaaagtaggtacttttgaaattggagccttaaaaagatttacaaataataaataaaaaaagtttaagaaacctattgacattaggtttcttttattatatactaatattataagaaataaggaggttaacttatgaaaggtattatcatattttacaaggaagagaccaaagaggatttaggatattttcttgggtttataaactttaagctagaaggattatcttacacaactgaaggtactttagtagataatgatgtagtagttttaaaggataaccaaattaatgaggataatttagagcagtttagtatgtcaaacaataatttagttattggaatactaggtcattcatctctttcagtacgcatctatgaaaaaggtattagacaagagtttgatagagtagaagaatatttagaggagttgagacaataatgatatttatattaatttttggtttactatttattttatctttactaggtatttttatttattttatagttttacgaaagaaaaaacaattaatagaagaaagagaatcatttggtatttataatagaacaaaagaaaaactgggtgatgtaacacgtttagggtatgaggaagatgtatataagttaatccataaccaatctaataaaacaatcatagaggataaaaagagtaaagttgtagatacaattaaaaagatgtatgagctagaattaacgtcagtagatgtttctaaggtagaaggattatctccacttgatacagaacctatgacaaatatgaaattactttcatataagctagatagagaaggattatatagtttaagtaaatttatttaggagtgatacaatggaatttatagataaaaataatgtaattaaagcttatgatataccaaatgtttatttaaaaggttatgtattacaggcatgtgataaaaatggagatacaacagcttatgatggttatgaccaaatacactataaagaaggtagagtattaacattcccttttgataaaccattaagaaagataaatgtactatcaggatattacaaactatttaaaaaggaggacataatatgatttattttgttagtgatttacatttcggtcatgataatattagagaattcgaagcacctacaagaagtcactggaactcagtagaagaaatgaatgaaggtttaattgagttgtggaataatacaattacaaataacgatattgtttataacattggagacttctttttcaatatgaaaccttctaaagtagaagatatacttaatagactaaattataaagagatgatactgattgcaggtaaccatgaccataagaaacttataaaactatatgaacgtaatggtattacagtaaagtacgcagacatgattaaaaaggatggtaagagattttatctaagccattatcctacactaataggtagaaaaaacatgtttaatattcatggtcatatacactcacaattaatgggtactgaatatcacatcaatgtaggttatgatgtagagggtaaaattgcctatagttttgatgatattataagtagagcaggtgaatataatggagaaattcaaaggtaaagatttatataaaactagaattagaaaacaaacaattaaaaatttagttataaaaacagagaagctacataataaacacggaaagtatagacctattggtcatgtttattactatccgaaaacaaaagagtttactttatctaagcctgaacaaaagatatttatagagtatatgaaagaattaggttttaatgtaaaacacaggagacgtaagaaaacacttattatttataagaatgcattcactgaatacattagtatgtatcatgaagcaatagagcagattgaaggagggacataatggaatatttatttttatttataggtattggcatgataatttggggtttcatagcaccttatcttgcatttgtagtttactataaacatgtaagagaaaatcataatggattcagtgatgaggaatctctagaagaggctacagtacttggtatgggattcatgtttatagcatttattcctataggtatactagttgtaattgaagaaattaagattttattcttttaagtgttgacaactacaatatagtgtgttacagtataaaaaaggaggttaactaatgaagcattttattttaattttagggattgtaatcctagttattgcattagggattgtaatcctagttattgcattaggtattgttttaccggcatggattttacagctagtattatctgcattcggagttaaagtaagtatttgggtatgtatcggaatatttattttaatcagtgcaataggaagtatgtttagtagaaattaaaggaggaattacaaatggcaaaatatgaatcaaatattaatggagagaattatattgcaacaccgtcacaagctttaagagaagcactagcaaaattaataactgaggaaaagagctttgcagagtaccaaactaaaggtggggaacagtatgaatcacagttacaactaagacactttgatgcaatgatatctcagtatgaggaagctattagagtactagaagataaatatagacctcagatttttattccgaaagataataaggaggaaaattaattatgaaagcagaatcaatagcaagattttttaatgacaaagtattacaaatagaaggttataaagtaagatttccgcaggctagttcatcttatattttagatatagatactgtagatgaatcagtattgtttttagacgctcaagtatctacactttcaggtaagcatttattagatacagctattacaattgagagacctgaaacattaagtgctaaagagttatatacagaaattagtaataaactgcaagctattgtaggagaccaaactaaaacaactatagaactatcaagatattttaaggaggaaaaataagtgtctaataaaactattacaaatcatttattaaatttaaaaggaataaacattgaaacgtatagtattattgctcgtatcaagaaacaaactagttggggtgataaaggagattcttttgaaataagcataagttataaagctgataaagaccctagaacagtgagatatattacaactgaaattactattgattatagtagtaataatccaaaagaaattttattacaattaaaagataagattttttctattgttgaggaacaggtagagactgacaatgattttattgaatctattaaagaaattaattcaactaaagcattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtgtcaaatgaacctatgagaaaaatgcttaaaaataaattccctcaccttagagtatcttctgctgaagattattcaaattatgatattaaaggtgaaattgtattaatagatgaagtagatattgaccagttatatagtgctgataaagtatctgttgatgcactattagtaggtatcattaaaaattaaataaatttataaatacctgttgacaacaggtattttttatagtatactttagatataaagaaaaaggaggtaatataatgatacctataatagttatacttattggactcatattatttttatctagtggttataagttggtattaggtaagtactatgatgatgtagatttaaaaatactatttaccatatttggtgttgggattgcattactacttggaggatttatattataaaggaggaaacaataaatgaattatgaagaggtactaagaactattaaggaaaataaaccctgtaaagttagattcacaggaaatattttagcaattgttaatgaggaatttaatgcagatactgataaaggagttttacagcttgatgtatcgaatatcaacaaagagggctatataagattacagcaatattgtttagaaagagatgactatacggtagtaggagctattttattttaaggagaggtaaatatgaattatagagattttattacagattgtattagcggtggttacaacgtacacatcagtgttacagaaaaaagagtgcacatcatttctgagatgacatcagcatcttatcctaaaaaggaaattaacttagatgaactacaagcttatgtgtactatatgaataactttggaagtcaaattacaacggaggggttataaatggaattggttattaatattgtagcagtattggtcggtatgtatgctatttatttctatgttacaaaatttagtactggcttatcaggtattttaattgttttagggatggctattggtctttacttctacttagactatttaaatgtcagagaaaatgttattcgattagtttcagtaatgtttggagctttcctatttagtattgaaatgatttataataaaattatgttcgaaattaaaaaaagcaatgttcagaagactgttagagtgtatgataaagagcagtaatgatttttaccataaagagtatctaaattactttaagtgctctctatggtaccttaaaatagcttagaattgaaattaaggagatgaatatttatgtatcctgaaatagatgtagaaaaattagcgtacaagctaaaaagtacgagagaatatttagaaagcattaaaataaaagaagtagaaatttatgaaatctatcatcttaaaacaggtaagttagtttttaaaggtgaatatattgaagtaaaagaattactgaggaaaatgtataaagagaatttaacacttgtagatgtagatacaatgttaagtattggtaaaggatttattgatgtaattaagaatatatcagcagaaaatgtattccaaataacatataaaaaggagctctcaacaaaatgattaaaatattttcagaagtagataaagaatacaaacccattattactgaaaagtttcctaatggtgagattaattttaaatacgatgatttaaagtatttagtagaagagaacttaagatttgatgttttctttaaatgggaaaatgacgcagatttaatgcatttgtatatgtttactaagtatttagagcaactaggtattaaagataaagctgaatttttagagattgcatatctaccttatagcagaatggatagagtagaagaagggcataataatatgttcagtcttaaatacattacagaatttattaataaccttaattataaatcggtatgggtagtagaacctcatagtcctgtaacagaagaattacttactaattctgttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggcgggacatttgtaggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaacaaattatgctaaacccaactttaatgtgtgacttctataaactaagtcacagagaacaatatcctgaaggtacagaaattgtatatagtacattagtacctagaagtaataaatattatgaacacagtgataatattgtagtattcggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacttagaaacgattattagtactcaaacatggcaagcaatgactagtgctacactagcatatgatatgcgtaaaatgctagataaatatgcaatggaaacagtaggtaatattgaagcagtggatttccagggtcatgacttcagtatgcgtggtatgagttctttagaaacagctcaattaagttcagcaggtcatgcaattagttttaaaggcagtgatacagtacctgtagtggatttcttagaatcatattacaatgcagacgtagagaaggaaatggttgttgcttctatccctgctactgagcactcagtaatgtgcgcaaatggtaattatgaaaccatggatgagtatgaaacatataaacgtatgttaacagaaatatatccaacaggaattttctctattgtatctgatacttgggacttttggggtaatatgactaaaactttacctagattaaaggatattattatggaacgtgatggtaaagtagtaatcagacctgatagtggagaccctgttaaaattatttgcggagaccctgatgcagatactgaatatgaacgtaaaggtgcagtagaagtactttgggatacctttggaggtactgaaactgaaaaagggtacaaagtattagatgaacatgtaggattaatttacggagactctattaactatgaacgtgctcaacaaatttgtgaaggattaaaagaaaaaggttttgcaagtattaatgttgtattaggtgtaggtagtttctcttaccaatttaatactcgtgatactcacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaagctttatagagaccagtcgttaagtgaaattagagaaataattaaaaataattaataaatatttaaactccctattgacaaagggagttttttattatatagtagggttatagtaaataaaggagtgaaagaaatgatttataaaatatcaaaacataattactatagtaggtttgaatattcatcttatttacctgatgaaggatttgcatacatagattatgtagatgtcattcttataggtgtagataatccgaggaagagaaaagttattactttaaaagcagatgagtttaatcctagtgattttaaggttggtcataaatataatattataaaaatactatggtttgagaaatgggaatggttacagccatagggaggagaggtatacaatgattatagataaattaaatggagttaaattagagattggcggtcatgttgtatcatttagtgtaagcaaatttaaaacgattaatggtgagagacaattacttgattaccaccatatcaaaagacgtaaacagaaatattttagaactactgaagaattctataatgagtacaaagaaataaaacccgataagaatgaaatagatgaaatgtttgaatctttaggttatgtagatactaaactagaagatgtagtaagaaaccaagagaaagtgacagagatattaggagttagtgaacaatacttaaaccaattgtcttataaggctatagaggaatatgtagacaaaatagttaccttagaaattaaagaattaaaaggagaaaaatagtatgagtaatagttgggaaaaagaaggagttaactactgggaaaatgaagattgccctagagaatacttagagaaagcatttatagaattagttgaatacgtagaaggtgttacagtaccatctagagatgttcagcagttgagagaggataagcttagagaagatattggattttatgagtatgtagcagataaataaatacacatctacctattgacttaggtagatacttattatataatagtatacaaggagatgaagtatgatgaatggaaaacaaatttatgtatttttaagtgaccagtatagtaaagatatactcagtttacaattaggacttattaaggaatggtctagaagagaactaacttattcagatgatgtcgggtcagatgcagatgttgttatttgtactgatatagtaagagatgatttcgtaaaaaaactaagtaaaaataatagcaatgcattatttgtgtttattagttctttttattggataggttataaaggcggagaattttttgttgcagttcaagactatgtgaaaggtatgtaagatatgaaaaaattattaatattatttacattagctagtactttactattagcaggatgtacaccggataatcatgaaggaaaagttttaggaacaggagaatatagagagccaactacttatatcaagtcaggaagtgttactgtaccagttattggtgaaatgaaatactatgtagatttagaaacagataaaggtgaagaccgtgtttatcttaatagagaagtttatcataaatttgataaaggtgatgatttctctaatgtaggtaaaaaagtatataaaaatgatgaattaatatataaaggggactaattagtatgaaacaatttatacatgataaaaaagatagttataatagtacaaatcgtaattttgatattcaatattataaaggtatacctttacaacaaattgataggggatatggtcaagcaagagctaggagatttacaataaataatacgaaccaaaatatatggatacctatgacatatttaaaacctaatggtactcttaaaaataacattgatatagattggatacttgttaaagaaaaatgtagtttaaagaaagcaggattagtaataaaaataaaaattacaggagatgtattataatgtatatattagaaagaacaattagaggttttgccggtcaaacagaagatattttaccttattactttaaaagtaagaaagaaattgttaattttttaaaactaatggagttccttaaagaagaaacaaattattgggttaaaaagaacggtaattatactattataatcagggctaaaaggatattatacattgaagaacatatacagaagttaaaggagtgggagaatgacttatgatgtttatgtattatataaaagaggagaacctattgcacaaggtagtatggaacattgcttagatgtctattattgggaaagggtacacggttatagtaataaaggttatgaactattacctatgggatatgaacaggaggaataactaatgataaatatagaacatgattatacaataagaactgtagataatagaaagtatacttactatagtaaacatgaatctccagttactttatataaaaatattataggtaaagattgtattgaagtaactaaatacgggaaagataaaaaagttattatagctactaaatatattgtatctattgaacgatggtaaataaggaggtataactaatgaatgctaggaaagcacgtaagaacactaaaaactataaggactctaatgtagtaactaaagagcaacacctaacttatatttataataagttaaactacttgattgcaaataatagtagtcagggtaaaacatatgtggtaatgaacctaagaacagattatcctgatgagttttctttatctaaattaaaatatctaaaagaaattaaacagcactataaagacctagtatttaatgtgaaaacgcaagtaaggaaggcacagtggtcagagaaaagtataatcaggtactactttaacctaggctatatagacagcgtgttagtacctattatacacattagttggtaattacaaggagaggtagttatgttttttaaaaaaaagaagttaagcaatgtagagaaacaaataagacaaaaccgtaataaagaagacaaagaaagaaaagaacatcaagataagttagatacagatatgtataaaacatatgaattagataaaattgtagaagaacatttaagaaagttaaacactatatcccttgaagaattataattaacttcagtgtgtttagggacaagacttgtttattattactcaataggtaaggattggaataaacaagtatatagtttaaacgaattagaatatatgaagaagaaatttaagaaattaggatttgaaactcagataacaaacgaagatatagggtttcaaccttatatttatttaagattattatgggatgcataagtaattattattaaaggagggatagttggtgctgtacctctaatgactattattattgcacagttaattacagattatcatgatagacattaagtattgaatactgttgactaataaggaggatatattaagaagttaaagttacctggtaatattgttgactagcaagaagaagaaaatattattactattaagtacctgggaaaacttttacctctctcactcagcctattacttactaccgacttccctaactacttattctatagttataatattcatttattatacaatggtaaactatagtattccacctgtaaactatgctgaagcggtagtaatctattgttattatataataatcttatataatggtacgttaatctagtatattacattagaatgattctaatctaggattttaatctttagaccctaggaaaagtggtactaaaatataaaaccctataggtatgggattcttatttttaaaattactaaaaagtattaggttttccctagggcaaagttttaatgtacctaaaatagtaagtagctccttatcatttagggttctataattgagaatattgaaagctaatccgcttcaattgtaattaattgttgacaactatgaagtgggtatgttatacttagtatataaaataataggaggaattaataatgaatctgacatttgaagataagttagaagacttactaaaaaaggtacgtagtggtgagatagaacctatcgagtactctcaagttaatgatgagcaccctaatggtaaaactacttgtggcgttacttttaagtttgatatcgacacaccaactaaataggaatatgaagcggttaattccgcttctcttacttagagtatataagtaactgtatattgtaagtaggagtaatcaaatttaggagatgagatagatgataatattatttacgcaggattatgataaaaccctaatgaaagtgatattaggggatattaatactatgagacctaattggaagtacagtgttaaccatcctgagaaagaagaggatgttcatatacaagcttatgaaggggaagatatatttgatgatatagaggagttatcagatagtacacaggatatagttataggtgttactgaagatgattgtatatcagagtctccttatgactttaatggtgggcttagattagtcactaaacatattaaggaacatatagagaaattcttatagggagtgataatatgattgatatatacttaggagaaggttataataaagaatacttgtctaaggcactcagattaatcaatgaccatgctcctagggagttaagttatgattttaataatgtagaagcggatgttaatattcacacgatgttatatgttaaacctgaagataggtatgtctataaggatatatcttatgacttcccgggtgatttaattatttgtatagttgaagatgatgctattgtgtatcaccaaggtaaacaggtttcaggtattagtattttaagaataatagaagagctcatttaagaagcagttaagtaaaaaaggataaattgtactagaaaatgtataccgcttctgtatggaaggctgagagggcttagaattgaaaggggagatataatgatagagatataccttagtgaaaattatgataaggatttattaaaagcggaattaaaatggattaaggagaccgcttcaagagaactaacttatgatgttaataggaatcctaacttagatgtacatgttagcccatttagatatactaaagatgaagtaaaagaaataagtttacatcctcaatttgaagacgatgtatgtgtatttatagcggagacgtggatacatgaataccatagaggtaaatcaataggcgtagatagtatggaagaatatgtaaaggagatgtaagtatgtttaaagtatattacacagtctaccataaaggtagtatgaaaacaattaaagataagctagatagaagtagtttaatatacttcttgtatgatacttggtataaagatattagtaatgtattccctaatcactataataaagagtttggaagtaatagtgatgatatagacatagataaacttattgaagcggttaatgaggagggtatattacttatcaatagaggtaattatgttacaataagagaatggtaggataggataaacttaggatagaaaataatttaggatgagttacgataggataggatacgataggataggatacgataggataggatacgataggataggatagggggttaagttaggatggttactttaacatacactattattcataaagaatctgatagggtaatagctagtggtttagatgagttagaggttataaacttagttcaaaggatggtaaatactaatctagttactgatatatcattagatgattatatacgcagaccaagtggagatatagatgtactcaatttactagtagatattagaagacaaggcgtatttgatttcaatcacacttggcacgtaggataggagggataggatgatagttatatatacagatgtttctaaggattatttaaaagacgagttcttaccttggcttaatgaaagggatagatacttagaagactataaagatgaattacctgaggatatagattcctcttatattgtatcagttgtatactgtaaggatatggaaggtctattagaaagaaaagacattgttattggtaatagctataatgaacctgtagctttattaggtgttcctgagttttttggtaattatagtaattatttctactatagaggagaaagtattagtaaacatgacctaggagaaattgttaggttaaaagcttggcaacgtatgggcggagattgactaagtagctctccctaatttcactaagtagctccctaggaattgcctaagtagctcggtatgattttaccctaagtagctccctctgttttctactagtttattttaaccgcttcaggtgtctatatatagacggttggaataatagcagaccgcaaaaataaatacactaggatattattcccagtgtattatataatttttttatttaaatctttttatatttctatttattgttattctacttacattatacatatttgataattcttcttgtgtaaaacctttttcagtatataatttataaatattttttctttcattatctgttaatgatttaccacgtttaaaattgtttattgtttcatctttatgatgtaaattattatgttctgtagggctaatacattgtaaattatttatatggttattttgtttattgccatctatatggtgtatatgataatcttgattaaaatcattgccaaaatattcatatactaaacgatgtatagaatgatgtttataattaattttaactattttatagccttgcttatgattatgaggttttactaacttttcaatcatataataattaccgtgtctttttattctaccatagttagatactgaataattaaatatattattaatattattttctatgcgtttccatttctcattaggtaaattattaatactattataatcttttaaattgtattgtaataaagtatcaattttaacttttcttgccttgtttatatcatctgtcatacgataaaagttatttttatctttttttaattccttatttgttttctttgaatatactttgttttcttttatatagtattttgaaaacatttcaatgttatttatattatgtttcatcttctcaactccttaactatattctactatataataggtaatttgtcaagttaaaaaagtttttaaaaacctattgacttattactttttagggtgtaatatagatactgtaataaataacacgaagggaattgatgaaaatggaaatcaaagaaattgccgatacaattatgtatttatttaatatggatggttacagatgtgcagaacctccattatatgaaagcacactaaaccacacacgcacacacacggcgttaattgtttctattaagggaaactatgacacagtgcagatgttccgcaaaacgcctataatgagcatgagagggcaaagccaaccggctagtatgttagtaaatgtaattgatgatgtaattataatagtatatgaaaatgtagtgtacggagttcaaaacaaagaaataaaattcattgaagaaatttaaaaataggggttgcaatcctcaagcatctatagtaatataataggtgtaggggatagcaacacacctcaaaaaaactttttaaaaaagttaaagaaaagtgttgacaccttataagatacatgttattattaagataacaaataagacaagccacttagcaaataacgaaattaaataaaaaaattatagaataggatttgattattatgacaaacaaaaattacttatacgaagaaactcacacagtacaagggcaagacattacggctttcagaattccaaacgacacaaacggcaacccacgttatgtagtgcatttcatggatttaaatattaaactagcagactatgacaacatcaataaactatacggatttaataaatatcgtgctaaatggtttggcggtggtgtagtattccaaagctataatatagaagatacattaaattttgcactagataaagttaaagaaatagaagcggttaagaattaaaaccgcttctgaattaaataaaaaaattatataaaaaggatatgataatatgatattagaaatagaaactaaaccagttaaaacattgaaagcaattaaagacgatacaaaaaatattaaaaatagtatagcagaacatttaggattaaatagagaacaatttaaattatcaaatggtttaataactttaaaaggttattcagaagaatttaaatgttggtataatttaactagcacaattggtaattttcctaaatatttaaaatcagaattatataatgaatataaattatattgtaatgtagaattaaaaactaaataaattaaataaaaaaattatacaattccctaggattagatttctagggatttttatttattttaatttatataaaaaatttatttattaaataaattagtgtaaaattgactattgacaaggttgtattttttatggtataatgaagtgaagaccttttttagtataaaaaaattattatataaaaaatttatattaaatgattttagaaccgctctttctcgttacctcgtcatttatatagcgcaagggataggcaacttagcgctttgttttactttctatatatagtatactatgaataatggtaattgtcaacacctttcagaaactttttttactttcttttattattatataaaaaaattatacatattttatggctccacttccattatataataattcagtcttaatgtcaatagataaatgtaaaaaagttttttaaattaatttcattaaatctattgacttgtgtttctttctatagtaatatataggtataccaacaagggaggcaatacaaatgctaaaattcaaatggaaaaacaaaacaattaaatcaactcaaaaaacggataacattctattacttattataggtggtttagttgcaacaatcacacctaaacttgtaaactggtttttactactacaagataatataaatatttttttaagataactattgacaacctagaaacaacatgttaatattaagatacaaggtaagggaagcggttgaccgcttccaacctaaataaaaaaagtttaaaaaaactattgacagtcacttgaaaccatgatattattaagataacaaaaaacaaacagaaaaggaattgatgaaaatgttcaaattacaaaataaagtggaaattatcgtacctaaggaagataacaacggcgttgagattgcagacaaacgtattaaagaatatgtaaacagtatcacaatggaagcgggcggttgcactattacagaaattaaggggcaatggtattcagaagatgaaaagcgtatcatggaagataacaacttaaatcttgaatggtactacattccagaccgtgcaaaattcatgacagttgaattaaaaggcattgtaagacgtttaattgaagtttacggacaagaggcaatcagtattaaagttaatggcacattgtacattgtagaccaatcagacattgaagaattacacacaacattattaaatatcatgaaataaaaaatttatataaaccgcttcggattaaattcttgaagcggtttttttatgtaaaatttatgcttgacaaatgtattaaaaaatgagataatagagtgacgactttttttagtataaaaataatattatataaaaaagttatagagtttttaaggctccaagtccattatatcaattttgctactggttgtcaatactttctttttttatataataatttaattatcttaaagataccgtccacttccattatctcaaattttcccccaaagtcaagaactttctttcaaataatttatttaaaaaagtttacaaaaagggttgacttattttgtactatagtgtaatatataaagtgtagtaaggaagcggaggaaataacctaaaaaaagaatttaaaaaaacttttaaaaaggtgttgacaaacttccaaatacatgataatattaagatagttaaaaaaacaaaaaaacgaaaaggaattgataattatgaacagattagaaatagtaaaagatacggcaatggaatatatccttatgatggataacagtgttatggacggagttatgacacaagaggaatacaacgaagcggttagctttgaaaaggtgtatgactacactctatcagaagcaaataaagaatgtaaattcttaggcggtaaagttttaactttcctagtacatgaagcaatcgaagaatacgcataaaaaaacttaataaaaggggttgacattcaacccctaccatgttaatattaatatataccaaatgagaggaattgataattatgagatacgaaattgtaacgctagttaatcaagaattgtttatgtatgcaacattcaacaagcaggaagcagaagcaaaatatagtgaatggtgtgaactgtacggtcaagaaaatgtaagcatggaaaaaaattaaaataagctgttgacaaactaaccgcttcatgataatattaaactatactaaagaaaaggaaatgatacaaatgaaattattaaaccaagaaaaccaaatcgtaattagcatagcaacattagagagtgtcaaacaagccctaatttgggaatacatcgaccacatagattataacatctggaacaatgaacttgatgacacagaagcggttgtaaaaatttctggtattcttcaatcaatcaaatttgcagacactatggaagacctgcaggaatatattggggatattggttggaaattaatttaaaagaatttcaaataactgttgacaccttagcagatagatggtaacattagggtagttaaaaaatactaaatgaaaaggatttgatttattatgaaaaaaaatgttaaagcaagcactattgaatggttagaattgactcaagggcatggggagtttgatggtttcgatgaagaagatatggacttcagaaaactagatgatgaagatattaaatggtattttgaaaattggtactttacagaggaaaaacaagaacagattatagacgaaataggtcaagaggaatttgaagaagcctattcagatgatattaaagaatacaacaattaatacaggaagcacacagagacacacagagaagcttaaccgcttctctaatattaaactattaggagatgtttataatgacaaaatttaaattgattgataaaaatagcttttacgtaaatgacaattacaataacgaaacttatttaacttctcaaattgttctatcaggtgaagcgggtagattgttagatgatatgatagaagattgtgaagacgaacacgacaaagacaattacaagaaactagacactaacaatattgatgatattgattatatattggaatgtgctaacgtttatatttacccttacaataaaacggaatttaaatattaaaataggagatgttgaatatgaacacaagacgggcaaataaagcgttaaacgaagcggttagattattagataagcaaatagaagacacacagaagaccatgcaggagctaaacaaacaactagaacaacaaataaaagctaaacaggaactaatgacactagttgacgttatgactggtgatgatgagtaatgaacattaaagaagctcacaaggtcgttaggagtgcaaagagcaaactcctgcaggagcaggagcacataacaaaccatatcatagaggactacatcatagaggagcttcacagacgcacacagggaagcggaacaatacagatgaacaataacaccgcttcatatagcaatggctcatatggtagcttagaagagcttagagaagcttatgacctatcgtcattatctactggtgagattaaagaattgcttgaaacatttgtttaaatttatttaaaaaagtttagtcaaaactattgcaatatcttcagaatactgtataatagtacttgtaagataaataaaacaaagaaaaggaatgattaattatgaaagaacaaatcaaacaatttgagaaagaattagaaatggcggtaaataacttattcgtattacatgattgtggcgtatcacaagcaaagattgaagaacaaaaccaaaaagttgtgtaccttaaagctatcgttgagaacatgaaagcctacgaagaaatcagagttgagccaaagagtgaagagcaatttttcaaagaacttgaagaagaacttgaagaagaagaaaaaattttaaaaggaatttaagaggagggcaaacgcccttctttatttttatcctattatataatttttttatattatacgggggcaggggtaaaatgccactcaatgggggtgggtctatatacccctacggtctacccaggtacttattttttggaggaaattatgaaaataaatatttaaaagtcaacaccctatatgataagtcaacattataaccctaccctgtaagtcaacaatttatagtataaataagaagcccttaaatataaagtcaacatatctaaaataaaaaaagagaaagaatattattcttcctctgaggtattattaataacttctaattcatgaatagtaatcatatcttctctaaataatggtacatcttctatattatctttataatagtaagtatacccgtcttgaaggtatccgcttattttttcttcatagccttctgctttaatacgtttaattaagttctccttatttgtgtaaactttatcttctctgtaagaatagttatcttcatagggttcacaattatcgtgttctacttgatatagtttcatattagttatcctccctttcataagaccattcaccgtattctgcactaaagtgggctgtgtctgtaccctcatcttcatattctacactataccatgcatcttcttctgtttctgcatctatatatcttacttcttctgtagtaataatacgttttaccttaaatctctccatttgtttttcctcctttatattttcctctagtatttgttttaatgtttggcagtctttttggtctagagtatcccaactctctagattttgtaattgataaagtaactcatttacaatttcatcgaaggcttctgcttttctatatacttcttctagttctgtttctgctaattttctatcccctttaatttgttctgctttagttactaagatatgggctttattcatttcctctataataaagtttttatagttttccattattatttatcccttctattttctatccgttgttttatctcttccctattgcggtggtgctccttactcatttctttacgttccttatttgttaaccttattctataaacaaggtaattaatgtatagggtgccggctgaccatagtagcaagaatgttattagataagtccatgagatactaatttctatcattgtgattcctccttatctattgtaaaggatttacctgttctagagaatagtttaaacatttcttcttcaaaatgcccatcactcatatctttatctttcagcatttcacagagtttgtcccatgcttctgctttattataaattgtttctacttctctatctgtttcatcactataattttcatatataatttgtaatacaaaatccttctcatcgtaacatttttcattaatatcatatctcattataattcctccttatattctttatagctcttgatggctattttacaaatacctctatttacagcaacaaatactataaatgataatagtgttataactgctcttacatctcctgtaaaaggtaataattggaagagcaaatagctttctaaaacactaatagctgtaatggtagttagatataatatagatagtaagtaatcctttaattttagtttaacaaatggttttttgtgctcatctgttcttacaataccataaagtattataaaccacataacaggtactaactgtataataaaatcattatctatattcaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccctggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccaaaataagtacagtgacgtgttcggcttatatttgaagtctctttatatgtaccgtagtaatctataccttctgtaatacctgatatatggaacctgcttacgtctttagattctaatcttacaacatcgcaattttctaatactaaatcaatatatttgatattcattttaactctccttttatattaataattctttccattctttatcaacctttttaagttcttttttattatagtctccatctttagttactacagtgttccattgaaacttctgtaataagctaaaattatttataatccatatattacttttactataatacatattatcttcaaatcttatatctttttctataaaatatttatatattttatatcttctttcatctgcacctgatattttaataatttcattagtatttaattgagtggataactggaagataacatcttttactttcaataggtctttaacattacctctacctacatggtcattataataatcgtacttaacttttttcttttgttttctatcattaactacaatgaatatattatatacgatataagctttaaaatgggtataggtagtaggtgcttctgaatcatcacattcttttcttaggtctgtacattgtatttttaacataatattatttgatatgttgactacggtagaaccatcatgttttttattgagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacgaaatctttacgtacatctgtgtctaatattctttgctttaggtgtgtagtcataaatttatctttaactacttctaccataatatcatatcttactttattccattgctcttcattaaaattacgaactttacgacctaaacttttagcatggtttggattcttagcatttagtatttcacctgctatttgaaagtcattaaagtatcttgctttacgccacataaaggcttgctctgagttattaaatgttcttccttgatgtttaaactttatagggtagaagttagaataaatatcctctttaccccaaaacataatatattcacttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatggttactactctctacaaatgcgtttaagtcagcgtataactggataaagaaggacatgtcataattccaatacttaggctcatttctacctagttttttcttcattttcttatattttttattcttttttagtccaaaaacttctttttcaaagtcatttaatttaagacctttaaaatattttttcttcatttcttaacctccaatttaataaatggaaaatcaatgtttctaaatactgcgccgacatcacacattaatatgtctccattaatttctacttctccactgtcagttggtgtatgaccacatacataggtaaaaccatcttttctaggttgaaaatctcttgaccatattaattggtcaattgtttgttcttctacaggcttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttaccgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacctaccttagtaggtaggtaattaaaattatttatatgttaatttaatttcaacatttttatactttttacgaccatctgttcctgttgactctagtgtaagaacagatacaaaatctttaacctccggtgttctgttattagttgtaccttccgttgcagtaggtactgttaaccagtaaggggagttagatgctaagcttgtattattaactagtgttttgccattatattctaacttagtaacagacttacctgttaaatctaacttagttttatctatattaatcatgaaactttggtcttctttccagtatatagctgttggtgtgaatgttgctgtatacgtaccatcaccattacttacaggtgttatagttcctgatgtatctcctgttggtggtgtactggctgtagtatctttgtaacctacttgagtatattcccctacaatattagtttttgttttatctacatagataactttaatgtaatctctcataaactctagtccttgagcattatcatctatagttatgaaagcatttaagaagttttgaacttcggaaattctattatatttgttaccatcttcataagcaggtaaagtataccagtaaggtgaattagatgtgtagccttcggggtttatcaagctcttaccattataagaaacatttaatatcttattagcagttaagtctatatcatctgtactcatgttcataacaaagcttgtatctttcttccatctcattccagttggtctgattaatttagaataaacaccattacctaaatccttaacagaagtgtcaatagatggtgggcttgctatagcacctacagtacctttactttctaagaatgattgtatagtgtatgatataaattcatgacctttagcattaggatgtaagccatcctccatgccttctttccaagcaaagaatgttttatttacattgttatcccatactctaatattactctccctatataagtctaatacaggaaatgaaaattgttttgctatttcttttataacatctaccaattgtcctaaagtatatccttgtccgttttcaacttctttaaaaggattactttcaatcctaggtgttggtgttagaacaacaataggtactgtaggaaaaaccttagatagttgataataagtataatagattgaacctgctactgtagtgtaagagtgttctttagctgttcctaggggttttgttttacccccaactaaaccatagtcatttgtacctaacataacgcaaattaaatcaggtttatctgtaatagtgtaggctacgtttttacggtcttggtagcctgttccacttgtacctttattaacatttattaatcctgttctgtcagcaataaattggtggtagttttttgttgttcttgcatttacttccgtaatactatctcctatgaatataactttcttatctttcaaaggtgagatagttgttgtacttggttgttgtgttggtttattatcagctataagcttatttatttctgccataaattcttcttttatatggtcgttaaattgggtatctataacatcctgtaaacctataatattttctgcttttatattcataggttctacttcattataagtaacaataataagtttgtcctgggatgatgttaaggtaacaaattttggtatatctacttttattgattcttcaccattaatatcccaacaaattttaaagtgccctgcttcgtatgttgtatcaggatttaaattctctataactatttgacctattgaatcttctatgttttcacttgattttaaaagattattttcatagtcataaagcttcaatttcttagtcatatttacttctccttttattgaattttgtacaactataatatatcaaaaaaaatttaaaaaaacacctatttaacttaaataggtgtccgacagagctcccgtacttagattacggttaataatattttacgacaattatatgagaccctctgtcgttgaaacgctcgtcactgcgttatacctcacaagatattttgacagttagcttgtgagaagaagattgttttttattgtacttagtttatacactctcaaaagtacatgtgtactatatatttatacaccaagcgtttggtgttagatacggaatggagggacactaccatccggagtctacggtcagatacaaagcctctgccgggcaacatacggtatctctcgtacatcaggttgactaaacctttagagcttttcactccttctcttataaccagtaacttaagagaaataggttttacttagtagatatgaaacaataaatccacatacaatattaaatcatagtcaagtgattgcacatatgtctaatacctataagttttctgctagcctggtatatggactctgcaggactcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttactctcattatcaggttaaaaaggctaactgtatttagcattatataagaggctttagttaactactatactaataatataccataaattatacttaatgtcaagttaatttatcaattgaatctataatttttgatgtgctacgtatatccgcttctctactatgtttaaggagatattttaatttcattaaaaaagaatttttttctttttctataatatcttctttatcattgtattctgaaaacataatgaattctatacctatactatttctattatgtgaaaacatatttatagaaaaaggtgaatcaaaatttttatcatctttattaatactaaagtcttcagtaacatgtaattcatttatttcagatatttcaaagtacccattaactcttttaagttcaagataactattatatctaaaataacgctgttcttctattaacttctcttttgttagataaggatactcatttataaatataggattacttgttccatagttatctctaatatattctgcgtcctctaaagaatcagtataacctaaaacttcataacttgttgtatacactgtatcttcttcccacaagtcatagtccatttcctctatttcttcttctaatatataaattttttccatatattactcccaaataccaataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatatggtgtaatattttcctcttcttgtatgtgcttacctatgatatcatataataattctgagtgtattcttttatctctcattatagacctccgtaaggaatgctacagttttgtctttcaaagatttttctactaattccatagcatctttatagtgtttgatattagattcattatacttaagtttatcttttacttcttgaattagaggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatgttattaatattaccgataaccgaatatgctataggcttaaaattagctctaacataagttaaaaatataaaatcatcataaaataaatctaaaacagttttattaaatctagtatttttagcttgctctaattgagcacataaattaagaacattatcaaacccactttttagcactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaggttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagtaatcctccttaataaccatgtttagttacccatcctgctaaagcatccatagccatatcatattcttcttcatttttaattcttataattttctctatttcttcctttgctttcttagaactaataaaatcaatatcagtatcctctaggttagttaattctaaattttctctaataaaattcttttgacttggtgttatagaattaactcttacattttcgtgatttagaaattggtaaaagtccatattactcatcctttttaacgtattctgccatatcttttaaaatacttagtacatactctaaatctctatattggtcatctaatgaccctataatagcatatggtgtcatatcccaggcatgtgcacagtcaaaccctaatactctcttaccctcatagtcataatcatcgtaagtgatacctctatgagcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataatcagtcatctcctttttatttatatctttactatacactattttttctattttgtcaacaaaaaaaggctactaattaaagtagcctaaatactaattatttagcattgtatttccattgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttactcctcctaattattcttacagtactaatatatcataggtctttttctaagtcatttttaaaagtttcctcgtaggaactagcgtaagtaacctcataacccactacgttagtatatcctacatataatgacttataattagattttatcttaatatcttctgattgttctagcttatttaagacttcatttaaatcatctgaggaatagtgttcattatctattgttattgtttttccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattattaatataagagaaaagcagacttattaaaagtctgcttctttacctaattctaatcttctatttttcatatgaggaatcgtttttttatttcctgttaataatgataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagtcccatcttcattttctttaaatttatgagcatcataaacttctactttgtcacctaatctcaaatcttgagttaagttatgtttaccgataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgagttacagttaagttatatgacccatcactaacataccctaaatcaatatcatgtctaaaagccaaatcttctaaatgttctaataaatcattcttttcattatgtttttcttcttctgtattatttttaattgggttaattaactctgtacaaacgatatcgtacaattcaccatctgtaacctcatagttcttttcaattaatacatcttgtattttattgattgaatttgtaactactttcccatattcttcttctgtaaatttacatttatctaaatcaacatctgtaattaattctgcaatccatttatttaaaattgatactgccattgttctagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacagctattgataaaagtttaatcgggtttttcatagttactctaactccttaagtttattttttactttctctttatcgtacttataatctttactagagttttcatttttttctttctcttcttcattaagttctctatactgagcttcttctacctcttgttctttattatcgttattttcttctgctttttgaatttctacatttttactattaccaccatttaccttttttctaaaaagaaaccaaagtattaataaaatgatgagtaaaataataatgcttaatacaacagcccaaatattattagccattacaacctacctccgaatagtttttttacagctcttaaattttcagatgaatcgttatttatatcaatccctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcataccctgaatttgataatttacctaagtaaaggtttatactatatccttttgtttctaatgtttgaatagcacttaacattatagcacctctataagcaagattttcagggtcttccctccaactaatactagaattataaaatacatcaataactttcttctctgctttaactctttgctgagacatcatagaattaggtaatccttttatagcattaggtacgtgaggttgatatccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatcggatgaattatctctacctgaaactctattcttttttaaagcagaaaagaaatcaggtagaccatcatatttaattacatttaattctgagttatctattaatcgtctacccattgatttgcctcctattctaatcctaatttatccataattgtatcaaaatccattgaatcttttgatgtactatcagattttctaggttcctgcttaggctcttgttgcatacctaaaagctttcttgttgcttctgtgtatctgttaccttcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagtttactaggtcttcattgcttgatagttgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgagtttcatgaaacttaccatttgcatcaataaatcctgttaatttaaattcttgcgtaattgcattactaaaatagaaatctaaatctagggcttctgctacttgttccaatacatggttcttacctgaacctgctccaccttttaaaaatactggaatattttggttaactagctttagtatatcttggtatctataatgaaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcgtacggattagagtttttctctcctagtttttttgctaaatctgctgttgtttccatttgttgctctaccaatctctctaatctttcaatagtatcttgctttgccatatttatcattctcctttgatttgttatacatttattatattacaagtatttgaatttgtcaacaactttctaaaactttttttagttgctaataaaaaaataccttacacctataacttaacatagggtaaggtaattgtcaacacttttgttaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcttaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttgctacctttatagtgctcaggtaaatgtgcatctacttgtatattataataattttctaaaagacctatactctcaccaagactagacaaagcgtaacctaaatcatttgaatcattagaccattccttagatactgatagtgcatcttctataattgttacttttaatttatctaaataatcttctacttgagcttgtgttttcataaattcttttgcgttcatgtaataccctcctaaattatataaaaaaacaccctgcttggctacaagcaaggtgaaaaaggaaagatattatggaagtgtactatctaagtacacctcataatataacagttttccttgctagttattacttattttttaaggtcttcttcttttacaaacactccattaataagcttaccttttctgtcttttatctcatcataagccatatcaatacactcttcaatatctatatctaactgtaagcatagtactgttaatactacaaaaatatccccaacactatctcttgttacatggtcattacttttagcaatacctgaagctaattctcctgcttcttctaataattttagcatttgaccctcgggtttacctgtttgtaagtttctatcttttgcccattgtttaataagttctactttttccattattctatatctcctttaatttctgtatctttgataattaggctatcagagtcacttgttacatttaaattatcttcaactaattcatgtaaattattagtaatatcttcttcatacctataacctacacgaacataagctttaactctgatatctatattaacataatcttcttggaatttttccatttctaacttcctttattgtatcatattattatactattgtcaattaatctgagtagtttcctttagcaagttgatactttttgtgtaattcttcatataattctctcataccttcgtagtttctcatatcatcttccaagaaactaagataatctaataatacttttacatcctcaggttctaaagttataactggttttaccattaggcaacctccttaaattcttctttatttattttcttaatatctttttctaatgcttcttttaattcattaggtaatttataggcatcaattgattgttgttgccctagtacatatccattatctgtaatacgtatttcaactgtaaaccatgaattatctaaatcttcttctagtcttgctaacaatattaagcaactgttctttataattcgattagcatacccgccaacacaatgagatagcattttaccttcatttttcagtttacttacggtatctgcaggaaggaattttacttttctaccatcttttaatttataagttttatcaattattttttctaatttattttcatatttagatttaagctctgcatcatctaattgttgttgaatagattgtttctcgtctgtaactatatcatgttctaattttagagagaatggtgttaagttaacactttctaatgttctataaccttctcgtattaatattgataaatcatgaagataatctaaatagtagctatccagtgcatatcctgttatacgttgtctatcttgagcatctacatctaaataatgagtcatttttttgtaattagcaaaagatatagataatatttcatttacaataggttttacttttaaagcatctgtaacatttcttacatcctgaaccattaaaaatgtatcatcaaatagttgatgtagattaacttcattgtgtaaatgattatagtaattatacaatgtatctgaaaatcttaaataattactctgttcaaaattatttaatgttagtaattttttatacgtttgctttgtaagattaaatgcttcatgtattttccacttaggatttttaggtatatgaaatagtaatgaatttctttcaaataattcaaattcctctaagttatttattttgtcaatatttttaacaatatctgttaagattgttaagtaattagaagttgaattttctcctttgagtggtttatatttgtttcctccataatttacacgcccatatacatcaacctcatcaaggcaccaactagaaagtccaaaaccatcatttcttaatgtttcttcaattattttaataataacattcttacttaaattaggtgttgaataattttttaaaataacatttaataaaacagccaaatttaattcatttttatattcacttttactaatatcgtctttgtatagatttaaagttatttctttattaacaagactgtctgttaagaaaaccttaacttctcctgttttaacatcaaatgaacttttattttctaaaacccatctatttcccatattatatttatctctaatgtgtctaactttaagaccaaaagatgaactattctcagtacttggatgcatgtaccaagtactactgtacaatgaatctgatatttccttataatacttactagagcctttttctgtatcttcattaagtctggaagtaatagatgactttattaaaccgtacttaccttggtataagatatccataatatcattattcaaactatctactacttccttatactcatctaattgtctagattcataccaccttaaacgggtttcattttctaattctttaattttttcttctacataacctttagattttatttgtgttatacgtttactaccatataaaggaaattcttttctttcttctctactggatgcaatatattctttgtaacttcttcctttattttcttcaattacaccttcaactaatttttcaattgtttcataaggattacctgtaaagtttgttacttctttattaccacatagtgctaagaataaatgtatttctgtagcagtatcaaaactaaatatattatgaatatctctaaatagttccttagagcctaagttaattatattatttttcttcttcttaaggaatacatcttcttctcctatatagatacatcctttattaactttaggtaaattaataatttcttgttctgttaatcctttttgtttatatgttattgccatttaaaatcactccttatttgttatgtactaatcataccatagtaaataatatttgtcaacaaaaaaagaagaactttttaaagttcttctaagtgagtttcgtagataaccttttgaattttatttaatggtttcaaatctaaattacgaataagtttttcgtactttctagaatttttaaaattgatagtatttggcatagcaagagcctcatcaatgtctttagtatagcttataacatctgaataaatatctacttcttttacatatagaccttgagttaaacttttaaatactacctcattatgtgctacaacttcttctttcttttctatgctcatttttgtaaacctcctggtctattctacacaaacaagtacgtactctaaactagttaatgttactgatttaatattatttaattcttgtaatttcttaatatctacaccatagtttttacttatagtccataatgtctctcctgctcttactttatggtaatacttattcccttctttaataaggtcattcaatattacctacctccttgagtaatagttagcttgtagataacatataagtataagaacaaagtttacaaattcagtagctataatgtgaacataagtatgtgataaaaccatacttaatattaatgaagctaatcctaatccaataataaggaatagaaatctgtttgttccttctgcacttttagttttatagaatgttgttatctgagttacatacgcaaggataatagtaatagttgcaatagtttgtgttaaggctgtaaagtcacttaataaaaatagtaacactgagaacacaataataaaaggtatagagaaataatccttttttctatacgaagctactaataagcaaacaataccaagagttaaattaacaccaactgatactacttgaaacattgtagcgtcagttataagtaaattgtaaaagctaatacctactgtagctacaattaaataccaaaaataactactaactcctttaacactatctgatttaactaaagctattagacctggtatataacctactgtaactaatatagcatataatatacttaagtaatgtgataagttatccatcttgtcctcctaatttctctagtctttttaaaacttcttcccaagaaataaacccttctccattagttaggcttagcacacatccgtaaataaattggttcgtactaaattcagccctatcagggtcatcataaccttttccatgtccttgacgaatatcagagcaatagattaaaacaggtttatttacaatattataagcttctaaaatatcatattgtgttaagggctctaagtctctaaagtctatatcttcatatttatcaataattttttgagcttggtgtttcattcctaataaaataccaagttctgcaatcgttcctagcccctcattaagaatgtcaaatacaaaaatatctgattcttgcatagctttaaaatcattgtttaagatacgttcagctaatccagtttgttctgcattagctttatcgttgattgatttgtcctgatgagggctataaggagttactcctacaataccctctacttgttcgtgttgtttagttctatattctaccatagcttggttaagtagatgacctcccatgtaacaaaccttatctttagtataattaaccatctatagtatctcctttttcttctagaatacctcttaaaatgtgtggcatctttttcttaatttgtttttctataattttcatcatattttctttttcttcttccatgatatcatcaacaaaattttgacctacttgtttcataattaaaccaaaattttccaattctaaatcatctttagacaatctgttttcttctatagctctaaaaatcattttttccattcttgattttgtgatagcataatctgctacagaatcattacttctaacttctgatttcattttcttacgactaaactctttaaattccttagatactaatttaaaataatcatcatgttctgatttaccatctaaatatttaataacaataccttctcctgtattaggtttaacagtcatatctgattttcctactaaatcttgaatttcttgagggtttaatttattaagataaaaagatggttctataatcattaaagtttttacagttttcaaacctaatgtttctgataaagaaatgacttctgaataaggtaaataggtttcactatccttatcgtatacatcgaatacataaaaattattataacactcttctttataatttaccttatgtttaactaaccattctccaaatataataataccttctaatatagataaatctaatttatctgtcatgttttcatgtacccaattataaaaaccgtttaatgtttcgttttcatttaatttttttctacgagagaaacatactaactcaccattctctgtagtaaaacttgcgttgcttccatctaatttttcttgaactacaaaacctctatctttaaatttgtctaaagataatcctttattttttactttagtataagatttcattaattagttatcctcctttgaattatgtactattgaaaataaaataagacttacacttgccaaaaatgctaatactactaaaccaggtaaatttagaactgttgataagaataatgctactgcacttataacataaactagaccgcctaataataaagttaataatacaattgttataagttttaccaaccagttattattaataaatactttagctaaataattcataaaaaagcctccttagttattataatataagtataccatatctaaggaggtttgtcaacatattattttaccatttgaaattatctgcgtattgggctaacttagaacggaaattaactgtaaaattatggaatactgcaccatcatattttttaaaatactccatgtaatccccaaaacctgatttactttcattttttaaatctatttgtttaaagttaccttctactattacagtagaattttttgtatgaacccttgtaagaacttttttaagttcactacgtttaaagttctgtgcttcatttataattatagtagaatctcttagatttccacctcttaggaatagatgtgatatttgagatacccaacaatctcctagtttatcttctttaacattatcttccatcattaacatttcagttatttgttgttcaggattcatattaagttcaataagggcatcgtgtaatcccatgaaataagccatttctttttctgtctgattacctggtctgcttcctaaatcctctgatactggtgaaattataaatactagctttctatctttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacttcttcgtcttctacatcatcataaccaatatcataattattataattaaaatctacaatacaattttcactattacctttagataatcctgtataaataatatcatccacagaatcccaatcgttatctgccaaataatttacgctatctaatactgattcattatcaggtaaataaatactaccgtctgaaaatttaattagaatatcaccttgaggtaaagtatcattaattaaatcaatctttgtttcttcttcaatagtgaatacagttccttctaatctttccggtgtagtatgcgttaaatgttttacagtatctcctgattcttcatagaatcctactgcattcatatctttattatattttgcaataaatttaccattgtcacttaccaaatattgactagttgaattatagtcgtttgcgtcatctactgtcatgcaagggttataatctttaacataataactaattttcctaacatctgttgtttgtactttcttaccttcacctttaattactgaattaatttttttcataatattttctcctttttatatatcaattgatttttttgcaagattatcggcatagtcattccatttatcatttgaatggctctttacttttacaaaatttatatctattactttttggtattctcttatcatattgatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgctattatatttccttctttacttaccaagacagcacctgagcctactttacctttattatatgaggagctaccatctgtgtatatatttacactatcctgcatatttataatcctccataaattgagggaattcacaatctgagtatacttctctacaaaaagatactgagatataattaaaatcaaaacatttgaaacagtgttcttgaacttcttttttatctttagcaatcacattaaatttaaaaccatcagctattactgtaaatactccttttttcataaaacaaatacctccaccaattttattttaaattaataactaattcaataaatgatttaatagttttatttttaccttcatcaatatctgaaaagaagttaattaaactatcatcctcatcaaataaatcttcaacatcatcaaatttatttaatatgtctgtaacactataaccttcttctgatatatactcatgcaagtcttctccatcttctgacagtgttgcttctattttaccatttttactttcaattaaatataaagtatttaacactttaacagaatctacaactacactgtagttactaatagtaggatattctgtataaagtatttctacattagtattcatataactatcaattacagagttaactgtatctctttttagctcagatacattatgttttcgtatagtagggaattcttcatcatattctactaattcttttctatctgtgttcaataacttgtctaaagaagacaacaatactattttatactggttatcagggagactatctgtaatttccattattgttaaaaacgtatcttcacctagaactttgtttatatcttgtaactcaaatgaatctaccatttcaatagtatcatctatatcatctgtagtcattaaaaaattaactaaattattattctccatcatcttcctccaattctttgaataactcttttcctggagtatttaacgctttctctaaccgcattaaattagcgcttcttggtttcttttttccatactcccaataagatataagagagtaatgaacacctatctcagaagctaggctccttaatgtatgtcctttttctactctaattttttgaaggtttagaggtttactttcctttttttcatccataattatttctcctctacttttaaaaatttaaaatcctcagatgcttttgcattttttagtatatactcgtgtgacttatctcttgcctctgccttgcttttagcatataactctatatgaaatacatgaggtttttttaaagacggtgattcatatctccaataaactttaaaaagtagtgtttctttttttaaaacattaattcgaaaccatcttttaaatttattcattcattatcctcctttatttatttgttaaactaattatagcatagttaacttatgaagtcaactataatatacaaaaaagactaagaaattaatcttagtctaaatcgttactaatagtttccgttggcattatggaagtttaaagctcctgatgttgaaccgtaacggtcaatcatatattgttttgcacctttagtttgttctgctatagaaccaccactccatgatttacctaatccttggaataacccttgggctcctgatgttggattaacagcattcgggttcaatgtagattcacgcatagcaatttcaatcattgcttcatctccgcctgcttgtctaatctgttctgctacagaaccacctgtacttttagtagctgtagtcttagtttctactttaggagcttctactgacttaggagcttcttgagtagttgtttcttgtttaggttgttctactgctttattttgtgtatcaaattgtgcttgttgttggtctactttttgttcaggtgtttgctcttctcctgctaatctagatactgtattatctacttgagttgaacctgaatgatattcataaccaaagttaccattataattatagaaatgataagtaaattcaccatcactaaatgagaaatcataattaccttcttgaattggttttgtattaacttctactgaatttgatttagcttgttctgctaacttattatagtcaatttcgtctgcactagcttcgtttgtagccatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaagagaggtattaacctatctaatttattattttcctgttacatctacaatagttccgtctccgccaatttgaataggttgttttccatcccatttttcaattagctgttgttgtaaaacttcatctgttaatgattcacttctgatatcattagctttcttctcaccttttgcttctacttcttttttcttagcattttcttcagctatctgtttatcgacttttgtacgttctaattcttgatttgcttttactctttcgtcaattgctttttgagtattcttatctgctttaggactagataatgcaatatcttcaattacaaatccttgtttttctaaattatcatttaagctatctaaagtatcttttttaatttgtcctgttttaacaccaaatgcatcaattactgagtacttagatactgattgacgtacattatcttgtacacgagaacgtaagtaacctttttctaattcttcaatgtcagcactaccaaaacgattaaataagtctacagctttagttgcatctactttatatgaaacatcaatatccatttgtaaattcttaccgtctgaagttgccacgtttaaatctttatatttatgtgtttgtgttttagttggatatttgtttaccttatcaaaaggtgctgttaagtgccaacctggtgatttagtatcttccttaacaccatttactgagtacacaactccaacatgaccttgtggaatctttgtaatacacattaataaaataataaatcctataattgctaaaaaccctattactcctgaaataactactgacttcctcatttacatttctcctttttctatctcttttattaaactatttaaagctttttcctctttgtctatttcctgtttgtctgctttggtaacaagagattgcctacggtcatttaagaattgttttttatattttacatattgttctaaaccgtattcttctaatgtaccttgcctaactaattccctgtattgttttcttatgttacttttcttctctctcattgaaagaaaatcaaatacgtaactcataccaaaacctacaaggactagaaaaacaataaaaatagcaaagtatgttaaaaataatgccatgtaattcctcctttatttgattacatatataactatacactatgtattacgttttgtcaacacttttttgcaaaaaaaatagacggatttaaaatccgtctaaatttatactttatttaaatattgttatacttttagtttcttcatactctttcaacattctatctctaagatttattgcttcttttatactatctacttgatatgattggtaccttatattatttcttgttatagaaactctatatttaccattagttctttcttgtatgttttttaatccttctagtttagagggtctattaactatattttcacttctagtagtccatctacaattttccggagaatagttaccatcattatcttttctatctaattggtatttatcagaaggtcttttacccatatcatataaaaaagattcgaaagagtttttccatctatcacaaacttcaatacctcttcctccataatatggataactgtcttgatttttgttatagcatctttctttcatttttctccatactgtatactcaggatgttttttagaaccattacgtgatttcatacaaccacaacttttataatagtataattgacttttagataaaactctatccataccgcaatcacataagcataaatataatttacctttaatcttatctgaacctacatattcttcaacaaataatttttctatttttttacctataatattttccataaaatctctcctttgaaaatattataacatatatataaggggtattgcaacccctttatttattaacctttgaatacaccccaggcaactccaggtacatgtgaaggtggaacaccttgacaagttctaacagggcaatatactctgttaccattgtaagcattataacctatccaaatatgacctgcttggatacaaacttcgtcatatacaattgtagcccctgccggtaagttaccgcctactggagcatttaagaatggagaacctattctagttactataggttggttaccattaacaaatgttgcattttccggtttataccaagttccgtactggttctttttccaagagcctgtaactggtctagttgccggtgtacttgcgctacttgtttttccatctttaactactgtagaacttgaagtccctttatccatgtagtttttaatttgtttaatgaaataatcttttaatttattcattattgcttgtgatggtcttccttgtgttactggattaaatcctgtatgaagaaccatagaacggtgagggcaggcagttggtacaaattccatatgcaatcttacagttttacggttaggagtaagaccccattctttaaatttctccgctgtaaattggaatactgcttgttcatttttaaggaattgagcatcactagcactcattgattgacagacttcaatacctgcaaatctaaagttacctgagtttgctcctgttccatctcctgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggagttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaacgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcgtcaatggctcctgcttccattacaccaaatgatgggtcataacttgtagcttttttaactctgtaagggctatctactgttccttttgcataagcgtctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagcgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctgtaatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattcttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctactcatactgataacctctattatctaacacatttctgtgctccaactacagttagtcgttacagcgtatctttctaggattccgctaagaccctagaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaattttaaaaaaaattatagaagtagggacgtttacctacttccatttaatttacacaaggatgataacattgttattgttttatactggaaaacaatgtaataaaaacagtgatgtgtaaggtatttgttttattgttaattacattatagcatatactgatacctttgtcaagttaatttaatactttttttaaaatattagttatcttttgttaattcttcctgaatagcatcccatcttctttctgcttcactacgattatcttctatatgctttgtagttttacaacatttaatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatactgataaataagtcaacagttttctaaaaaataatttaaattattttgaagaatcctttaatatcagtacttacaagagaaaaagtacgtatttagaaaataaggagtactcctattatatataattatattctgatatacagtaattaataatattaaatatataattataattaatagggttgggaaaattgatataaacataactgatactgtttataaatactcagtataaaagtaaaatcccttagtatcagtacttacaggcaaaaaagtacgtatttagaaaataaggagctctcctattatagttatatatatatatttattactattattaattactatttaaatatataattataattaacaatgttagaaagtcaacaatagcataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttcttagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcgaatctaagtttaccgaagtcttggaggtctaactcttttattacaatattcgggtcatcagaaggaaggtaataatagtcgaagtatataattgagccatttattagtagacggtctattctatacatatgaaagaatcttctgtctcgtttgaaatgagctagtgaatctttaaactctaacttaagtatatccttatatttagtcaaagtggtaacctccttactattaatttttaaatttacttattttgtgttataatagttatgataaaggcagttattataattatattaagaataaagataataattattttttctgagaaaataagccaaatactacaaacagataaaacatagatagctgatagatatactatattaatagttaccttacttttatcttttctatagatagaataacctaaagaagttgtaacaccactaagtataaaataatagaaacaaaaaagaggtatagacagaaaaaaagatacgataatcattgttaaacacctatttctttttgacctattatttctagaacttttagattataccactaatataacattaaaagccagtcataaaagtcaattgttagattaataatataataaaaaaagacaataggaggttaaagtggttgaataataacatagctatattcatattcaaaacattggttatcattatattcttactgctatttttgtctgttgttaattccttatcccttatttactcaataagaccgagtgtagttatggcatactttacctttggaggtattgtttctgatgtcgcacttactatgacagataagttcttacttaagaaagaagaccctctacctgagtatgttcttaaaaaagtagagataaatgataaagaaataagcataattaagaaaatcatagaaagtaattatgatataacatcagaagagataaaagttagagctaaagcacaacagagattagaggaagatagcaaagaggaagataacgatgaaaacgaagaaagaaattaaagaacaaaggaaagaacttaaagacggtgctacaactgtttctttagtaaaaaaaggggataagagaatagctagccctagtagaatttgtagtttatgtggtcagcagttatcaggtatgagttacactaaaggaaaagcattatcaaaagttaatcattttcatttacagtactctaagtacatttattttgatatttgtgcagatattaacaattgttataaaaatttaagaaaacgaggtgaaatggattgagtgcagaaaatattagagatataattaataagaaaaagttagaagaagaggatacaagaaaatatatagctgatggatttatgaatggtatcggtaaattaatgtatgaattcaataaaaaagtagataataaagaaatagaagttaaagaccctaacgatttatataaactatttgtgatattctctcaaatgcagaatatggttaatgaaacttctgaaggtggagcaatacctcaactatctagacctcaacaagaattatttgaagagattacaactgaagatagtaatggggagtctactgtagacttacaaaaaatatcagaaatgtcagcagaagatattacagaaatgatttctgaaaaagagaaagtaatgaatgaggaaaattcaaaaacattctaaggggaaagatataacatggatggaaaagaactaattaaaatagcacaagaaacatttcaaacagaaaaaataacaagagagcagatagaccatataatcaatatgttaaacccttctacctatatgcttaagtatcacacgctaagaggtcaccctataactttcagtattcctaatagggatagaagtaaagcacaagcacaccgaccttggcaagtccgtaaacatactatgcggactataaaccttttctaaaattggaaactcctaacaagtgaagttgaggacaatcaattgctaaatcgtaactaagataaatattttaattacgtaaatgcctaacgactaaatttccaagtaagcaataaaatggtattgtgtagaattggaagagagggaaaccgtaacgaaaaggacttttacgcctaactgtaaaagtatgatatagtctaatcccctaataaatatcgggaaaccgagggtagtaaatgatagtaaatgacactcatccaaacaaagcagttattaaaagcagacaattggggcttagtgagatgggtgtaatggaaatggttcattttgcagatatgcatagctatgccaatgcaaaatgtttatatacctttaattagagaggcttcacgtagcaatgcgtgttgaaaaaccttgttaaacggggaaacccctaacgtaaagacgagggcaatcccgtgctaaatgttgactaacctaatattatatgatatattagttatagtcagctaaatgccgaacgactaaatttctaggtaggtatctaaatggaggtactgagaactagataaaaaaactacttaaaataattagacttaaaaaaatactgttggaaggaggatatttaatgggaaaaaaattaactaatactgagtttttaaatagagtatttcagttagttagtgatgaatactcatttttagaagagtataaagggagacataccaaattaagatgtaaacataatttatgtagttacgagtgggatgtagaacctggagcttttttaggtaataagaacaaagcaggaagtagatgtcctagttgttatggtaatgttactaaaacaacagataaatttaaaaaagaaatatacaatttaactaaagatgaatataggttactttctgagtatattaatgctaaaacaaaagtaaaaattaaacattctaaatgtggtaatactttttctatgacacctaatacttttataaatggaagtagatgtcctgaatgtaaccctcaaaaaccgtataatacagattctgctaaagataggataaataaagaaacgaatggtacttttgaactagttagtgaatacaaaggttgttatgagcttatgaagttaaagcatcatgaatgtggaaatattgtagaaataaatatgcagagtattgatagcaatagactaaattgtccttattgttataataggtctagaggtgaattactagtatcctcatttcttctttcaaaaaacataccattcgaagtccaaaaaagatttgatgggtttaagaaatatccttatgatttttatatagctgattataatacggttatagaatatcatggagaacaacattataaacctattaagttttatggtggagaagatagattggtaaggcagaaaaatatagatttaaagaagaaaaattttgttgagggtaaaggtataaattacttagaaataccttacacattaaacaatcaaaataaagtaaatgagtttttaattaattattttaagtagaagtaaagcaaggaacccttaaccaaacttaagggttatgatatagtctaaaccgtatataaatactaggaaactagcggtataattgtcctacaaatgaacaaatgaagaaatttgttcagtctcgtttaaatcctgtattagaaaaagaatattttagggatattgttgattgggataaagactctttaggttttaaaaagataagaaattctagtttattctttagaacaagttctaaagcaagtactgtagagggtgtggatattgactatttatctttagatgagtatgacagggtaaacttattagcagaatcgtctgcactagaatcaatgtcttcatcaccttttaagattgtgagaagatggagcacaccttctgtaccggggatgggtatacacaaattataccaacaatcagaccaatggtattacggtcatagatgtcaacattgtgattacttaaatgaaatgagttataatgattacaaccctgataatcttgaagaaagtggaaatatgttatgtgttaatcctgaaggggtagatgagcaagctaaaacagtacaaaatggtagttaccaatttgtttgccaaaaatgtggtaaaccactagatagatggtataatggtgagtggcattgtaagtaccctgagcgtacaaaaggtaataaaggggtacgaggatacctaataacacaaatgaacgctgtatggatttctgctgatgaattaaaagagaaagaaatgaatacagaatctaaacaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggcaaggtagacttaatacgattattctctgttaaaaaaatgacaagacctgatttagttgaagcagatttagaaaaaataatttgggaaatatctaagtacgaccctgatattataattgcagataatggagactcaggtaataacgttttaaaactcattaatcattttggaaaagataaagtatttggatgtacttataaatcttctcctaaatctacaggacaattaagacctgaatttaatgagaacaataatagggttacagtggataaattaatgcagaataaaagatatgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtttacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatactttagatgttaaatatgaacatgtctataaatctctaggattcgataatttctttgattgttttttatatgctaatagagagcctgaaatagtccacaaaggtggagataaaaatcttggtggactaaataaggttaaacgtactgttattcgtaatggtaaagaaatggaaatgacagtttacgaagacggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctagtttaagtaaaaagggtgtagatgtatcccatattaatacaaacttatcattgtataaagagtttgttgatgataacggtgatacattaggaattacatcttttaaacgaactgaaaatgatataatattagaatcttatgcaagttcacctgattcagatggtgtaggagcaagagctattatggaattattacgtttaagtattaaggaaaataaaaatgcagttgtgtatgacatagaattacctgaagcagtagagtatttaaaaactttaggatttaaacctaataaagatgggtacatcttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagtaaagaggagaaagaagatagtattaaagaatttagtagtttattatgtgaaatggtaaataggctatacaagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgattttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaatggataatcctattataacaaatccggttgaaccaactataccttcagatactatacctcctattgataatccttcagttccggtatttcctgagaatccagtagataataatcaaggaaatacagataatccaaacccaccgcctccaggatatacagatgaagatggtggaaggggctccggtggtggaggaaattctgaaccaccatcaacggaagaaccttcggataatggtaacactggaggaggagattgggaagaaaaacctgacccaggagaagaaccttcagataatggtaatacaggaggcaatggtggagaagttacgcctgaacctgaccctaccccttctgaacctgaacaaccgaatgaaaattctgatgaaggtaatgaagaaaaaccatctgaaccgtctgacaatcctgatgaaaatggaggatgggaaactgaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctcttttttgtttgctatattaaataagagttaaatataaaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggtgcaatacttggaggaatttggtacaagatgatgaaaattattaaaaagagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgttcgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatactaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacctggtagaaaagaaaaagaagaaatgaaacgtatagaagattttattgttaatactggtaaagataaagatgtagatagagattcatttcaaactttctgtaagaaaattgttagagatacttatatctatgaccaagttaactttgaaaaagtatttaataagaataataagactagactagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcctcaggatatggattatcagaagtagagatagctatgaaagagtttattgcctataataacactgaatctttcaatgatagatttttctcacatggtggtactactagaggtattttacagatacgttcagaccaacaacaatcacaacatgcattagagaactttaagcgtgaatggaaatctagtttatcaggtattaatggttcatggcaaattccagtagtaatggcagatgatattaaatttgtcaatatgacaccgactgctaatgatatgcaatttgagaaatggttaaattaccttatcaatattatatctgctttatatggtattgaccctgcagaaattggtttccctaatagaggaggagctacaggttctaaaggtggctctactttaaatgaggctgacccaggtaaaaaacaacaacaatctcaaaataaaggtttacaacctttacttagatttattgaagatttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaaggacaatcagcagattctagtaatgatgataaaagtaaccctgaagtaggaactgactctcaaataaaaggggattcaaacgtttatagaacagaaacttctaacaagggtcaaggtaaaaaaggggaaaagtcttctgattttaaacactaataaggaggtaaaattaaatgtcagttatatataaagataataattggattgatttaactaatgttccttatttacaaaaaggtgatagtggatatcgtaaagatataccaaggaaaaattggaaaaagtgtttaaatacagaagtaagtttttcttataaaggtaaaaagggtctattttatgtaacttatcgtaaggaagataaaggaaaagttaaagttgaatatgataagtatgttaagataatagaccctcatgatttaaagacactaaatataaataaaatagttaatcctcctaataaagctaagtatcgtgagcaggaagtaattaatggtgatactgtaagaaatattagaaaagttaagaatacaggaattgtttatactatgttatgttcagagtatgaagaagaatatgatataagagaaagtgatttattaagagggagaggtagcccttataaatcaggtagaaaagtatgttataacaattcattatattctgttgaaaatttgagagaatatatctgtgatttagaatatgctaaaactgtaactaagttttcacataaagatataaaatgcaagtgccctatatgtagtgaagagaaagttatgaaggttaataaattagttaataacggtttttcttgtcatagatgtagctcaactataacatatcctgaacgattaatgataggattactagaattaaataatttaaactatgaatatcaaaaagtatttaaagacctacctaatagaaaatttgatttttatttacctaaattaaatatggttattgaaactcatggattacaacattatagggaattaaatggttacatgaatcatgaaaaaacaaaggaatcggatttagagaagtataactattgcaagaataataatatagattatattgaaatagattgtagttacagtgatttatcctttatattaagtaatgttgagaatagtaagttaaatagcatacttaaaaataagaattacgataatcttagcaattatattataagaagtaaaaatgatgatgttaagtataatatatatttggattactgcaaaggattaagcaagaaagaattgaaagataaatataataaaacgagttattatataaacaggtctattgagatatttaaacattaattaataagcctagaataaatctaggctttgtttattttttttgtaatttaattttgataaatgtaataactatggtatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaggttgtagggatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatagagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaggacaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaatggagagcaagaaaaagtagaaggttatgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaacgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagatttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaacatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtttagagtttgatggtttagctaaattgattgacaaaaataacgtaattaacgctaaaggtaaccaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaattaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattagtgttaacgctatgtaccaacaacaaccacaattcgtttctatctaccgtcaaggtaaagaaacaggtatgtacttcctaataaaacgtgtaccagttaaagatgcacaagaagatggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagttaaaggattaactaaagagcaagaaaaagaatttgcaaatgttccaggttttgaatttgaagaagaaaagaaaactactagaaaacaatcagcttctactagtaaagaagaagagcctaaggaagaggaaaagaaagcctctactagaaaaactacaagtactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacatatagacgtaagtgagatagataatttaacattagctgattatggatggtcaccggatgcagttaaagcatatatgttcggtatcatagttcaaaatcctgatacaggacaacctatgggtgatgagttttataaccatatattagaaagagcggtaggtaaagctgaaagagcattagatatatctatactacctgacactcaacatgagatgagagattatcatgagacagagtttaatagttatatgtttgtacatgcttatagaaaacctatattacaggtagagaacttacagctacagtttaatggtagaccgatatataaataccctgctaactggtggaaagtagagcatctagcaggacatgttcaattattccctacagcacttatgcaaacaggacaatcaatgtcatatgatgcggtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgcctcctgagttagaacaattagttataaaatatgcattgaaagaaatataccaagtatggggtaacttaatcattggtgccggtattgctaataaaacattagaagtagacggtattacagagacaataggtaccactcaatcagctatgtatggtggagctagtgctcagatacttcaaataaatgaagatataaaagaactattagatggtttaagagcttactttggatataatatgataggattataaggagggttagaaaatggaaaaaccgtatatgataggagccaactctaaccctaatgttattaataagtcaacaacatatactactacaacacaagcagatgaacaagataaacctaagtatactactagactagagtttgatacgattgacatgattaggtttattaatgaccgaggtataaaagtattatgggaagaagcatatttctgcccttgtcttaatcctgatacaggacatcctagagtcgattgtcctagatgtcatggtaaagggattgcatatctacctcctaaagagactataatggcaatacagtctcaagagaaaggaactaaccagttagatataggtatattagacacaggtactgcaataggtaccactcaattagaaaagaggatttcctatagagacaggtttactgttcctgaggtattgatgcctcaacaaatgatttattttgtgaataaagatagaattaaaaaaggtatacctctatactacgatgtaaaagaagtaacttatatagccactcaagatggtacagtctatgaagaagattatgaaattaagaataatagattgtatttaaatgaaaaatatgagaatcatacagtaactttaaagatacttatgactttaagatatgtagtatcagatatactaaaagaaagtcgttaccaatatactaagtttaatcaacctaaatcaaaatttgaaaacttacctcaaaaattacttcttaaaagggaagatgttattgtactacaagacccttataaagttaatgatggtatagaagaagacctagaaattcaagtagatgaccctaaggcttcggcatctaatcctagtaatttaggtggattcttcggaggtgcatttaaataatgccagttcacggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttacctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttaccaagatatgagaactttaaaagtagataaaggtacaggttcagtctctaagataactgattacctagaaggacgtagaaagaatgtaagccacccttcaatgaagcctgagcctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggatagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagataccttagtcgaatcttctacagcaataagagaagatgataagttagtttttactgtttctaaaccaataggagagttaataaaggtagaagatatagagtttgctaaatacgataatcttcaagttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgaaggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactatgcacaagctaaacgtttattccgttcaggagaattacttgatgcaatagaattagcatggggttctaaccctaactatacagcaggtaagattttagctatgcgtatagaagatgctaaacctgcttcagcggaaatcggtggattaaaagtaacatctaaaatctatggtaatgttgctaacaacattcaagtaggattagaaaagaatacattaagtgattcattacgtttaagagtaatcttccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagtaaattagataaaattgaaaatgcaaatatcaaagataaagctgtatatgtaaaagcagtttttggtgacttagaaaaacaaacagcttacaacggtatcgtatctttcgagcaacttaatgcagaaggagaagtaccaagtaatgtagaggttgaagcaggagaagaatcagctacagtaactgctacttcacctattaaaactattgagccgtttgagttaactaagttaacgggcggtactaatggagaaccacctgctacatgggcagacaagttagataaatttgcacatgaaggcggatactacattgtcccattatcatctaaacaatcagttcatgcagaggtagcttcttttgttaaagaacgttctgatgcaggggaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagatttagatgaattaaatgaaaatggtattattagtatcgagtttgttcgtaaccgtactaatacattcttcagaatcgttgatgacgtaactacattcaatgataaatcagacccagttaaggctgaaatggctgttggggaagctaatgacttcttagtaagtgagcttaaagttcaacttgaagaccaatttattggtactcgtactatcaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagatatcattgatattttagtggtagataacttaacgaaacaagttattatctcatatcatggttgctctgcaaataactacaatgaaacttggcagacaaatgaaattgtaacagaagaaatcgagttcagttacctttaactaatagaggctatgtttggtgacaagcatagaaaacactttaaattgcgtgaaagtcttaaagactagataactacaacgtaactcgaaagggtaagcgtgaatgttgagaaatcagaaaaaatatctagtatagtataaggttaaatcctaagtacagtaaaatagatgatacgcaggcaagcctacaaatgtgggaagcttcaacgactataataggtgagtcttagttacacattaagattatggtatagtctactccctttaaaatatatcgaaagatagggtacaaaggacagcatcagataaagctagaacttaaatttcttattaagaccaacaataaaagttggtcttatattttatacttgctttgtctgaggcagtgtgctataattaaaatacaaggaggtaataatatgggaaaaaatcaatatacatttaatattaaagaaaataaaaataaatggtatgaatggtgtaaactacaaaacgtaaaacctttagtagaatatgaaaatgcacaacaaatattttattttgaatttcttgaaggtaaatttaaaggactaataggaaaaacatattgggctagtataaatagaggttctaatatgcgtatgagttgtttaacatcagaaagtaaagataaatatttaaaaaatttaggaaaaagaaaaggtatagaggtagtagaagactataagggtggcagaaaattaaaacataaatttatagttttagaaggtaagtaccaaggatgtgaaggatatataactttaaatgatttagagaatttaggtagagtagataatagaagtttatctgaaaaaggaaggaaacaatactttgataaacaggcaagacttagagattgtattattctagagtaccctaaagactatagaataaaaactaaagataagatagtagtaaaagataaagaagggcatgttcataatattattgttcaggacttttttgagaaatcatctttattggagttatcttgtgctagtgaaggagagaaaatagttaaagaaatacttactaaaaattctataaaatttgaaaaagaaaaatcatttagaaacaaagaaggtaaagtacaaagatttgatttttatattaatgaaaataataaagaatatgcaatagagtacaatggtgcacagcactacatagattctacaggatatcttaaagatactttggaaacaacccagaaaagagataaactaaaaaaagaatacagtaaagataaaggtataaatttattaattattccttacacaataacagataagaaagaaatggaaaaaattattttaaattttttaaacaaataacccttgacactccctcaagggatatgttattataataacaggttaggagtaataagtatgaataataggcaagctaaaataaaaggatataaccaatttcattattatgattttccaacaactaaaggtaagtttaaagatataatgaaaagaaaatctagaacagaacttaaaaaagatttacaaaaagaaaggaagtattatcttgacaaataagagaaaaacgataggtaagatgagtaacacaagagcaacatggaatattaatccggtaactaaagttaaaaaagataaaacaaaatattctagaaaaaataaacataaaggtcttgacaattataattaactaaggtatattattagtataacaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaagaaagttaaaggtaaaccaacaacaaatatacctaaattaataggttttatttttaaaaataagtttgcctacgaaaatatcatagaatacaataacacagattataatggtaatattgagaggagaattgttgttaaacatcctaaagttataactgtagaaggaaaacctagctatcagtttttgacaattagtcttgaagatgctagagttattacagtatggtacaacagtgtagatgatacacatagaacactagatttaaattattatagtaaagacttgacaattcaataaggaggtattataatgggtatcacaatagtaaatagttattttattctgtctaacatcttcctcatcatattaaccatattaaatggtaagggtactgttacaagggaatcactaactatgagtaaaatattagtagtaataacatcaattcaatttttagcatgtttaattattaatggtatttattggtcactaaaattttagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgcacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggtgttaatgatacttgggaaaaagaatataactttgaagaattagacttaagatttaaagttaaaattaaattacctaatgcacgagaacaaggtaatatatttgcgttacgttctgcttacttaggtggtatggatatgtaccaaacagaccaagtaattagagcatatcaaatgttagctacattacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctactgagcaaagatttaaggacttagatgattatcagatagagtttattattgggaatatgaacagagatgtttatgaacataacaaacaacttaaacaagctcaaaaaggtggaaaattcgatagtcaattcgaagatgatgatagtagttggtggaatgaatctcatgaagactttgacccagtacctgatttcttagatgctgatgatttagcacaacaggtggaagctaaattatccgatagagataaggaagaaagagctaagagaaacgatgcggagttaaatgatgaaacagaaggacttactacacaacatctagctatgatggaatacatcagacagaaacaacaagaattagatgatgaagtaggaaatggtaagactagtgaagaggatgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctgaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgctagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgtttgacatatgaccaaggtgcacgagttagaagtgaactaggtaaaataagttcttatgagagccaaagaaaacaaaaccaacgtaatttaggacaagcaagagagcaatatagcaactatagaaaccaacaacaagacttgactaaacgtagagctagcggtcaaattaataaggcacaatatgaacaagaattagcttctattaaacaggaaatgaaagctagagaagaacttatatctaactacgagaaactaggagcagaacttgataaaacagtccagtattataagggttcagttcaaaaggatttccaatctagagatgtagaccaacaacgaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgacaacaaattaggttataatagtactgacatgttaaaaatggctacttcatatgaagcatcagtagggcataaaagtgacgaggacacaatggcaggaactaaacaacttgctattggaggacgttctttaggtattagagaccaagaagcttatcaagagtctatgggtcaaatcatgcatactggtggagtaaattctgataacatgaaggaaatgcaagatgcattcctaggtggtattaaacaatcaggcatggttggtcgtcaagatgaacaacttaaagcactaggttctatagcggaacaatcaggagaaggaagaactctaactaaagaccaaatgagtaatcttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacacaataccaaggtcttgaaggtggatatgatttacaaaaacgtatggatgaaggtatatctaatcctgaaaacttgacagatatggctgatatggctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatctaagactgatgataaagcagaagatacttatgatatggctcaaccattaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataagggtggtagctccggcggtaatcctatggcaggtggaatgcctagtggtggtggttcacctaagggcggaggctcacctaaaggtggaggcactcgttctactggaggaaaaatacttgatagcgctaaaggtcttggaggattcctagtaggtggcgcaggatggaaaggtatgtttggtggggagtctaaaggtaaaggctttaaacaaacatctaaagaagcctggtcaggtactagaaaagtatttaatagagataatggtagaaaagccatggataaatctaaagacatagctaaaggtactggtagtggtcttaaagatatctataatgatagtatatttggtaaagaaagaagacaaaacctaggagaaaaagctaaaggttttggtggcaaagctaaaggtctttatggtaaatttgctgataagtttggtgacggaggtaaaaatggtatcctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggtggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaatggagataaagatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggtgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggagctagaaaaacaggattagaaaactttgctaaatctaaaggtaaaaaatctagtgacatggatgttcaattagattacctatggaaagaaatgcagtctgattatgaaagcaataatcttaaaaatgcaggttggagcaaaggtggaagcttagaacagaatacaaaagcatttgctactggatttgaacgtatgggagcaaacgaggctatgatgggtactcgtgttaacaatgctaaggaattcaagaagaaatatggaggctccggtggcggaggtggtggaggagctttatcctctacttatcaagaagctatgagtaatcctgtattaactactggttctaattatagaggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcatagtatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccccaacgataaagaaggaagacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattgcctgaagtaggttggcttattgatggtgatggagataatgaagtaaaatttactggtagctcagctcatgaagtaatgactggcattatacgtagatttataccttatatgaaatataactatactgaaaaaacatataatacaattgataactatcttgattatgatgatttaagtagttgggatgagtttgaaaaacttacagaagtttcagcctttactaattttgacgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttccaaaccacaattccatcctgaattaactgatagatacggttataccaaatttgaagtagaaaatatttatcttagtacaaaatcaggttcagccactgaggattcagattcttcaggtgatgataatggtacagaacgaggaacttactctaaaattatgaaagatttaagtaactatggaagagataatatatctaaaggtatagataagtatacaagtaaattatcttcaaaatataaaaacttaaaaaaagcccaagctaaaaaaattatagagaagtttgtcaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttgttagatgaatatattaaatacaaaggagaaccgcctaatgatgaggcttttgataaatatcttaaagctattgaaggtgttagtaacgtagctacagacacaggttcagatgcaagtgatagccctctagttatgttttctagaatgttatttaattggtatcatggtaaccctaacttctatgcaggagatattattgttttaggagaccctaagtatgacctaggtaaaagattatttattgaggataagcaacgaggagacacatgggagttctatattgaatctgtagaacataaattcgattataaacaagggtattatacaactgtaggagtaactagaggtttaaaagacgctattctagaagatggtaaaggtagtcctcatagatttgcaggattatggaatcaatcatcagacttcatgggaggtcttatgggtgaagatacttctaaagaacttaaagaaaaaggtgtagcagagaaacaaagtagtggaggtaaagatggtggttctgatagtggcggagctcaagatggtggctctttagattcacttaaaaaatataacggcaaacttcctaaacatgacccaagttttgttcaacctggtaaccgacattataagtatcagtgtacatggtatgcttataatagaagaggtcaattaggcattcctgtgcctttatggggggacgccgccgactggataggcggtgctaaaggagcaggttatggtgtaggtagaacacctaaacaaggtgcttgtgttatatggcaaagaggagttcaaggaggtagcccacaatatggtcacgtagcttttgtagagaaagtattagatggaggtaaaaaaatatttatctctgaacataactatgctacccctaatggatatggtactagaacaatagatatgagttcagccataggtaagaatgctcaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccctacgttggagtaatacaaagtcttaaccctcaacatgtgcagtatgaatcattttctaataatggttatgatatagaggcagaattaagtttcaggaaagtaagttatttagttgataaagggtctatacctacagattctttatctactttaacagttcacttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcataccctatgaatattaattacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcagatgatttaaatgtaaaaggattagttttagctacagttagtaaaattaattataaatatcaatcagtagaagttaaagttaacaacttaactctaggaagccgtataggtgacgatggtagcttagctgtaccttatcctaaatctttcataggaagaacacctgaaggaagcgtattcggtacaaaacctcttattactgaaggttctgtagtattaataggatttctaaatgatgatataaatagtcctattattttaagtgtttatggtgataatgaacaaaataaaatgattaataccaatcctttagatgggggtaagtttgatacagaaagtgtctataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggcgttttttatgatgatggcacgccggataatcatataactactttatttatatctgaaagaggggatataagagcctcagttttaaatacagaaacacagaaaagaaccacacaggaaatgtcaagtgatgggtcttatagggttataaaacaagatgacgatttaatgttggatgaagctcaagtttggattgagtatggtattagtgaagataataaattctatattaaaaatgacaagcataaatttgaatttactgatgagggaatttatatagatgataagcctatgttagaaaacttagatgagagtatagcagaggctatgaagaatttgaatgaaatacaaaaagaactcgatgatataaattaccttctcgagggtgtaggtaaggataacttagaagaattaatagagtctacaaaagagtctatagaagcttctaaaaaagcaacttcagatgtcaatagacttacaactcagatagcagaagttagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatatcagatagaggagaacatataggtgctatgatacagttagaggaaaatgtcactgtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattagatttacaattaacaaaagataataagttattgtgtatgcatgattctactatagacagaacaacaacaggaacaggtaaggtaggagatatgaccttatcttatatacaaactaactttacatccctcaatggtgagccgataccatctcttgatgatgtactaaatcattttggaacaaaagttaaatattatatagaaactaaacgtccgtttgatgctaatatggataaagaattattaactcaattaaaagcaaaaggattaataggaataggttcagagagattccaagtaattattcaatcatttgctagagaatcgttaattaatattcataatcaattctctaatatacctttagcttacttaacaagtacattctctgaaagtgaaatggatgattgtttaagttatggttcttatgctattgcgcctaaatatacaactataactaaagaattagtagatttagctcatagtaaagggcttaaagtccacgcatggacggtaaatacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgtttccctaaagaaggcggtggttatgatatgtatagatttaaagttaaccctgagaactacacaatagattcaccacaacgtacgacagcaattaaaacaaaatcagatatcgtaatagaagattatggtaaagatatagaagttattaacttcacaggtacaactggttttagacctgttagagaagcagatgggttaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaactactgaagagtttggtaatgttaaacctaatgcttctcaaagagtagatgaaggtataaaagaattagataaaaatgctcgtaaaacgagagatagaaacaatcaagaaatatctagaagagaaaatacaatacctaaatccacaggagataatacgaacgagggtaatagacttaagcaaagcttccctagtagttctatatataatcctagacaatctactaatggattaaaaggtaatattgacaatatggctctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagttacaattaagtgaattagcaaaaaaagtattgacaaatataaagacagatgatatacctgtattagaaagggaatttaatgataatacaattatccataaagctaacgatacattactaaaagtacaggctccaagaatgtatatgattctacagtctattgtacttgaagcatatgctattgttaattgctttgtagaaaatccaagttctttaaaatacttaactgaagaagatgttagtataacacgagaaaacttaaattatgtagctgactacttaggtaactatgatgactacaatagtgttgtattagacttaagagatttagacttatgttttagtgctatagaattacaattacctctaattaaaaaggaggctaacgtataatgagatttaagaagcacgtagttcaacatgaagaaacgatgcaagcaatagcacagagatactatggtgatgttagttattggatagacctagtagagcataataatttaaagtatccctatttagtagaaactgatgaagaaaaaatgaaagacccggaacgattagcttctaccggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttccttaatgttacatcctaattacggttcagatttgcataatttatttggtcttaatatacctgaacaagctacgcttatagaaatggaagtattgagaacattaacatcagataatagagtaaaatctgctaatttaattgattggaaaatacaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttcccgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacctgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacgattaatactatagcatcaggttctagtttgattagaagtgttaataatgagtattcttttaatacaggaactaaagaagaaagtcaggaagactttaaacgtagattccactcttttgtagaatctagaggtagagcaactaataaatcagtaagatatggtgcactgcagatacctgatgtagaaggtgtttatgtttatgaagaaacagggcatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgacgtattaatatatgatgtgtcatttgataacttagatgagaacattatagtaccaccacaagggattattagagcgggagaaataaaagtagaattaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtggagaaagatgctatagaaagtaaattacaatcctctctaaagacatctacaagtgaatatttagataagtttggggattggtttggagtttatcgtaagaccgatgagaacgatgatgtttatagagcaagaattataaaatatttactcttgaaaagaggaactaataatgctataatagatgctataaaagattatttaggtagagatgatattgatgtaagtgtatatgagccctttacaaatattttttatacgaacaaatcacatttaaatggtgaagaccatttaatgggatactattatagatttgctgttattaatgtatctataggtgattattttcctgtagagattatagatgtaattaatgaattcaaacctgcaggtgtaactctatatgtcacttatgatggagcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaatcatagcttaattaatagtttagatgttttaacaggttcatctagtgtaggtagacagtatattaactatggatatgtaacatcatatgtttataatccaggtatgacatcctctgtaaaccaaataagtgctagtacagaaggtagaggtcaagaagtacctactgattactatatgtatactagtactaagaataacaatacagtagaacttagtatgcaaactacttccggtgtgtcttatttatataataactttaattttagagattatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataacttatctttctatgaaaaaaatattgggagtaatatagggtatataaaagactatctaaacagtgaattaaatatgtttactaggttagagataaatgcaggtaaaagagattcagtagatattaaagttaattacttagatttaatgttttattactatgaacgaggtatttatacaataaaaccttataaagcattaatagaaaattatttagatatatctagagagacttatgtagaagcatttaaaatagcatcattatctaatggagatattataactaaaacaggttttcagcctatagggtatttaaaactagttggtaattatgaaaatacaagacctagcacaataaatatagtagctaaagatacagataataaccctatagaatctaatgaattagatgtatataatacagtagagaatagaaatctattacaatcttataaaggtgcaaatacgatagctagagaaataacttctacaaaagagtttactgtatcaggatgggctaaagagatatactcaactaattatctttctaaagtattaaaaccaggtaaagtgtatacgttatcttttgatatagaaataacaggtaatgacctaactcttaaatcttattctgataatcatggtatatatttatacagtaatactaagggaattgttgttaatggtgttaaatctatggaacgtactataggtaacaaagtatccgtaactcaaacttttacagcccctactattactgaccatagattattaatatatactggaagatatacatctgatggtaaagcatcaactcctccagtgttctttaatacagttaaaattacggaattaaaattgtctgagggtacctctaatctagagtactcacctgctccggaagataaacctaacgtaatagaaaaaggaattaaatttaataatatcctaactaatatacagactttaagtattaattcggatactatcttaaaaaatgtaactttatattattcttactatggtgataattgggtagaactaaagactctaggaaatattagtactggagaaacaacagaaaccaataacttaatagatttatatggattacagacagtagattattctaatataaatccaatgtctaaagtatcattacgttccatttggaatgttaaactaggtgaattgaacaatcaagaaggttctttatctaatatgcctaatgattactttaatgctgtatggcaggatatagataaattatcagatattgagataggttctatgagaatggttaaagacactgagggtggagtattcgatggagctacaggtgaaattattaaggctactctatttaatgtcggttcttatactgatttagacatgttagcttatactttgactaactatactgaaccgttaactttaggctctagtcgattaataagtgagttaaaagaagaacttctaacatcagaatcatttaatgttgataatagaattaaagtaattgactcaatatatgaggagttaccaaatacaagcattattaaaaatggatttgttgaaagagaggttacaggctctaaatatttagattatggtttatatgagcctatagaagatggtactagatataaacttattgtcgaaggagaatttaaagataatatagaatttatatatttatacaattctaaccctaactttaatgaaacatttatatatccatcagagataattaatggagttgctgaaaaagaatttattgcaaaaccatccaccgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatacaaaaaagctactaaagttactttagttagaccttctaaatcacctgaagatgataataagaatttaatttcttatggtaataaatcatgggtagaagtaacacctgaaaatgctaaagctgaaggagctaaatgggtttacttagaaagtagtattgttggtgacgaactgcctcttggaacatatagacaggtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacagtcaggacttggattcacattgtctgaagataatgtattgacagtaaatcctggttatgtatatatcaacggtaaaataagatattacgataatgacgattcagttaaaataactggcgtaggtaaagaaactatcggtattaagttaacagaacgtattgttacacctgatgaagatgctagtctattagaccaaactagtggagtaccaagttacttctctaaaggtgcagatagattagaagaaaagatgtcattaacagttaatgaccctacatcagcaactatttatactttcatggatggagatttatatattcaatcaactaatgctgaaatggataaaatcaataaagtattagctgaacgtacttatgatgagtcaggttcatataaagtaaatggttttgagttattctcagaaggtaatgctgaagatgatgaccacgtttctgtagttgtagatgcaggtaaagcttatgtaaaaggttttaaagtagataaacctgtatcaacaagaattagtgtacctaaatcttatgacttaggaacagcagaaaatgaaagtactatctttaataagtctaataattctattagtttagctaatagccctgtaaaagaaattagacgtgttacaggtcaagtacttattgaaaaagaacgagttacaagaggagcccaaggtgatgggcaagattttctttcaaataatacagcatttgaaattgtaaaagtttggactgaaacaagccctggtgttactacaaaagagtataaacaaggagaagacttcagattaacagacggtcaaacgattgattggtcacctcaaggtcaagaaccttcaggaggtacttcatactacgtttcttataaatataacaaacgtatggaagccggtaaagattatgaagtaacaactcaaggtgaaggtttgagtaagaaatggtacattaacttcacaccttcaaatggtgctaaacctattgaccaaacagtagtattagtagactatacttactacttggctcgtaaagattcagtgtttattaataaatatggtgatattgcaatattacctggtgaacctaatattatgagattagttacaccaccattaaacacagaccctgagaatttacaattaggtacagttacagtattacctgattcagatgaagcagtatgtatttcatttgcaatcactagattgtctatggaagacttacagaaagttaaaacaagagtagataacttagagtataaccaagcagtaaatgctctagatgatggtgctatggaaggacagaacccactaacattacgttcagtatttagtgaagggttcattagtcttgacaaagcagatattacacatcctgacttcggaattgtatttagttttgaagatgcagaagctactttggcttatacagaagcagttaaccaacctaagattattccaggagatacaacagctcatatttggggtagattaatttcagcaccatttactgaggaacgtacaatctatcaaggtcaagcatcagaaacattaaatgttaacccttataatattcctaacaaacaaggtgtgttaaagttaacacctagtgaggataactggattgatactgaaaatgttacaatcactgaacaaaaaactaaaaaagtaactatgaaacgattttggagacataatgagagttactatggtgagactgagcattacttgtattctaacttacagttagatgcaggacaaaagtggaaaggtgaaacttacgcttatgatagagagcatggacgtactggtactttattagaatcaggaggacaacgtactctagaagaaatgattgaattcattagaatcagagatgtatccttcgaagttaaaggactaaaccctaatgataataacttatatttattatttgatggggtaagatgcgctataacacctgcaactggttatagaaaaggctctgaagatggtacgataatgacagatgctaaaggaacagctaaaggtaaatttactattcctgcaggtattcgttgtggtaaccgagaagttacacttaagaatgctaactctacaagtgctacaacttacacagcccaaggacgtaaaaaaaccgttcaagatattattatcagaactcgtgtaacagtaaacttagtagacccattagcacaatcattccaatatgatgagaacagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggaatacgctattgttattattactgagaacagtgattatacaatgtgggtaggtactagaactaagcctaagattgataaacctaatgaggttatctcaggtaacccataccttcaaggtgtattattcagttcatcaaatgcatcaacatggactcctcatcaaaactctgaccttaaatttggtatttatacttctaaatttaatgagacagcaacaattgaattcgaaccaattaaagatgtatcggcagatagaatagttcttatgtctacgtacttaactcctgagagaacaggatgtacatgggaaatgaaattaattctagatgatatggcatcttctacaacattcgaccaattaaaatgggagcctatcggtaactaccaagatttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaagaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacaaatatcacaacccgactttaataatattttagcatctatacctgatagtggtaactactatgtaactaattcaaaaggtgctcctagtggagaagctacggcaggatttgtaagattggataaacgaaatgtaaattattataaaatttactattcaccatatagtagtaataaaatgtatatcaagacttatgctaatggtactgtatatgattggattagttttaaattagatgaaggtaacttatacaatgaaggtaatactttaaatgtaaaggaacttactgaatctacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctaatacgtaccctttagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacatttacgatacctgaaaatacaatcggagcatcaggcgttaaagttaattacgtatctttactactaagaatgaattgttcatctagtaaaggtaatggtgctgtagtatactatgccttacctaaattagaaaaatcacctaaagttacaccatttattacacatgaaaatgatgttcgtaaatatgatgagatttggtctaattggcaagaagttattagtaaagatgaattaaaaggtcactctcctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccctacagagctaataagtttgttaaattattgtttactgacacagaaggtataccttatacattatactacggagggtataatcaaggttggaaactcttaaagcaatcagaaacttctactttactatgggaaggtactttagattttgggtctacggaagctgttaacttaaatgactcattagataattatgatttaattgaggtaacttattggactcgttcagcaggacatttttctacaaaaagattagatataaaaaatacatcaaatttactgtatattagagactttaatatttcaaatgatagtacaggttctagtgtagacttttttgaagggtattgcactttccctactagagcatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaactatggctgttaaatatgatataggtaataatgagatagtattacacttaagagaaggtaaatatataacagggtttacaacagtaggagggtatgacaaggagttagggcaagtaaaagttaatagagaaatcttacctgcttacttctttgataattttgcctatgaaagatatttgtattatagtaaacctgaagaggttatagaaaataaaaactatgtaccaccacaaatcaatgatgatgaggaatcccaacaaattactgtacctaaagaacaatatgatagtttaaaagaagagctagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcagggaactctagttcagaatggcaatttattcaaggattacctagtaataaaaatgctgttatatcgggcactaatattctagatatagcttcaccaggtgtttactttgttatgggaatgacaggaggaatgcctagtggagtaagctccggatttttagacttaagtgtagatgctaatgataatagattagctagactaactgatgctgaaactggtaaagaatatactagcattaagaaacctacaggaacatacacatcttggaaaaaagaatttgagccaaaagatatggagaaatatttactaagtagtatcagagacgatggtagtgcatcattcccactcctagtttatactagtgataataaaacgtttcaacaagctattatagaccatatagatagaacaggtcaaacaacctttactttctacgttcaaggtggtgtatcaggttcccctatgtctaatagttgtcgaggtctattcatgtcagatacacctaacacttctagtttacatggtgtctataatgctataggtacagatggtagaaatgtaacaggttcagtggtaggaggtaattggacttcaccaaagacatcaccttcccataaagaattatggacgggagcacaatcattcctatctgtaggtactactaagaatctagcagatgatattagtaattactcttatgtagaggtttatactaaacataagacagtagagaagactaaaggtaatgatgactcgggtacaatttgccacaagttctacttagatggtagcggtacttacgtttgctcaggaacttttgtttcaggagatagaacagatacaaaaccacctgttacagagttctatagagtaggtgtatctttcaaaggttcaacatggacgcttgtagatagtgcagtacaaaatagtaaaactcaatacgttacaagaattataggtattaatatgccatagactaggataagtttcctagtctttttttcttgacttgaaaaggattctatggtatactataactcgtgtaaggatataaggagattaaaatgagattaagaattaagaacttatatacctatgtagaatttgaggaggatgataaatacttaaaagatatatttttaaagagagtccatactactataggagcaaggcaagaaggttttcaatatagccctgcgtacaaaagaggtagttgggatggttatgtagacttttatgtttatgaggaagataaattccctactggacttttatttaaaattgagttattattaggtgagttacaatcaaggtataacttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaactattacctcaattagaaaaaggtgaaagagtagcgttcttcacaggctctacggagatatttcatcagtctgcggatagactacaagaacgtttaaatattcctattggtaaagtaggtgcaggtaaatttgatgttaaacaggttacagttgtaatgatacctactttaaatgcaaaccttaaagacccaacacaaggggtaaaggttacacctaaacaaaatattagtaaaaagattgctcaagagatattacctaaatttgaaggtggaacaaatcaaaagaaattactaaaagtattacttgataacacaacacctaaaacaaaagtagaacaaaacgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatctaatgacatgtgaaaaagctttatatcgaattgcattaacagggtctatagataaaaaagatgaattactttggatgagattacaggctctatttggtaatgttattgcacgaactactaataagtttttaattgatgaaggtcattctgctagaccaacaataaatattatacctatagctaatcctaatgacatagatagaattgatgattatagggaagcttacgatagaggtataacaaataatgattttagaaataaacttattgcaaaactaacagaaaagtggtataatcaagataaaggtacattgattattgtaaacttcattgaacatggagacacgatatcagaaatgttaaatgatttagatgtagagcactacttcttacatggagaaatagactctgaaactaggagagaaaaattaaatgatatgagaagtggtaagcttaaagtaatgatagctacatcacttattgatgagggtgtagatatatccggtattaatgcactaatattaggtgcaggaggtaagtcattaagacaaacattacaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggagtaataataactttagttagagagtatgatacagaagaattgaaagaatttaataattctacagataatattattacttccgatttacagtatgctaaggcattaagagaaaagcacttcccttcttatagatatgagagaaaagaacaacgtagacgtactaaaatagaaatggcacaatacaatgccattaaggatgagaagagaagaattatagcagatatgaacttctattcagaaggtcttccttatccttctaaagatatttttaatatgtcttatgacccggaagggttttataaagcatacatcttatgtaagttatacgaccaatatgctatttctcatatggatgctaaacatacaagtcatcttaaagcaatgagtaaggcaacaactaaagatgaatatgactatcatcaacatatgtctgaatactatagaaataaaatgattcaaaatttacctagaaatagcgttagtgataatttctttggtagtaaaatgtttaataccttttataatttttatttaaaaataaaagataaaaatattaatgtatttaaatatatgcaaaacgtatttaaaaatgtaacattttattatgagaatggtatgcaacctaatccaataccttctcctaacttctttagttcagataagtattttaaaaactataataattatattaaaggaataaaaaaaggtgttaacagtacgaatagacacctaggtgatacagacagcatcattaattcatcagactacgtgaaaaaccctgctgtattacatctacaccaactatatactacaggattaaattctactttacatgatattgatactatgtttgaacaagccttagaccttgaaaatgcctcctatggactatttggagatatgaaacatattattttactacagtataattctatgattgaagaagaaattaagaatttacctagagaagaaaaggatattattaataaatatgtaaaacaatgcataattaatgattattcaccaacaagtatttcaccatctgcaaggttatcaatgtttactatgcagaaagagcatatagtttacaataagcagttaaataagggaatcaagagagaggatttattaccattaagtctaggaggtatagtgaataaagattcattgagtggtatggatatacaaaacttagaacagaatggtaatgaatacctgtatatgagacaacatacttcaacttattatatattaagaatgtttggtgactatttaggatatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggagagtttattgacttctttgaagatacagaaaagaaacaagaactattgagtaatttagctacaaataaattctctactggatttacttctattgacaaccatattgaaggtggtatagcaagaggagaagttggattaattatagctcctactggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagagcaaattattgttaatacaacaattaagaaggataaaaatattgatgttgttattattgactatcctcacttaatgagaaatccttatgctaaatatcattcagaatcagatgcaggaggaaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagtggtttcttaagattatatttagataaaattcgtaatagctccaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagtcattttcacctatttactaactacgctaaacctgataatgaatttgtgaatgatagatttaaagaacagatagaagcattacagaaagtttttgatattgctaaaaaagaagaagcaacagttatatttggtggagatttatttcataaacgtaactcggtagatactagagtatacaacaaagtatttagtacatttgccaaaaatgatgaggttcctgtattattacttagaggtaatcatgatgctacaactaattcattatatactgattcaagtatagatacatttgagtatctacctaatgtaagtgtaataaaatcattaaatacaattttaaaagataatgttaatattgtgtttactgcttatggggatgagacgaaggaaataaagacatacattaatagtaattacgataaagatatggtcaatatactagtaggtcacttaggtgtagaaggttcattaactggaaaaggctctcatagattagaaggggcatttggataccaggatttattacctgataaatatgatttcattttactaggtcattatcaccgtagacagtatttccaaaatccgaatcatttttatggtggctcattaatgcaacaatcattttctgatgaacaagaagctaatggtgttcatttaatagatacagaaaaaatgactacagaattcatcccaattcatacacgtagatttattactattcaaggagaagatattcctgagaactttgaacagttaatcgaggaaggtaattttattagggttatcggtacagcaaatcatgctaaggttttagaaatggatgacagtatgaaagataagaatgttgaagttcaaattaaaaaagaatatactgtagagaaacgtattgatagtgatgtatctgatgaccctttaacaattgctagtacctatgctaaacaatactcacctgaatcagaacaagaaatacttgagtgtttgaaggaggttttataatgaaaaaatatagagaatacctaaataagacagatgcagaaaatttagcagaggattgggagaaagtaaccgaagatttatggaaagtgtttaaagatatgaaacctaaaattaatacattagatattagtaatgtagaaagtaaaaacttagataaaagtaaacctatactacaattccaagattcagatggagtaatagagaatatttgtaatgttgagggtttagaagatggtttaagtaaaatgaaaaaggtttttgatgatagtaactttgaaaagcattattatagtagagtcgtagaccatgatgagtattactggattgattatggttctcatcattgtttctttagagttacgaaaggggataagtaatggttgtatttaaacaagtagaagttaataattttttagcaattaaagaagctacgctagagttagacaatagaggattaattctaattgaaggtgagaataaatccaatgagtcatttcattcaaacggttcaggaaaatcaactttaatatctgccattacttacgctttatatggtaaaactgaaaaaggactaaaagcagacgatgtagtaaataatattgagaagaaaaatacatctgttaaacttaagtttgatattggggaagatagctatttaattgaacgttatcgtaaggacaaagagaataagaataaagtaaaattatttgttaatgaaaaagagattacaggttcaacaaatgacgttactgataaacaaatacaagacttatttggtattgagtttaatacttacgttaatgctatcatgtatggtcaaggagatatccctatgttctcccaagcaacagataaaggtaagaaagaaattcttgaatctattactaagacagatgtatataaacaagcgcaagatgtagcaaaagagaaagttaaagaagtagaagaacaacaaaataacataagacaggaaatctataaactaggttatcagttatctacaaaagatgagtacttccaaagagaaatagaacagtacaaccagtataaagaacaattggttcagatagaaaacagtaataaggaaaaagatagattaagagaacaagaggagaagcaaatagaagctcaaatagagcaattagcttcacagataccaacaatacctgaagatgaatttaagcactcagaggagtataataaagcttctcaaagcctagatttactttctaataaattaacggagctaaatcaagtatactcagaatataataccaaagaacaagtactaaaatctgaaatagctacattaagcaatagtctaaataagttagatacaaatgaccattgtcctgtttgtggctcccctatagataattctcataaattaaaagaacaggaaaatattaataatcagattgagaataagaaacaagagattactagtgtattagaaatgaaagatacgtataaagaagctattgataaagtaaaagataaatcacaagaaattaaagataaaatgtcacaggaagaccaacaagaacgggagcacaataataagattaacagtataattcaagaggcttctaggattaaatcagacattagctcattagagaataataaaacttatttaaaagtgaaataccaacatcaatctgttcaaggattagagagagaagaaccaagtaaagaaaaacatgaggaagataaaaaagaattacaagaatctattgacaaacatgaagagaatatagtacaattagaaactaagaaaggtaaatatcaacaagctgtagatgcttttagtaataaaggtatacgttcagtagtgttagactttattacaccattcttaaatgagaaagcaaatgagtaccttcaaactttatcaggttcagatattgaaatagagttccaaactcaagtgaagaatgctaaaggagaactaaaagataagtttgatgttattgttaagaatagcaagggtggaggctcatacaaatctaattcagcaggagaacaaaaacgtattgatttagcaattagttttgcaattcaggatttaattatgagtaaagatgagatatctacgaacattgcactttacgatgagtgttttgatgggttagatactatcggttgtgaaaacgtgattaaattattaaaagatagacttaatacagtaggaacgatatttgtaattactcataataccgaacttaaaccactatttgaacaaacaattaaaatagtaaaagaaaatggagtatcaaaactggaggaaaaataatgaaattaaagattttagataaagataatgcaacacttaatgtgtttcatcgtaataaggagcacaaaacgatagataatgtaccaactgctaacttagttgattggtaccctctaagtaatgcttatgaatacaagttaagtagaaatggagaatatttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctgttataacagaagaatatgatgctaatactgtagagcaaggatttagagatattggagttatattccaaagtcttaaaactattgttgttactagatatctagaaggtaaaacagaggaagaattaagaatatttaacatgaaatcagaggaatcacaattgaatgaagcacttaaagagagtgatttttctgtagacttaacttatagtgatttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaatcctattacatttatgaagacttattataacattacaggtaagcaagcttttgatttattagagtctaagaatatagatatagagagagcccctttacttacaaccaataataaggatttaacagaatcagagaaacttatattaatgcttagaggtgtgcatcaagataagggaactactagtattaaacctcctcgattacctgaaggatataaattattaaaagataacttaaataataaagagattataccttttttaaaatacttaaaaggtagaggtataactttagaacaaatcattaataacaatataggttatgttattaatgggagcttttataaagttgacggggaatccaaagtatcattaaggaatagtattatattttttacttatgataatgatggaaactaccagtactggaatacaagaagtatagagaagaacccttatattaaatctattaatgctcctgctaaacaagatgaagtaggtagaaaagatgtcatatttaatttgaatatagcaagaaagaaaaagttcttagttataactgagggtgtatttgatgctttaacctttcatgagtatggagtagcaacattaggtaaacaagtaactgagaatcaaataaaaaaaataattgattatgttagtatagatacatcaatatatattatgttagacactgatgcattagataataatatagacttagcttataagttaaaaacacattttaacaaagtttactttgtaccacatggtgatgaagatgcaaatgatatgggaacaaggaaagcttttgagttattaaaacagaaccgggtgttagtaacacctgaaagtatacagagttacaaaatacaacaaaaacttaaactttaggcttgaccttagagaagttttatgttatactagtaattaagtaattaataaaggagaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagtccttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaggcacaaaaagaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtaccccaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttataatgaaaaagtatatgaagatttaagaaataatgaataccctgtcatgagaacagattttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggcacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaaggttcctgacactattattgatgagatgactaagttagcttacagttttaattttaaattccctagtttcatggcaggacaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataataactcaggtcaagctaatagaggtgaactaagctcatgttatctatttgtagtagatgattcaattgagtctttaaactttgttgaggatagcgtagctaatgctagttctaatggtggcggagttgcaattgatttaactagaattagacctaaaggagctccagtacgtaatagacctaattcaagtaaaggtgttattgcttttgctaaagctattgaacataaagttagtatttatgaccagggcggtgtaagacaaggtagtggtgctgtttacctaaatatattccacaatgatatcttggatttattaagctctaagaaaatcaatgccagtgaatctgttagactagataaattatctattggtgttacaatccctaacaaatttatggagttagttaaagaaggtagacctttctatacttttgatacttacgacattaataaagtgtatggtaagtatttagatgagctaaacattgatgaatggtatgataagttactagataatgatagtatcggtaaagtaaaacatgatgctagagaagttatgacagatattgctaaaacgcaattagaatcaggatacccttatgtattctatattgataatgctaatgataatcatccattgaaaaacctaggtaaagttaaaatgagtaacttatgtacagaaatttcacaattacaagaggtatcagaaatttatccgtactcttacagtaataagaatgttattaatagagatgttgtttgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagagaagcattagacctagtaaacagtttatatagtgctattaacttccagtctattaagacatctatgttaatggctaaagaaacaggaaaaccatttaaaggatttgagaagtccgattacgctacaggtgaatactttgtaagatatattagagaatccaatcaacctaagacagataaagctaagaaagtcctagataaggtttatattccaacacaagatgattgggatgaattagctaaagcagtaaaagtacatggcttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtatctacaatcctttatgtagagtcagaaatacctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatttcccaattttggactcctgaagagtttgatgtatcaagagatttaagttcttggaatagtttaactgaaagtgaaaagaacacttataagaaagtccttgcagggctcacagggctcgataccaagcaaggaggagaaggtatgaacttagtatcctaccacgaaccaagacctaaataccaagctgtatttgcgtttatgggtggtatggaagagatacatgctaaatcctatagtcatatctttacaacattactaagtaataaagaaacaagctatctattagatacttgggtcgaagaaaacgactttttaaaagtaaaagctcagtttatcggatattactatgaccaactattaaaacctaaccctactgtatttgatagatacatggctaaagtagctagtgcctttttagaaagtgcactattctactcaggattttattatcctttacttcttgcagggagaggacagatgacacaatcaggagctattatttataaaattactcaagatgaagcttaccatggttcagcagtaggattaacagctcaatatgattataatcttctaacagaagaagagaaaaaacaagcagataaagaaacttatgaattattagatattctttacactaatgaagtagcgtatacacatagtctatatgacccattagaattaagtgaagacgtaattaactacgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatattaaagatattaaagatgaagatttttcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaagtcttttcagttagagtttatgcatgatatgaccatgtatactttatcttatggctcaggacagttaaaacttattgatttagcagaaggttatgaagcacaaaaagctacagtagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattggatataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtcacacatggtaatgaagaagaaattgaaaagaatatggatgaattaatatctaagtctagacgatatatcatgagagatgaaaatcattacatgttatttaatgaaaagtacaataatgatagacttatagaaaaagtatgtaaacacggtggcaaagttacatactatactgattcagtattaccctattatgttttaaaagacttatctagtcaccctgactcagaagtcgtttatcgtatgcgcaatggttttactgcaaaagaagtagataatatagctttgtcatttatgggtacaaaagttattattgatatttctgtagtatttccttatgtaaacccttatgatattattagaagtttacatgatattaaaacaaatgtagatgaagttcatttatcatttccacgaatattagaagtagatgaaaaacaagaaaaattttatttctttgatggtgaagcttatgatttaaaacctgagtataaagtagattttgcggataaaattagagtatctttatcagtatggaaaatgtatatctatatcttaacaagtagtcgtgattttgaggatgtagacaatgtaattacgaaactaaaacaacaacgaaagattaagatataaggtgattatatgagtacagcaaatagaagagatatagcaagaaagatatcagagaatacaggttactatatccaggatgtagaggaaatactaagtgcagagacagatgctatttctgacttactagaagaaggatatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaatggaaaaacacttaagaaattacttgagaagtgttctaatttaaagagagataaaacaaacagagattatgatattgattttctctacaatgcagtacctacacctatcagaaatgactatggtaaaattattaaatatcaagatgttaaacaagcagaagtaaagccatactatgagagaatgaataatattattattgataattcttatgatatgataattcctgtaggtaaactaggcgttaaatacttattaaatgttacagctattggtaaagtaagaggtgtaccaagtaaagtaactattgaaaatggaacatcttctcatgacgtgtgggtattacctacttacagtattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggcgtagatattaccgcatgggacttagagactaactcattaaaacctgataaagaaggaagtaaacctttagtactatctctatcatggagaaatggtcaaggtgtaactatacctttatacaaatcagactttaactgggaaaacggtcaagatgatattgatgaagtcttagaattacttaagaactggttagctagtaaagaagatattaaagtagcacataatggtaagtacgatattaaattcttgatgagtactgagaactttaaagattttgagagtattcaagatactaaagtaggttggtacctagctgttacccaagaagttaaagaatctttaagattatctgatttagcttatgaggttacagatgtcggaggttatgataaaccattagaagattttaaattatggtttgttactaagttattaagattcttctcagataaaattaaagagatacagaaagaaaataaaaagattgctaagaaggagtatgatgttaaagctcccgaatataaagaatggctagagaataaactaaatgaaacagtagtagaactagatgatactgagaagaaatttagagttagtgaattagagaaaaagtatattcaactaggtctttcacctgaaattgtaaatatgaatttagttatgaataacgatgagttcataagtattgcagaacaatcacctgagtacatggggttatctgactatgctaagtcttacacattaaatactgcaattaatttaattaatgagtatagagatgtaaaagatgtagttaatgatattgatggaggtaactttaattatgattggttccctattgaattaatgcatccatacgcatcaggagatactgatgtatgtagaagaattcattgtgatgtagttaagaaacttaaagaacaagatagacctaaatcaatgcatttattagaagttaattacccaagacttactaagtctttagctagaattgaatcaaatggtttatattgtgacttagattatatgaaagaaaatgatgagtcatacgagtctgagatggctaaaaatcatgctacaatgagagagcactgggctgttaaagaatttgaagaataccaatacaatctttaccaaatggcgttagaagaacatgagaaaaagccaaaagatagagataaagatatccatcagtatagagataaatttaaagatggtaaatggatgttttccccaagttccggagaccataaaggtagagtaatttatgatattttaggaattcaattaccttatgataaagaatatgttaaggaaaaaccatttaatgctaatgttaaagaagcagaccttacttggcaggactataaaacagacaagaaagctattggttatgcgttagataatttagaattaaaagatgatgttagagaacttcttgagttacttaaatatcatgctagtatgcagacaaaacgtaattcatttactaagaaattacctaatatgattaataaacaaaaacgaacattacatggttctttttctgagacaggtacagagacatcaagactaagtagtagtaaccctaacttgcaaaacttaccggcacacacatcagatgtaaacaagtttgattacaaacatccaattaaacgttcatttgtttctagatttgaaaatggagtactactgggagccgactatagcgccctagagatgcgtattattggattatttactaaagaccctgatatgctacaatcattcttaaatggggaagatattcataaggctactgcaagtattgtttataataaaccagtagaagaggtaactaaggaagaacgacaagcaactaaagcagttaacttcgggttagccttcggtgaatcacccttctcatttgcaggtaaaaataatatggaagtaagtgaagcagaagaaatatttgaaaagtacttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactattatccaaggttcaggcagtttcttaacaaacatgtctttaacttacttagatgattttatccaatctcgtaacttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagctgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttaccaagaaatttaataaaagtattgacaatacatttaacttatgttatactatataggtaataaatataaggaggaaaacagagtgaatacaggagagattagatttaatcgttctatggatgaatggattataacaagtatgtaccaggatgagctaggtgagatgaatattgttgttacattctataatagagaagaaaataaacatggttctacagttttaccaacagagtcatctactggagaagtagcagaggaattggcaagtcttgaagaagaatatcctctagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggactttatgcaacaatcagctaaatatgctttttgggcttctatattagagaaggtaagagcatattctgaaatggaacaaagaaatctagaaacaattggtagtaagctaaaccttacaattagacaagagtacgaacaacaaggtaaaaagcctactaaagatatgattgaatctagtgtttatattcatgattcttaccaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcaaggattcacaggattaacattacctgcagaagaaggttcatctgtccttgacccgtacattcaggactggataacaaatggtgttcaatttagtagattccctaataaaccaggagtacgctattacattcatgtgattgaatactttaataacaatggtcaaattcaaccaaaaacggatgctcaaggaaatgtaatgattcaacctatggaattatctaacacaggatataaagaattattagctaacttaaaagatactatgttaaaaccatcacctaatgcacctcatagctttatctcagcaaatgaagcattcttagttaatattgttaaagctaagaaaggtgaaatgtcatggaaagtaagtgtttatcctaatgctcctttaggtgcgttaccgcaaggttgggaacaacaattatctgacctagaccaattagcaaaaccaacagaagaacaaaatcctaattttgttaacttcttaatcaataatgttaataacacagagttaagtcatgataactttaaatttaaccgtgaaacaaatgtcttaggtgaagaaccttcagagcctaaacaagcacctacgcaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacacgcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaccaaactacacaagagcctccaaaacaaaaacaaacacaaagtattgacgatgtattaggtggtctagacttagataacctataagatatagagtgccttagagcactcttttatttaagatatataattactaggaggatattaaatggcaagagcaaaaaaaggtaaagaagtagatttaacagatttaaatacaattgatttaggtaaagaattaggattaacattattatcggatagcaatagagcagacattaaaaatattgtacctactatggttcctcagtatgatagaattctaggaggaggcatcccattaggtagattgacagaggtttacggattaacaggttcaggtaaatcaagttttgcagtccatctctctagaatttcaacacagttaggtgttataactatttggattgatattgaaggtactgcggacaataatcgtatggaacagcttggcgtagatgtttcaaaactattctctattcaggcaggtgaaggtagacttaaaaatacagtagagttatctgtagagactgtaggtaaggaattagattactggatagatactttcaacgagaaagcccctggagtacctattttatttatttgggattcattaggagcaacaagaactcaagcggagattgaagaaggagtagaccataggaaattagggacaaaagccacagctactcaaaaagttatcaacgcagtatctcctaaattaaatgatacaaatacaggattaattgttattaatcaagctagagataacttgaatatgtctaacccttatgatgaccctattaagtccacaggagggcgtgcgttcgagcatggagccagtctaagacttaaaattactaaaggtaaagagtccgaccttaaacaatctgattcaatgacaggtaaacctacctataaaggtcatgtgatgagagtagagactaaaaaatctaaactatctagaccaggacaaaaagcagaagcagacttactatcaggatatgaggtaggttctggttcggatattacccaactaaatggaattgacccttaccatactatctataaggaagcagttgaaagaggtctaattacgaaagggacttggagaaattatatcacacttaatggggaggaaattaaactttatgataaagattgggttcctcgtttaatagatgaccatgagttatacttggaattatttagtagagtctatggagaacatttccctaatggttattcaccattacttaatactaaagtaattgtaactcagttagaagaatatcaagcattagagaattactatgaagagtgggctaaagataataaacaagaagaacaagaggaagaatcaaaaggagaatctcaagaaaaggattctgaataatagatgtataatttaatagataaaaacatgagacaggtaaaagaatctttggggaatgcaaattcctcagatgttcttcctttaccttataaagacatagcaaagaaatttgaagaagtaaaagaaaaaggtgaatcaattatcattgaagagggtggattcccttacacagattctacagtgatgtatatagaacatgtaacagatagatgggcaggaggatactccctaattaggcatgaaggtgaagaggttaaagtacctaaaactatccatttctctgatatatatgttaaggataaatcacataaagtaagaataatcttcgagggggctaatccttatgaagaaggctaaaaatggtaatagatatgtaatagatatagatggtattcctgttgattttgaaagagacttggatagtttacttaacaggtataaaaaccttaggtggtcattatatcataagtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattattggtaaaaaagattatacagtagagtccttaacagaagatttaaatgaagacttcgaggataatcaaattatgagttacgtatttgatgatatagaatttacagaagttcaaagtgagttacttaaagaattacttattaatcctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatataagtactactaataatattattagtagtacttttgatatattatttatgtagaagagaagtgaaaatagtgagaatagaaaagcataaaataaagaataataaagtaattaatgaaatgtctataacagcaaataacctctataatcatgctaattttattttaagacaaaatttctttaataataagactaataaaggatacagaaagtttttaaattataatactattcatagaatattaaaaaatatgaatgaagagaattatattaaactcccaagacaaacatctcaacaagtattaagggatttaattaataactggtctagttttagaaaatcagaaaaagattattttaaaaaccctaataaatacagaaatagaccaaaaccacctaaatataaagctaaaggcggtaaaggaacaattaagtttactaatcaacaatgtagaattcataaaaaagatggtttaatacatttacctacacctttacaagatataactataaaaccttataaagctaagaatataagagaacttgtttgtattcctaaaagtgattattttgaagttttagtatgttataaagaagaaaatagtaataaaacactaaatgataacgaaaacatagcaagtattgatttaggtttagataacttgataaccatggtttctattgtagataaaccaataattataaatggtaaaggtctaaaatctaaaaataaatattttaataaaaaaataaggtattatcaaagtctattacaaaacaatagttactcttcgaaaagaatattaaaatattgggaaaaaagacacaatattatactagattactttcataaagcaacaaacgaagttgttaaatactgcgtaaaaaatgatattagtaaagtagttatagggtataataaacagcaaaagtataaatctaaattaaaaaa

SEQ ID NO: 1075 - protein, 102 aa, Unknown
  Description of Unknown: Bacteriophage F125/10
FVQIPIFSLIPILRYKLEEQGIGLIETEESYTSKTSFIDNEKPIKHNVYKGKRVKRGLFKTEEGRILNADVNGAFQIMKKVFPDVEIPRDNGFVYNPFLINC

SEQ ID NO: 1076 - protein, 210 aa, Unknown
  Description of Unknown: Bacteriophage F125/10
MAKKNVNDVLQQESVTVADKYLQVKVNRDGYTRTHEGQYAYKVVSEGEELFLYPVQTDGKGTLNVMKKSPIAYTDGDNIHFVVNTVVDPYNHSFIRTEDIKGLDKGKQLIQAFLAFVEDRFKFGVYNVFVANSKEDVLSIVDPTDNDADEVKDSLEHAHEDVIADFPASPARKDVKGVDSGEGQGDTSEPSAPKNVQVTPKEDGADVSAE

SEQ ID NO: 1077 - protein, 173 aa, Unknown
  Description of Unknown: Bacteriophage F125/10
MVNLAKLNLYKGNELLNSVEKTEGKSTITIENLDANTDYPKGTFKVSFSNDSGESEKVDVPQFKTKAIKVISVTLDVDSLDLTVGDTHQLSTTITPSEASNKNVSFESDKSGVASVTSEGLIEAVSAGTANVTVTTEDGSHTDIVAVTVKEPIPEAPADVTVEPGENSADITA

SEQ ID NO: 1078 - protein, 75 aa, Unknown
  Description of Unknown: Bacteriophage F125/10
MEKTLKVYSNGEVVGSQVANNDGATTVSITGLEAGKTYAKGAFKVAFANDSGESEKVDVPEFTTKTPTEEPSGEA

SEQ ID NO: 1079 - protein, 86 aa, Unknown
  Description of Unknown: Bacteriophage F125/10
MDIPTILFRNPYDYTKVKKLMENKEQYIVVKFDSVSVHNLNVQGMMNVIQDYLHIYGYRVKEYGQENASKDDERDVKGYLYERVGE

SEQ ID NO: 1080 - protein, 251 aa, Unknown
  Description of Unknown: Bacteriophage F125/10
MGIIVNSNHIQSDTLYEYDSFFDIEKVDTFEEGLLSIQDEPTVLAGFIYDDITFNKVINSNSDIDDYIKNNDIYYVSDIGLLPDTFITVDSDKKYYSLLQQVVELSKDPFPKWVEDDAKGLTKYYNFQDFEDVFDLNSFYKKEVDMVREKCYNNGNVYLLYEVLPDYKLPLAYSLLSNKEHGIVIIGSQTRSNNDILTFYVKGMDAKAIASMFNVEHDYDSNIFHTFVNSHINILGNQITKFIREKGSSYE

SEQ ID NO: 1081 - protein, 416 aa, Unknown
  Description of Unknown: Bacteriophage F125/10
MSNYKTIEEVQAVIIGVLFKDEGKIVTSKFNKITKEFGLDRIGKDDLKEIVEDIRQDAYLNELKNKAIKGKVTLGDLKDVADNQVFEGNNYHEEVSTYVVAKEKELSHLREQRKHNRHTAYPQIMFDELKEHMVKELQGETLVEHHGSKANINDTELIVLLSDFHIGSIVSDMTNGKYDFEVLKARLNHFINTTVKEIEDREISNVTVYFVGDLVEHINMRDVNQAFETEFTLAEQISKGTRLLIDILNVLSNVVSGELRFGIIGGNHDRMQGNKNQKIYNDNIAYVVLDSLLLFQEQGLLNGVDIIDNREDIYTIRDTFGGKSIIINHGDGLKGKGNHINKFILDSHIDLLITGHVHHFSVKQEDFNRMHIVASSPMGYNNYAKELHLSKTKPSQQLLFVNKENKDIDIKTVFLD

SEQ ID NO: 1082 - protein, 122 aa, Unknown
  Description of Unknown: Bacteriophage F125/10
MDTIFIIGVAFITFATFNIVFRLFDLWTTEKKMVSQGQPPLSNFEYYHVIVPYLVGVIVITLSIIFRDSLYSAQSGFGIIITSFIYMLVYVIIGLVGSFILTIFQARKARQYQTQEDNNEVQ

SEQ ID NO: 1083 - protein, 103 aa, Unknown; identical to SEQ ID NO: 692
  Description of Unknown: Bacteriophage F125/10

SEQ ID NO: 1084 - protein, 178 aa, Unknown; identical to SEQ ID NO: 693
  Description of Unknown: Bacteriophage F125/10

SEQ ID NO: 1085 - protein, 255 aa, Unknown; identical to SEQ ID NO: 694
  Description of Unknown: Bacteriophage F125/10

SEQ ID NO: 1086 - protein, 148 aa, Unknown
  Description of Unknown: Bacteriophage F125/10
MSKDKPNRRKEIQHQPVNFAPMNTLTGANNSFFAKKPSEPKDATSVIEYRILFIKRFDNVTSTDVKLQKKYALNLISEALDVKETYLSLKQKGKKTESILHTDRVYYVHRGKKLIGKCSIREQRTFKGKHLIFIFKTRHRVKAERKDK

SEQ ID NO: 1087 - protein, 287 aa, Unknown
  Description of Unknown: Bacteriophage F125/10
MLKGFSEHVDKPTTTKTLYKTLTSGKVELLGVSYDSDYFPSGVTVQSYIEDIGNEDEGLQFVNKINVVESMKQAVVGMNNQLGSSGLGYVRTEQLKKELEETGLMTDLLARGTNLTSTKKVDIVSTFIEPEVTYQDITIAKDIKLRLYKLEEESPLNGYTHIVYLLTTEKLYDGQTLFGMLSKKDKLSKGDTDKLLAFFRNNSLISKSVFCVKLLSKDYYFNLYNTHETGIFFLEDTDVITIACGQSYVKVNTKDIKSSYVKIEDKTHKLTELVINLKGDDTLTILF

SEQ ID NO: 1088 - protein, 243 aa, Unknown
  Description of Unknown: Bacteriophage F125/10
MARKKNLRNKNSDIKVVPDKEKESILSKLYHNKLLRSKVDNALDEDMSYDDIIELCKEYDLELSKSAITRYKSKRKEAIENGWDLEELIDKRKKTSVKDIKEKETPILEEEQLSPFEQSKHHTQTIYDDIQVLDMIISKGAKGLEFVETLDPALMIRAMETKDKITGNQLKGMSFIGLRELQLKQTAQDTAMSEVLLEFIPEEKHEEVLQRLEELQNEFYKNLDLDEESRKLKEALDRVGYTI

SEQ ID NO: 1089 - protein, 152 aa, Unknown
  Description of Unknown: Bacteriophage F125/10
MADEISLNPIQDAKPIDDIVEIMTYLKDGRVLRVKQDNQGDILVRMSPGKHKFTEVSRDLDKESFYYKRHWVLYNVSVNSLITFDVYLDEEYSETTKVKYPKDTIVEYTREDQEKDVAMIKEILTDNNGNYFYALTGETMLFDENKLNKVKD

SEQ ID NO: 1090 - protein, 147 aa, Unknown; identical to SEQ ID NO: 699
  Description of Unknown: Bacteriophage F125/10

SEQ ID NO: 1091 - protein, 234 aa, Unknown
  Description of Unknown: Bacteriophage F125/10
MRNKKSFQEQLNDMRNKEKWVSEEEFTEEVAPSEEPEVEEEKLYTLNELKENLLDAQGLKDVVADFPASKDLYEPNKLYICTIPKGYQSTEVQPGQYIGISTGLLSESEDFSHLRGQMPRNLYETSHVLKPLVRINNTSIEYQQHELLEDIKEDKNVYDVELEDLRLATGEEISYLEIVDSKFFESRINEVLDFYHELTDSDDLLEYYNKLRELVGNDRMIYCPLLNKCVKIID

SEQ ID NO: 1092 - protein, 104 aa, Unknown
  Description of Unknown: Bacteriophage F125/10
MYHDKAKNEVSTELSNTGKIKEEKNVEFVGDYTLKKVEDNKAYFMETLPTYLPGRTGDNSIDMRYYKTSRFKEGVNFKLIRVYTEDGEDNPIHKYRFEAVPTKK

SEQ ID NO: 1093 - protein, 80 aa, Unknown
  Description of Unknown: Bacteriophage F125/10
MEMADLERFDAFVRLISDDELSEERILELSVDLLNPILEGGTAYRAKKRIKSKFGKLEAKNFKRNYKFLLKSIAQIDQRR

SEQ ID NO: 1094 - protein, 185 aa, Unknown
  Description of Unknown: Bacteriophage F125/10
MTEREKLIKEIEEANRDIQLQLKEVDNYKDSIRSKGTRNYISTKVLDSITVGFIVSFLILIIMRVLEYFVTGNAVYSPLAPAVIIMFVLALGTWKVSKMNKIVSYRGTIKMYWELSNAEQKQAKVFKYPNDEVDIVSKHNLRQITFSEINILHLKYMRYNKAVEQHTKLSKELFKKDKETVDKNK

SEQ ID NO: 1095 - protein, 58 aa, Unknown; identical to SEQ ID NO: 704
  Description of Unknown: Bacteriophage F125/10

SEQ ID NO: 1096 - protein, 83 aa, Unknown
  Description of Unknown: Bacteriophage F125/10
MVSKFIGVYLFNLLVVALVYTVGFLFFYGVASLVIILTHATIDPFVLATFLGIGFLVIRTAHRIMARVINDAVAQAIKDKENE

SEQ ID NO: 1097 - protein, 77 aa, Unknown; identical to SEQ ID NO: 706
  Description of Unknown: Bacteriophage F125/10

SEQ ID NO: 1098 - protein, 214 aa, Unknown
  Description of Unknown: Bacteriophage F125/10
MKVSEEVKQSYLENKANTKMDKISWSELKASPLGITLGDIIFYSVVIIDNIIAIILTLTLIGTITDSIESTLAQIIVGVFIIITIYGILSALIPILIHKAVSPGWSYTEWNESYYIRLPGEENYKYYSKWYLDLLGVKEFYYKRDSGEEVKEKNISWAFQAEVKRPEDVNHWKNQLLTNRPLTILEYKKLKKLDKESEIRKQEDLEEYKQYNSN

SEQ ID NO: 1099 - protein, 82 aa, Unknown; identical to SEQ ID NO: 709
  Description of Unknown: Bacteriophage F125/10

SEQ ID NO: 1100 - protein, 58 aa, Unknown
  Description of Unknown: Bacteriophage F125/10
MDFNDFINSESDRVGNPKQKKKVENKLPSSIPIEDREKKLKEIRKKSLYIDLRRKRND

SEQ ID NO: 1101 - protein, 98 aa, Unknown; identical to SEQ ID NO: 711
  Description of Unknown: Bacteriophage F125/10

SEQ ID NO: 1102 - protein, 60 aa, Unknown
  Description of Unknown: Bacteriophage F125/10
MLLGILWFIWGFVSYFVLMFGIEFCKDRWMPGVIGAGALLLFLFWIMKSIHNAMTVVYLY

SEQ ID NO: 1103 - protein, 122 aa, Unknown
  Description of Unknown: Bacteriophage F125/10
MDILIIHYKETNKRVLKETIQTIQNHLNDEHGLVKMTATKLSRENIEKRFNNYNIVIAEDDPDNSYHYSEAVEEADFIIDIPISYLDIHAGVEWDVDNPVDMLDRNPDFIEAVNKLNEDLML

SEQ ID NO: 1104 - protein, 115 aa, Unknown
  Description of Unknown: Bacteriophage F125/10
MLNEKLKNLEDTKVYMINSIASLLSASTGKSSKVFFDEGTIKIVSGETKAVEVIDNLVHPHSGRLPIKTTERIALGRLTDSLQFVISEIEVVKDQIIDEENEAYIDFVMEDWDWD

SEQ ID NO: 1105 - protein, 90 aa, Unknown
  Description of Unknown: Bacteriophage F125/10
MDLLTIASVAFIAVVIIDLINDDMSYMLTGTAILINIWAGFYGWFFLLQAGMLLFLLLARKVKDDKESILYSSASLICALGMIINLLSFS

SEQ ID NO: 1106 - protein, 101 aa, Unknown
  Description of Unknown: Bacteriophage F125/10
MSKETIRRQFSNAIEIMATTKEWWNFPKSFNTSKEFKIKTFKNDTLVFEVREGSRNLGSFVIFTNIDFDYDKLEGTSTQYMINYFAKKLTKDMFNYHKLQL

SEQ ID NO: 1107 - protein, 116 aa, Unknown; identical to SEQ ID NO: 717
  Description of Unknown: Bacteriophage F125/10

SEQ ID NO: 1108 - protein, 200 aa, Unknown
  Description of Unknown: Bacteriophage F125/10
MIKRRKHLDHSLQPEKGWRTVPFNGYYEAHPTGLIRNKVTKKLIKGTQTRKNHPKWTAHEIVYLINPKKTSYSRGVVIAHTFPEMISQSRGDLKNGHVCFKDGDRSNCHVDNMFIGKGNVNKNIYKLNDSYLTRKDIEEDVNNLVNERLFSQLELLIKKNEPERITPSNHFIKRDNNVFSITDLSKNSLVEFELEIKNIK

SEQ ID NO: 1109 - protein, 59 aa, Unknown
  Description of Unknown: Bacteriophage F125/10
MNEWYALCYYDKVGKKKIPRQIKAHRDVSVLEDLKDRLEEQNPKEEYKIKTTKEFDKER

SEQ ID NO: 1110 - protein, 91 aa, Unknown
  Description of Unknown: Bacteriophage F125/10
MKLEDKVLERIDSLGNKAGNLSNQAMESLVKYQITYGIIDIVVSILVIALTIFLGKVYLKEYKKVKMDLKESLLYDDYDILSLRNSCRYTN

SEQ ID NO: 1111 - protein, 22 aa, Unknown
  Description of Unknown: Bacteriophage F125/10
MRLINPEVYAVKDLIEQVKGGN

SEQ ID NO: 1112 - protein, 97 aa, Unknown
  Description of Unknown: Bacteriophage F125/10
MKQRDFEFEEDFVLTYECEDCKHFEDWGHDEEPEECSECGSSDLINNTSHEDTECDMCRGYIDMWQDGYRYMGDNKEYIEKEESGLICEDCYEKLDI

SEQ ID NO: 1113 - protein, 95 aa, Unknown
  Description of Unknown: Bacteriophage F125/10
MNKAVEQASNALGQGFSAMVWHQVLAGLGFILLGLVLSLLVWVLVKKFHVPFNHPTAFVVYSIMLVSIVASFIWGGLHVINPEYYAILELKGFIK

SEQ ID NO: 1114 - protein, 38 aa, Unknown
  Description of Unknown: Bacteriophage F125/10
MTKEELEQKVKELEAENKELKKQIERFEDEGGKTKDEQ

SEQ ID NO: 1115 - protein, 88 aa, Unknown; identical to SEQ ID NO: 723
  Description of Unknown: Bacteriophage F125/10

SEQ ID NO: 1116 - protein, 101 aa, Unknown; identical to SEQ ID NO: 724
  Description of Unknown: Bacteriophage F125/10

SEQ ID NO: 1117 - protein, 133 aa, Unknown
  Description of Unknown: Bacteriophage F125/10
MIFILIFGLLFILSLLGIFIYFIVLRKKKQLIEERESFGIYNRTKEKLGDVTRLGYEEDVYKLIHNQSNKTIIEDKKSKVVDTIKKMYELELTSVDVSKVEGLSPLDTEPMTNMKLLSYKLDREGLYSLSKFI

SEQ ID NO: 1118 - protein, 78 aa, Unknown; identical to SEQ ID NO: 726
  Description of Unknown: Bacteriophage F125/10

SEQ ID NO: 1119 - protein, 175 aa, Unknown; identical to SEQ ID NO: 727
  Description of Unknown: Bacteriophage F125/10

SEQ ID NO: 1120 - protein, 106 aa, Unknown
  Description of Unknown: Bacteriophage F125/10
MEKFKGKDLYKTRIRKQTIKNLVIKTEKLHNKHGKYRPIGHVYYYPKTKEFTLSKPEQKIFIEYMKELGFNVKHRRRKKTLIIYKNAFTEYISMYHEAIEQIEGGT

SEQ ID NO: 1121 - protein, 76 aa, Unknown
  Description of Unknown: Bacteriophage F125/10
MEYLFLFIGIGMIIWGFIAPYLAFVVYYKHVRENHNGFSDEESLEEATVLGMGFMFIAFIPIGILVVIEEIKILFF

SEQ ID NO: 1122 - protein, 68 aa, Unknown
  Description of Unknown: Bacteriophage F125/10
MKHFILILGIVILVIALGIVILVIALGIVLPAWILQLVLSAFGVKVSIWVCIGIFILISAIGSMFSRN

SEQ ID NO: 1123 - protein, 87 aa, Unknown
  Description of Unknown: Bacteriophage F125/10
MAKYESNINGENYIATPSQALREALAKLITEEKSFAEYQTKGGEQYESQLQLRHFDAMISQYEEAIRVLEDKYRPQIFIPKDNKEEN

SEQ ID NO: 1124 - protein, 105 aa, Unknown
  Description of Unknown: Bacteriophage F125/10
MKAESIARFFNDKVLQIEGYKVRFPQASSSYILDIDTVDESVLFLDAQVSTLSGKHLLDTAITIERPETLSAKELYTEISNKLQAIVGDQTKTTIELSRYFKEEK

SEQ ID NO: 1125 - protein, 226 aa, Unknown
  Description of Unknown: Bacteriophage F125/10
VSNKTITNHLLNLKGINIETYSIIARIKKQTSWGDKGDSFEISISYKADKDPRTVRYITTEITIDYSSNNPKEILLQLKDKIFSIVEEQVETDNDFIESIKEINSTKALEKLKPYINNEYYSMFKSSIEKEIPVALSSEVLNRCTGKTSTLAYLALEKDLPLVVSNEPMRKMLKNKFPHLRVSSAEDYSNYDIKGEIVLIDEVDIDQLYSADKVSVDALLVGIIKN

SEQ ID NO: 1126 - protein, 52 aa, Unknown
  Description of Unknown: Bacteriophage F125/10
MIPIIVILIGLILFLSSGYKLVLGKYYDDVDLKILFTIFGVGIALLLGGFIL

SEQ ID NO: 1127 - protein, 74 aa, Unknown
  Description of Unknown: Bacteriophage F125/10
MNYEEVLRTIKENKPCKVRFTGNILAIVNEEFNADTDKGVLQLDVSNINKEGYIRLQQYCLERDDYTVVGAILF

SEQ ID NO: 1128 - protein, 66 aa, Unknown
  Description of Unknown: Bacteriophage F125/10
MNYRDFITDCISGGYNVHISVTEKRVHIISEMTSASYPKKEINLDELQAYVYYMNNFGSQITTEGL

SEQ ID NO: 1129 - protein, 96 aa, Unknown
  Description of Unknown: Bacteriophage F125/10
MELVINIVAVLVGMYAIYFYVTKFSTGLSGILIVLGMAIGLYFYLDYLNVRENVIRLVSVMFGAFLFSIEMIYNKIMFEIKKSNVQKTVRVYDKEQ

SEQ ID NO: 1130 - protein, 102 aa, Unknown
  Description of Unknown: Bacteriophage F125/10
MYPEIDVEKLAYKLKSTREYLESIKIKEVEIYEIYHLKTGKLVFKGEYIEVKELLRKMYKENLTLVDVDTMLSIGKGFIDVIKNISAENVFQITYKKELSTK

SEQ ID NO: 1131 - protein, 302 aa, Unknown
  Description of Unknown: Bacteriophage F125/10
MIKIFSEVDKEYKPIITEKFPNGEINFKYDDLKYLVEENLRFDVFFKWENDADLMHLYMFTKYLEQLGIKDKAEFLEIAYLPYSRMDRVEEGHNNMFSLKYITEFINNLNYKSVWVVEPHSPVTEELLTNSVAIDVTLKLLNQYIEMSEEPVTIVLPDKGAYDRYLFDVERILMESNIESYSIVYGEKKRDFETGKIKGIKIIKDKNTLYDNCIILDDLTSYGGTFVGCKKALDKLKVSSVSLILTHAERAFAEGALLSSGFKDIIVTDSMFPKNNWEKAIAKHRARINGTELQIKDIERYL

SEQ ID NO: 1132 - protein, 489 aa, Unknown
  Description of Unknown: Bacteriophage F125/10
MLNPTLMCDFYKLSHREQYPEGTEIVYSTLVPRSNKYYEHSDNIVVFGIQSLVKKYFIDMFNKEFFNRPKEEVINEYKRTVKFTLGQENPDAKHLEQLHDLGYLPIDVRALKEGTVVHPNTPVMTIENTHSDFFWLTNYLETIISTQTWQAMTSATLAYDMRKMLDKYAMETVGNIEAVDFQGHDFSMRGMSSLETAQLSSAGHAISFKGSDTVPVVDFLESYYNADVEKEMVVASIPATEHSVMCANGNYETMDEYETYKRMLTEIYPTGIFSIVSDTWDFWGNMTKTLPRLKDIIMERDGKVVIRPDSGDPVKIICGDPDADTEYERKGAVEVLWDTFGGTETEKGYKVLDEHVGLIYGDSINYERAQQICEGLKEKGFASINVVLGVGSFSYQFNTRDTHGFAIKATYAKIKNEEKLIYKNPKTDSGKRSHKGRVAVYKDGSWEDNLTLHQWLNKQNVNQLERVFEDGKLYRDQSLSEIREIIKNN

SEQ ID NO: 1133 - protein, 81 aa, Unknown
  Description of Unknown: Bacteriophage F125/10
MIYKISKHNYYSRFEYSSYLPDEGFAYIDYVDVILIGVDNPRKRKVITLKADEFNPSDFKVGHKYNIIKILWFEKWEWLQP

SEQ ID NO: 1134 - protein, 130 aa, Unknown
  Description of Unknown: Bacteriophage F125/10
MIIDKLNGVKLEIGGHVVSFSVSKFKTINGERQLLDYHHIKRRKQKYFRTTEEFYNEYKEIKPDKNEIDEMFESLGYVDTKLEDVVRNQEKVTEILGVSEQYLNQLSYKAIEEYVDKIVTLEIKELKGEK

SEQ ID NO: 1135 - protein, 65 aa, Unknown
  Description of Unknown: Bacteriophage F125/10
MSNSWEKEGVNYWENEDCPREYLEKAFIELVEYVEGVTVPSRDVQQLREDKLREDIGFYEYVADK

SEQ ID NO: 1136 - protein, 98 aa, Unknown
  Description of Unknown: Bacteriophage F125/10
MMNGKQIYVFLSDQYSKDILSLQLGLIKEWSRRELTYSDDVGSDADVVICTDIVRDDFVKKLSKNNSNALFVFISSFYWIGYKGGEFFVAVQDYVKGM

SEQ ID NO: 1137 - protein, 103 aa, Unknown
  Description of Unknown: Bacteriophage F125/10
MKKLLILFTLASTLLLAGCTPDNHEGKVLGTGEYREPTTYIKSGSVTVPVIGEMKYYVDLETDKGEDRVYLNREVYHKFDKGDDFSNVGKKVYKNDELIYKGD

SEQ ID NO: 1138 - protein, 99 aa, Unknown
  Description of Unknown: Bacteriophage F125/10
MKQFIHDKKDSYNSTNRNFDIQYYKGIPLQQIDRGYGQARARRFTINNTNQNIWIPMTYLKPNGTLKNNIDIDWILVKEKCSLKKAGLVIKIKITGDVL

SEQ ID NO: 1139 - protein, 79 aa, Unknown
  Description of Unknown: Bacteriophage F125/10
MYILERTIRGFAGQTEDILPYYFKSKKEIVNFLKLMEFLKEETNYWVKKNGNYTIIIRAKRILYIEEHIQKLKEWENDL

SEQ ID NO: 1140 - protein, 51 aa, Unknown
  Description of Unknown: Bacteriophage F125/10
MTYDVYVLYKRGEPIAQGSMEHCLDVYYWERVHGYSNKGYELLPMGYEQEE

SEQ ID NO: 1141 - protein, 64 aa, Unknown
  Description of Unknown: Bacteriophage F125/10
MINIEHDYTIRTVDNRKYTYYSKHESPVTLYKNIIGKDCIEVTKYGKDKKVIIATKYIVSIERW

SEQ ID NO: 1142 - protein, 117 aa, Unknown
  Description of Unknown: Bacteriophage F125/10
MNARKARKNTKNYKDSNVVTKEQHLTYIYNKLNYLIANNSSQGKTYVVMNLRTDYPDEFSLSKLKYLKEIKQHYKDLVFNVKTQVRKAQWSEKSIIRYYFNLGYIDSVLVPIIHISW

SEQ ID NO: 1143 - protein, 62 aa, Unknown
  Description of Unknown: Bacteriophage F125/10
MFFKKKKLSNVEKQIRQNRNKEDKERKEHQDKLDTDMYKTYELDKIVEEHLRKLNTISLEEL

SEQ ID NO: 1144 - protein, 62 aa, Unknown
  Description of Unknown: Bacteriophage F125/10
VCLGTRLVYYYSIGKDWNKQVYSLNELEYMKKKFKKLGFETQITNEDIGFQPYIYLRLLWDA

SEQ ID NO: 1145 - protein, 53 aa, Unknown
  Description of Unknown: Bacteriophage F125/10
MNLTFEDKLEDLLKKVRSGEIEPIEYSQVNDEHPNGKTTCGVTFKFDIDTPTK

SEQ ID NO: 1146 - protein, 101 aa, Unknown
  Description of Unknown: Bacteriophage F125/10
MIILFTQDYDKTLMKVILGDINTMRPNWKYSVNHPEKEEDVHIQAYEGEDIFDDIEELSDSTQDIVIGVTEDDCISESPYDFNGGLRLVTKHIKEHIEKFL

SEQ ID NO: 1147 - protein, 99 aa, Unknown
  Description of Unknown: Bacteriophage F125/10
MIDIYLGEGYNKEYLSKALRLINDHAPRELSYDFNNVEADVNIHTMLYVKPEDRYVYKDISYDFPGDLIICIVEDDAIVYHQGKQVSGISILRIIEELI

SEQ ID NO: 1148 - protein, 97 aa, Unknown
  Description of Unknown: Bacteriophage F125/10
MIEIYLSENYDKDLLKAELKWIKETASRELTYDVNRNPNLDVHVSPFRYTKDEVKEISLHPQFEDDVCVFIAETWIHEYHRGKSIGVDSMEEYVKEM

SEQ ID NO: 1149 - protein, 85 aa, Unknown
  Description of Unknown: Bacteriophage F125/10
MFKVYYTVYHKGSMKTIKDKLDRSSLIYFLYDTWYKDISNVFPNHYNKEFGSNSDDIDIDKLIEAVNEEGILLINRGNYVTIREW

SEQ ID NO: 1150 - protein, 79 aa, Unknown
  Description of Unknown: Bacteriophage F125/10
MVTLTYTIIHKESDRVIASGLDELEVINLVQRMVNTNLVTDISLDDYIRRPSGDIDVLNLLVDIRRQGVFDFNHTWHVG

SEQ ID NO: 1151 - protein, 115 aa, Unknown
  Description of Unknown: Bacteriophage F125/10
MIVIYTDVSKDYLKDEFLPWLNERDRYLEDYKDELPEDIDSSYIVSVVYCKDMEGLLERKDIVIGNSYNEPVALLGVPEFFGNYSNYFYYRGESISKHDLGEIVRLKAWQRMGGD

SEQ ID NO: 1152 - protein, 230 aa, Unknown
  Description of Unknown: Bacteriophage F125/10
MKHNINNIEMFSKYYIKENKVYSKKTNKELKKDKNNFYRMTDDINKARKVKIDTLLQYNLKDYNSINNLPNEKWKRIENNINNIFNYSVSNYGRIKRHGNYYMIEKLVKPHNHKQGYKIVKINYKHHSIHRLVYEYFGNDFNQDYHIHHIDGNKQNNHINNLQCISPTEHNNLHHKDETINNFKRGKSLTDNERKNIYKLYTEKGFTQEELSNMYNVSRITINRNIKRFK

SEQ ID NO: 1153 - protein, 102 aa, Unknown
  Description of Unknown: Bacteriophage F125/10
MEIKEIADTIMYLFNMDGYRCAEPPLYESTLNHTRTHTALIVSIKGNYDTVQMFRKTPIMSMRGQSQPASMLVNVIDDVIIIVYENVVYGVQNKEIKFIEEI

SEQ ID NO: 1154 - protein, 95 aa, Unknown
  Description of Unknown: Bacteriophage F125/10
MTNKNYLYEETHTVQGQDITAFRIPNDTNGNPRYVVHFMDLNIKLADYDNINKLYGFNKYRAKWFGGGVVFQSYNIEDTLNFALDKVKEIEAVKN

SEQ ID NO: 1155 - protein, 90 aa, Unknown
  Description of Unknown: Bacteriophage F125/10
MILEIETKPVKTLKAIKDDTKNIKNSIAEHLGLNREQFKLSNGLITLKGYSEEFKCWYNLTSTIGNFPKYLKSELYNEYKLYCNVELKTK

SEQ ID NO: 1156 - protein, 52 aa, Unknown; identical to SEQ ID NO: 754
  Description of Unknown: Bacteriophage F125/10

SEQ ID NO: 1157 - protein, 126 aa, Unknown
  Description of Unknown: Bacteriophage F125/10
MFKLQNKVEIIVPKEDNNGVEIADKRIKEYVNSITMEAGGCTITEIKGQWYSEDEKRIMEDNNLNLEWYYIPDRAKFMTVELKGIVRRLIEVYGQEAISIKVNGTLYIVDQSDIEELHTTLLNIMK

SEQ ID NO: 1158 - protein, 73 aa, Unknown
  Description of Unknown: Bacteriophage F125/10
MNRLEIVKDTAMEYILMMDNSVMDGVMTQEEYNEAVSFEKVYDYTLSEANKECKFLGGKVLTFLVHEAIEEYA

SEQ ID NO: 1159 - protein, 45 aa, Unknown
  Description of Unknown: Bacteriophage F125/10
MRYEIVTLVNQELFMYATFNKQEAEAKYSEWCELYGQENVSMEKN

SEQ ID NO: 1160 - protein, 92 aa, Unknown
  Description of Unknown: Bacteriophage F125/10
MIILNYTKEKEMIQMKLLNQENQIVISIATLESVKQALIWEYIDHIDYNIWNNELDDTEAVVKISGILQSIKFADTMEDLQEYIGDIGWKLI

SEQ ID NO: 1161 - protein, 79 aa, Unknown
  Description of Unknown: Bacteriophage F125/10
MKKNVKASTIEWLELTQGHGEFDGFDEEDMDFRKLDDEDIKWYFENWYFTEEKQEQIIDEIGQEEFEEAYSDDIKEYNN

SEQ ID NO: 1162 - protein, 86 aa, Unknown
  Description of Unknown: Bacteriophage F125/10
MTKFKLIDKNSFYVNDNYNNETYLTSQIVLSGEAGRLLDDMIEDCEDEHDKDNYKKLDTNNIDDIDYILECANVYIYPYNKTEFKY

SEQ ID NO: 1163 - protein, 57 aa, Unknown
  Description of Unknown: Bacteriophage F125/10
MNTRRANKALNEAVRLLDKQIEDTQKTMQELNKQLEQQIKAKQELMTLVDVMTGDDE

SEQ ID NO: 1164 - protein, 89 aa, Unknown
  Description of Unknown: Bacteriophage F125/10
MNIKEAHKVVRSAKSKLLQEQEHITNHIIEDYIIEELHRRTQGSGTIQMNNNTASYSNGSYGSLEELREAYDLSSLSTGEIKELLETFV

SEQ ID NO: 1165 - protein, 83 aa, Unknown
  Description of Unknown: Bacteriophage F125/10
MKEQIKQFEKELEMAVNNLFVLHDCGVSQAKIEEQNQKVVYLKAIVENMKAYEEIRVEPKSEEQFFKELEEELEEEEKILKGI

SEQ ID NO: 1166 - protein, 87 aa, Unknown
  Description of Unknown: Bacteriophage F125/10
MKLYQVEHDNCEPYEDNYSYREDKVYTNKENLIKRIKAEGYEEKISGYLQDGYTYYYKDNIEDVPLFREDMITIHELEVINNTSEEE

SEQ ID NO: 1167 - protein, 143 aa, Unknown
  Description of Unknown: Bacteriophage F125/10
MENYKNFIIEEMNKAHILVTKAEQIKGDRKLAETELEEVYRKAEAFDEIVNELLYQLQNLESWDTLDQKDCQTLKQILEENIKEEKQMERFKVKRIITTEEVRYIDAETEEDAWYSVEYEDEGTDTAHFSAEYGEWSYEREDN

SEQ ID NO: 1168 - protein, 63 aa, Unknown
  Description of Unknown: Bacteriophage F125/10
MIEISISWTYLITFLLLWSAGTLYINYLVYRIRLTNKERKEMSKEHHRNREEIKQRIENRRDK

SEQ ID NO: 1169 - protein, 82 aa, Unknown
  Description of Unknown: Bacteriophage F125/10
MRYDINEKCYDEKDFVLQIIYENYSDETDREVETIYNKAEAWDKLCEMLKDKDMSDGHFEEEMFKLFSRTGKSFTIDKEESQ

SEQ ID NO: 1170 - protein, 160 aa, Unknown
  Description of Unknown: Bacteriophage F125/10
MNKTFFKFLGKNTLEYSKQGLGFLVALPIMLIIFSVFLAFIIGIPAVIIYALHALNIDNDFIIQLVPVMWFIILYGIVRTDEHKKPFVKLKLKDYLLSILYLTTITAISVLESYLLFQLLPFTGDVRAVITLLSFIVFVAVNRGICKIAIKSYKEYKEEL

SEQ ID NO: 1171 - protein, 143 aa, Unknown
  Description of Unknown: Bacteriophage F125/10
MNIKYIDLVLENCDVVRLESKDVSRFHISGITEGIDYYGTYKETSNISRTRHCTYFGILIDKPMEIPQVGFAYPDNTNAYEMITAYSDITAIDIIYENDANEYIYVDFNEYNDNYNINQKNDYYNNMLEITITESNSREEEDE

SEQ ID NO: 1172 - protein, 180 aa, Unknown
  Description of Unknown: Bacteriophage F125/10
MDKINLNKKHDGSTVVNISNNIMLKIQCTDLRKECDDSEAPTTYTHFKAYIVYNIFIVVNDRKQKKKVKYDYYNDHVGRGNVKDLLKVKDVIFQLSTQLNTNEIIKISGADERRYKIYKYFIEKDIRFEDNMYYSKSNIWIINNFSLLQKFQWNTVVTKDGDYNKKELKKVDKEWKELLI

SEQ ID NO: 1173 - protein, 162 aa, Unknown
  Description of Unknown: Bacteriophage F125/10
MRETSEYIMFWGKEDIYSNFYPIKFKHQGRTFNNSEQAFMWRKARYFNDFQIAGEILNAKNPNHAKSLGRKVRNFNEEQWNKVRYDIMVEVVKDKFMTTHLKQRILDTDVRKDFVEASPYDKIWGVGLKANDPKILEQSNWKGQNLLGKVMEDVRVHCIYNK

SEQ ID NO: 1174 - protein, 132 aa, Unknown
  Description of Unknown: Bacteriophage F125/10
MKKKYFKGLKLNDFEKEVFGLKKNKKYKKMKKKLGRNEPKYWNYDMSFFIQLYADLNAFVESSNHVDMEYHTFVDVDGKERTQIDMIKHILSLIKYYHKEMDDFDMDKYDELEQVQSKILDNFKIVLPSLWN

SEQ ID NO: 1175 - protein, 235 aa, Unknown
  Description of Unknown: Bacteriophage F125/10
MAIYVVPDIHGEYQKLLTIMDKINNERKPEETIVFLGDYVDRGKRSKDVVNYIFDLMSNDDNVVTLLGNHDDEFYNIMENVDRLSIYDIEWLSRYCIETLNSYGVSTVTLKYSSVEENLRNNYDFIKSELKKLKESDDYRKFKILMVNCRKYYKEDKYIFSHSGGVSWKPVEEQTIDQLIWSRDFQPRKDGFTYVCGHTPTDSGEVEINGDILMCDVGAVFRNIDFPFIKLEVKK

SEQ ID NO: 1176 - protein, 616 aa, Unknown
  Description of Unknown: Bacteriophage F125/10
MTKKLKLYDYENNLLKSSENIEDSIGQIVIENLNPDTTYEAGHFKICWDINGEESIKVDIPKFVTLTSSQDKLIIVTYNEVEPMNIKAENIIGLQDVIDTQFNDHIKEEFMAEINKLIADNKPTQQPSTTTISPLKDKKVIFIGDSITEVNARTTKNYHQFIADRTGLINVNKGTSGTGYQDRKNVAYTITDKPDLICVMLGTNDYGLVGGKTKPLGTAKEHSYTTVAGSIYYTYYQLSKVFPTVPIVVLTPTPRIESNPFKEVENGQGYTLGQLVDVIKEIAKQFSFPVLDLYRESNIRVWDNNVNKTFFAWKEGMEDGLHPNAKGHEFISYTIQSFLESKGTVGAIASPPSIDTSVKDLGNGVYSKLIRPTGMRWKKDTSFVMNMSTDDIDLTANKILNVSYNGKSLINPEGYTSNSPYWYTLPAYEDGNKYNRISEVQNFLNAFITIDDNAQGLEFMRDYIKVIYVDKTKTNIVGEYTQVGYKDTTASTPPTGDTSGTITPVSNGDGTYTATFTPTAIYWKEDQSFMINIDKTKLDLTGKSVTKLEYNGKTLVNNTSLASNSPYWLTVPTATEGTTNNRTPEVKDFVSVLTLESTGTDGRKKYKNVEIKLTYK

SEQ ID NO: 1177 - RNA, 72 nt, Unknown
  Description of Unknown: Bacteriophage F125/10
ggacucuuagcuuaaagguaaagccaaccgcucauaacgguuugacuguagguucgaguccugcagagucca

SEQ ID NO: 1178 - protein, 182 aa, Unknown
  Description of Unknown: Bacteriophage F125/10
MEKIYILEEEIEEMDYDLWEEDTVYTTSYEVLGYTDSLEDAEYIRDNYGTSNPIFINEYPYLTKEKLIEEQRYFRYNSYLELKRVNGYFEISEINELHVTEDFSINKDDKNFDSPFSINMFSHNRNSIGIEFIMFSEYNDKEDIIEKEKNSFLMKLKYLLKHSREADIRSTSKIIDSIDKLT

SEQ ID NO: 1179 - protein, 72 aa, Unknown
  Description of Unknown: Bacteriophage F125/10
MKNIINFLVDYNINFSYSEDSLNVMNNSYLVDKHGTQDYEIVGNYEHITGVFSYQTEEEVIAKLKNLIGIWE

SEQ ID NO: 1180 - protein, 64 aa, Unknown
  Description of Unknown: Bacteriophage F125/10
MRDKRIHSELLYDIIGKHIQEEENITPYIEAIYVDMMNIIVVEYTFYNENGTRMLGQYPIGEVM

SEQ ID NO: 1181 - protein, 245 aa, Unknown
  Description of Unknown: Bacteriophage F125/10
MNLEKSFLLSTIEFGSTYQGTSDEHSDKDYMSLVVQPLSDTIFRNNEKASKHTEVSRYYAVERFISLVLKSGFDNVLNLCAQLEQAKNTRFNKTVLDLFYDDFIFLTYVRANFKPIAYSVIGNINNILKKGELTGKDLVKFYTFYNHLEYYNDLLDDLDNLNVSYKDFAKVKYMPKEVLDNKRSNVSIEKKKDLVNKVEPLIQEVKDKLKYNESNIKHYKDAMELVEKSLKDKTVAFLTEVYNER

SEQ ID NO: 1182 - protein, 34 aa, Unknown
  Description of Unknown: Bacteriophage F125/10
MKYILGLITLGIILFKVYEHFKYKQDEVDTEEDI

SEQ ID NO: 1183 - protein, 82 aa, Unknown
  Description of Unknown: Bacteriophage F125/10
MSNMDFYQFLNHENVRVNSITPSQKNFIRENLELTNLEDTDIDFISSKKAKEEIEKIIRIKNEEEYDMAMDALAGWVTKHGY

SEQ ID NO: 1184 - protein, 129 aa, Unknown
  Description of Unknown: Bacteriophage F125/10
MFKKAPQYIMEKVEKENNILGEDLSLDIYYKGVKLTVKRHPETGHLNGYITLPSDINEKEYDSLERRAHRGITYDDYDYEGKRVLGFDCAHAWDMTPYAIIGSLDDQYRDLEYVLSILKDMAEYVKKDE

SEQ ID NO: 1185 - protein, 57 aa, Unknown; identical to SEQ ID NO: 568
  Description of Unknown: Bacteriophage F125/10

SEQ ID NO: 1186 - protein, 160 aa, Unknown
  Description of Unknown: Bacteriophage F125/10
MANEKEIIRMVNYLIDNMSMWHINYARAVLIPSEVEKIIKEHEKFDDLLKKRGEWLVKGSDTDNIDDLETYNQIMNNQKDEMMIQEIDIYTQGKTITIDNEHYSSDDLNEVLNKLEQSEDIKIKSNYKSLYVGYTNVVGYEVTYASSYEETFKNDLEKDL

SEQ ID NO: 1187 - protein, 180 aa, Unknown
  Description of Unknown: Bacteriophage F125/10
MDRIIGKHNLTQDLRLGDKVEVYDAHKFKENEDGTIELGDKITEGIVVDYKGDFTGNTSGLVTLDSSEKELIIGEYNFKLIEEGNLQAVYDSVSKNKVESLSEDYDMYRKLLGVKSGELAGIEDELEYLVRQYNSKVDNYNGLLTLSKEKARELSLLTGNKKTIPHMKNRRLELGKEADF

SEQ ID NO: 1188 - protein, 177 aa, Unknown
  Description of Unknown: Bacteriophage F125/10
MVYDSIISRTMAVSILNKWIAELITDVDLDKCKFTEEEYGKVVTNSINKIQDVLIEKNYEVTDGELYDIVCTELINPIKNNTEEEKHNEKNDLLEHLEDLAFRHDIDLGYVSDGSYNLTVTHWLMQDEFTDVNIKVNNDEDFYTVTIPESKYFWLPITKENLEMFLTQDPINKGEVK

SEQ ID NO: 1189 - protein, 54 aa, Unknown
  Description of Unknown: Bacteriophage F125/10
MKNPIKLLSIAVVTILTFSLTYVILKKETNNKRNGVAPFDFSLEDHIHLNKEIK

SEQ ID NO: 1190 - protein, 92 aa, Unknown
  Description of Unknown: Bacteriophage F125/10
MANNIWAVVLSIIILLIILLILWFLFRKKVNGGNSKNVEIQKAEENNDNKEQEVEEAQYRELNEEEKEKNENSSKDYKYDKEKVKNKLKELE

SEQ ID NO: 1191 - protein, 281 aa, Unknown
  Description of Unknown: Bacteriophage F125/10
MGRRLIDNSELNVIKYDGLPDFFSALKKNRVSGRDNSSDTGSYDFTGTHSFQEAYNLMVKGDRESYDMVVKLKKMTDALFRMDKSVKRKPVVAPEGYQPHVPNAIKGLPNSMMSQQRVKAEKKVIDVFYNSSISWREDPENLAYRGAIMLSAIQTLETKGYSINLYLGKLSNSGYEDKLTGFVVNIKHSYQRLNVFKSSFYLVNPSFLRRISFRVLEVEPDMVDLTNHGYGSVVSKSSYGNKLTEHILDNAVIFDSSVGIDINNDSSENLRAVKKLFGGRL

SEQ ID NO: 1192 - protein, 372 aa, Unknown
  Description of Unknown: Bacteriophage F125/10
MAKQDTIERLERLVEQQMETTADLAKKLGEKNSNPYEQAIVDAIVEKAGTESREIIITDVKKQIEEYVEEQLSNLPVKIELQQEGKTIKDISGIFHYRYQDILKLVNQNIPVFLKGGAGSGKNHVLEQVAEALDLDFYFSNAITQEFKLTGFIDANGKFHETQFYKAFTKGGLFFLDEMDASIPEVLLILNSAIANKYFDFPIGRVTAHEDFRVVSAGNTMGTGADHIYVGRQQLDGATLDRFAQVEFDYDTKVEHQLSSNEDLVNFVQQLRHENDEKGLPYVFSMRAIINGSKLDGVMEDEFVVESIIFKSVPKDEINQFISSLPEGNRYTEATRKLLGMQQEPKQEPRKSDSTSKDSMDFDTIMDKLGLE

SEQ ID NO: 1193 - protein, 108 aa, Unknown
  Description of Unknown: Bacteriophage F125/10
VSKRTDNFIYFCKYYFSEYLPSLGVEVLNHNETSHGTMEGVKKYYIANILYEGQELTVTIDLEEFNNATSMHNMLEIMNNHTYNCMFMYDMDTHETKDIDDFFKLMYF

SEQ ID NO: 1194 - protein, 138 aa, Unknown
  Description of Unknown: Bacteriophage F125/10
MNAKEFMKTQAQVEDYLDKLKVTIIEDALSVSKEWSNDSNDLGYALSSLGESIGLLENYYNIQVDAHLPEHYKGSKDVISFLEEHFSYDGFVDSMIFNIVKYTTRLGRKDAVDKEVQKIKTYYVRLERNIKYGDSTRV

SEQ ID NO: 1195 - protein, 100 aa, Unknown
  Description of Unknown: Bacteriophage F125/10
MEKVELIKQWAKDRNLQTGKPEGQMLKLLEEAGELASGIAKSNDHVTRDSVGDIFVVLTVLCLQLDIDIEECIDMAYDEIKDRKGKLINGVFVKEEDLKK

SEQ ID NO: 1196 - protein, 62 aa, Unknown
  Description of Unknown: Bacteriophage F125/10
MEKFQEDYVNIDIRVKAYVRVGYRYEEDITNNLHELVEDNLNVTSDSDSLIIKDTEIKGDIE

SEQ ID NO: 1197 - protein, 53 aa, Unknown; identical to SEQ ID NO: 580
  Description of Unknown: Bacteriophage F125/10

SEQ ID NO: 1198 - protein, 683 aa, Unknown
  Description of Unknown: Bacteriophage F125/10
MAITYKQKGLTEQEIINLPKVNKGCIYIGEEDVFLKKKKNNIINLGSKELFRDIHNIFSFDTATEIHLFLALCGNKEVTNFTGNPYETIEKLVEGVIEENKGRSYKEYIASSREERKEFPLYGSKRITQIKSKGYVEEKIKELENETRLRWYESRQLDEYKEVVDSLNNDIMDILYQGKYGLIKSSITSRLNEDTEKGSSKYYKEISDSLYSSTWYMHPSTENSSSFGLKVRHIRDKYNMGNRWVLENKSSFDVKTGEVKVFLTDSLVNKEITLNLYKDDISKSEYKNELNLAVLLNVILKNYSTPNLSKNVIIKIIEETLRNDGFGLSSWCLDEVDVYGRVNYGGNKYKPLKGENSTSNYLTILTDIVKNIDKINNLEEFELFERNSLLFHIPKNPKWKIHEAFNLTKQTYKKLLTLNNFEQSNYLRFSDTLYNYYNHLHNEVNLHQLFDDTFLMVQDVRNVTDALKVKPIVNEILSISFANYKKMTHYLDVDAQDRQRITGYALDSYYLDYLHDLSILIREGYRTLESVNLTPFSLKLEHDIVTDEKQSIQQQLDDAELKSKYENKLEKIIDKTYKLKDGRKVKFLPADTVSKLKNEGKMLSHCVGGYANRIIKNSCLILLARLEEDLDNSWFTVEIRITDNGYVLGQQQSIDAYKLPNELKEALEKDIKKINKEEFKEVA

SEQ ID NO: 1199 - protein, 87 aa, Unknown
  Description of Unknown: Bacteriophage F125/10
MSIEKKEEVVAHNEVVFKSLTQGLYVKEVDIYSDVISYTKDIDEALAMPNTINFKNSRKYEKLIRNLDLKPLNKIQKVIYETHLEEL

SEQ ID NO: 1200 - protein, 57 aa, Unknown
  Description of Unknown: Bacteriophage F125/10
LNDLIKEGNKYYHKVRAGETLWTISKNYGVDIKKLQELNNIKSVTLTSLEYVLVCVE

SEQ ID NO: 1201 - protein, 192 aa, Unknown
  Description of Unknown: Bacteriophage F125/10
MDNLSHYLSILYAILVTVGYIPGLIALVKSDSVKGVSSYFWYLIVATVGISFYNLLITDATMFQVVSVGVNLTLGIVCLLVASYRKKDYFSIPFIIVFSVLLFLLSDFTALTQTIATITIILAYVTQITTFYKTKSAEGTNRFLFLIIGLGLASLILSMVLSHTYVHIIATEFVNFVLILICYLQANYYSRR

SEQ ID NO: 1202 - protein, 197 aa, Unknown
  Description of Unknown: Bacteriophage F125/10
MVNYTKDKVCYMGGHLLNQAMVEYRTKQHEQVEGIVGVTPYSPHQDKSINDKANAEQTGLAERILNNDFKAMQESDIFVFDILNEGLGTIAELGILLGMKHQAQKIIDKYEDIDFRDLEPLTQYDILEAYNIVNKPVLIYCSDIRQGHGKGYDDPDRAEFSTNQFIYGCVLSLTNGEGFISWEEVLKRLEKLGGQDG

SEQ ID NO: 1203 - protein, 297 aa, Unknown
  Description of Unknown: Bacteriophage F125/10
MKSYTKVKNKGLSLDKFKDRGFVVQEKLDGSNASFTTENGELVCFSRRKKLNENETLNGFYNWVHENMTDKLDLSILEGIIIFGEWLVKHKVNYKEECYNNFYVFDVYDKDSETYLPYSEVISLSETLGLKTVKTLMIIEPSFYLNKLNPQEIQDLVGKSDMTVKPNTGEGIVIKYLDGKSEHDDYFKLVSKEFKEFSRKKMKSEVRSNDSVADYAITKSRMEKMIFRAIEENRLSKDDLELENFGLIMKQVGQNFVDDIMEEEKENMMKIIEKQIKKKMPHILRGILEEKGDTIDG

SEQ ID NO: 1204 - protein, 74 aa, Unknown
  Description of Unknown: Bacteriophage F125/10
MNYLAKVFINNNWLVKLITIVLLTLLLGGLVYVISAVALFLSTVLNLPGLVVLAFLASVSLILFSIVHNSKEDN

SEQ ID NO: 1205 - protein, 246 aa, Unknown
  Description of Unknown: Bacteriophage F125/10
MAIQLKELDFKLKDYPNVRYNMGEHLVFNEFLEKATTEQLDFCEDFFNDNVEILWNESQAGTGKTMCSVACAYADYLNKDRKLVFIISPVSEDLGSRPGNQTEKEMAYFMGLHDALIELNMNPEQQITEMLMMEDNVKEDKLGDCWVSQISHLFLRGGNLRDSTIIINEAQNFKRSELKKVLTRVHTKNSTVIVEGNFKQIDLKNESKSGFGDYMEYFKKYDGAVFHNFTVNFRSKLAQYADNFKW

SEQ ID NO: 1206 - protein, 204 aa, Unknown
  Description of Unknown: Bacteriophage F125/10
MKKINSVIKGEGKKVQTTDVRKISYYVKDYNPCMTVDDANDYNSTSQYLVSDNGKFIAKYNKDMNAVGFYEESGDTVKHLTHTTPERLEGTVFTIEEETKIDLINDTLPQGDILIKFSDGSIYLPDNESVLDSVNYLADNDWDSVDDIIYTGLSKGNSENCIVDFNYNNYDIGYDDVEDEEVCDNYPECECSNYCSSTGEYIGN

SEQ ID NO: 1207 - protein, 141 aa, Unknown
  Description of Unknown: Bacteriophage F125/10
MQDSVNIYTDGSSSYNKGKVGSGAVLVSKEGNIIAEISKSVDKPGLIKYNNVAGEILACCYGIEEAIKLGYNQAIVYIDYIGLIHWYEGTWSARNILSKTYINMIREYQKVIDINFVKVKSHSNDKWNDYADNLAKKSIDI

SEQ ID NO: 1208 - protein, 63 aa, Unknown; identical to SEQ ID NO: 591
  Description of Unknown: Bacteriophage F125/10

SEQ ID NO: 1209 - protein, 213 aa, Unknown
  Description of Unknown: Bacteriophage F125/10
MENNNLVNFLMTTDDIDDTIEMVDSFELQDINKVLGEDTFLTIMEITDSLPDNQYKIVLLSSLDKLLNTDRKELVEYDEEFPTIRKHNVSELKRDTVNSVIDSYMNTNVEILYTEYPTISNYSVVVDSVKVLNTLYLIESKNGKIEATLSEDGEDLHEYISEEGYSVTDILNKFDDVEDLFDEDDSLINFFSDIDEGKNKTIKSFIELVINLK

SEQ ID NO: 1210 - protein, 76 aa, Unknown; identical to SEQ ID NO: 593
  Description of Unknown: Bacteriophage F125/10

SEQ ID NO: 1211 - protein, 75 aa, Unknown
  Description of Unknown: Bacteriophage F125/10
MNKFKRWFRINVLKKETLLFKVYWRYESPSLKKPHVFHIELYAKSKAEARDKSHEYILKNAKASEDFKFLKVEEK

SEQ ID NO: 1212 - protein, 235 aa, Unknown
  Description of Unknown: Bacteriophage F125/10
MKKTIFATLALGTAITFGGMATNEASADEIDYNKLAEQAKSNSVEVNTKPIQEGNYDFSFSDGEFTYHFYNYNGNFGYEYHSGSTQVDNTVSRLAGEEQTPEQKVDQQQAQFDTQNKAVEQPKQETTTQEAPKSVEAPKVETKTTATKSTGGSVAEQIRQAGGDEAMIEIAMRESTLNPNAVNPTSGAQGLFQGLGKSWSGGSIAEQTKGAKQYMIDRYGSTSGALNFHNANGNY

SEQ ID NO: 1213 - protein, 264 aa, Unknown
  Description of Unknown: Bacteriophage F125/10
MRKSVVISGVIGFLAIIGFIILLMCITKIPQGHVGVVYSVNGVKEDTKSPGWHLTAPFDKVNKYPTKTQTHKYKDLNVATSDGKNLQMDIDVSYKVDATKAVDLFNRFGSADIEELEKGYLRSRVQDNVRQSVSKYSVIDAFGVKTGQIKKDTLDSLNDNLEKQGFVIEDIALSSPKADKNTQKAIDERVKANQELERTKVDKQIAEENAKKKEVEAKGEKKANDIRSESLTDEVLQQQLIEKWDGKQPIQIGGDGTIVDVTGK

SEQ ID NO: 1214 - protein, 102 aa, Unknown
  Description of Unknown: Bacteriophage F125/10
MALFLTYFAIFIVFLVLVGFGMSYVFDFLSMREKKSNIRKQYRELVRQGTLEEYGLEQYVKYKKQFLNDRRQSLVTKADKQEIDKEEKALNSLIKEIEKGEM

SEQ ID NO: 1215 - protein, 206 aa, Unknown
  Description of Unknown: Bacteriophage F125/10
MENIIGKKIEKLFVEEYVGSDKIKGKLYLCLCDCGMDRVLSKSQLYYYKSCGCMKSRNGSKKHPEYTVWRKMKERCYNKNQDSYPYYGGRGIEVCDRWKNSFESFLYDMGKRPSDKYQLDRKDNDGNYSPENCRWTTRSENIVNRPSKLEGLKNIQERTNGKYRVSITRNNIRYQSYQVDSIKEAINLRDRMLKEYEETKSITIFK

SEQ ID NO: 1216 - protein, 496 aa, Unknown
  Description of Unknown: Bacteriophage F125/10
MAKTQAEINKRLDAYAKGTVDSPYRVKKATSYDPSFGVMEAGAIDADGYYHAQCQDLITDYVLWLTDNKVRTWGNAKDQIKQSYGTGFKIHENKPSTVPKKGWIAVFTSGSYEQWGHIGIVYDGGNTSTFTILEQNWNGYANKKPTKRVDNYYGLTHFIEIPVKAGTTVKKETAKKSASKTPAPKKKATLKVSKNHINYTMDKRGKKPEGMVIHNDAGRSSGQQYENSLANAGYARYANGIAHYYGSEGYVWEAIDAKNQIAWHTGDGTGANSGNFRFAGIEVCQSMSASDAQFLKNEQAVFQFTAEKFKEWGLTPNRKTVRLHMEFVPTACPHRSMVLHTGFNPVTQGRPSQAIMNKLKDYFIKQIKNYMDKGTSSSTVVKDGKTSSASTPATRPVTGSWKKNQYGTWYKPENATFVNGNQPIVTRIGSPFLNAPVGGNLPAGATIVYDEVCIQAGHIWIGYNAYNGNRVYCPVRTCQGVPPSHVPGVAWGVFKG

SEQ ID NO: 1217 - protein, 167 aa, Unknown
  Description of Unknown: Bacteriophage F125/10
MANETKQPKVVGGINLSTRTKSKTFWVAIISAVALFANQITGAFGLDYSAQIEQGVNIVGSILTLLAGLGIIVDNNTKGLKDSDIVQTDYLKPRDSKDPNEFVQWQANANNASTFEIDSYENNAEPDTDDSDEVPAIEDEIDGGSAPSQDEEDTEEHGKVFAEEEVK

SEQ ID NO: 1218 - protein, 61 aa, Unknown; identical to SEQ ID NO: 600
  Description of Unknown: Bacteriophage F125/10

SEQ ID NO: 1219 - RNA, 72 nt, Unknown; identical to SEQ ID NO: 601
  Description of Unknown: Bacteriophage F125/10

SEQ ID NO: 1220 - RNA, 73 nt, Unknown; identical to SEQ ID NO: 602
  Description of Unknown: Bacteriophage F125/10

SEQ ID NO: 1221 - RNA, 74 nt, Unknown; identical to SEQ ID NO: 603
  Description of Unknown: Bacteriophage F125/10

SEQ ID NO: 1222 - protein, 72 aa, Unknown; identical to SEQ ID NO: 604
  Description of Unknown: Bacteriophage F125/10

SEQ ID NO: 1223 - protein, 69 aa, Unknown; identical to SEQ ID NO: 605
  Description of Unknown: Bacteriophage F125/10

SEQ ID NO: 1224 - protein, 110 aa, Unknown
  Description of Unknown: Bacteriophage F125/10
LDKEINNLVSQVETIKSKIQEGNYIDRGTFKDLEVEVAELRKMIVSIDKDVAVNSEKQSAIYVQLERLDEKISELAESTKTKDTKKKDTTEKVLLLVLGAILSFVFNKFA

SEQ ID NO: 1225 - protein, 108 aa, Unknown
  Description of Unknown: Bacteriophage F125/10
LTKYKDILKLEFKDSLAHFKRDRRFFHMYRIDRLLINGSIIYFDYYYLPSDDPNIVIKELDLQDFGKLRFEIDTKTSYGKVVTDNYMEIINDFLENYDIHSESETVRP

SEQ ID NO: 1226 - protein, 128 aa, Unknown
  Description of Unknown: Bacteriophage F125/10
LNNNIAIFIFKTLVIIIFLLLFLSVVNSLSLIYSIRPSVVMAYFTFGGIVSDVALTMTDKFLLKKEDPLPEYVLKKVEINDKEISIIKKIIESNYDITSEEIKVRAKAQQRLEEDSKEEDNDENEERN

SEQ ID NO: 1227 - protein, 92 aa, Unknown
  Description of Unknown: Bacteriophage F125/10
MKTKKEIKEQRKELKDGATTVSLVKKGDKRIASPSRICSLCGQQLSGMSYTKGKALSKVNHFHLQYSKYIYFDICADINNCYKNLRKRGEMD

SEQ ID NO: 1228 - protein, 136 aa, Unknown
  Description of Unknown: Bacteriophage F125/10
LSAENIRDIINKKKLEEEDTRKYIADGFMNGIGKLMYEFNKKVDNKEIEVKDPNDLYKLFVIFSQMQNMVNETSEGGAIPQLSRPQQELFEEITTEDSNGESTVDLQKISEMSAEDITEMISEKEKVMNEENSKTF

SEQ ID NO: 1229 - protein, 79 aa, Unknown
  Description of Unknown: Bacteriophage F125/10
MDGKELIKIAQETFQTEKITREQIDHIINMLNPSTYMLKYHTLRGHPITFSIPNRDRSKAQAHRPWQVRKHTMRTINLF

SEQ ID NO: 1230 - protein, 47 aa, Unknown
  Description of Unknown: Bacteriophage F125/10
MIVNDTHPNKAVIKSRQLGLSEMGVMEMVHFADMHSYANAKCLYTFN

SEQ ID NO: 1231 - protein, 303 aa, Unknown
  Description of Unknown: Bacteriophage F125/10
MGKKLTNTEFLNRVFQLVSDEYSFLEEYKGRHTKLRCKHNLCSYEWDVEPGAFLGNKNKAGSRCPSCYGNVTKTTDKFKKEIYNLTKDEYRLLSEYINAKTKVKIKHSKCGNTFSMTPNTFINGSRCPECNPQKPYNTDSAKDRINKETNGTFELVSEYKGCYELMKLKHHECGNIVEINMQSIDSNRLNCPYCYNRSRGELLVSSFLLSKNIPFEVQKRFDGFKKYPYDFYIADYNTVIEYHGEQHYKPIKFYGGEDRLVRQKNIDLKKKNFVEGKGINYLEIPYTLNNQNKVNEFLINYFK

SEQ ID NO: 1232 - protein, 486 aa, Unknown
  Description of Unknown: Bacteriophage F125/10
MKKFVQSRLNPVLEKEYFRDIVDWDKDSLGFKKIRNSSLFFRTSSKASTVEGVDIDYLSLDEYDRVNLLAESSALESMSSSPFKIVRRWSTPSVPGMGIHKLYQQSDQWYYGHRCQHCDYLNEMSYNDYNPDNLEESGNMLCVNPEGVDEQAKTVQNGSYQFVCQKCGKPLDRWYNGEWHCKYPERTKGNKGVRGYLITQMNAVWISADELKEKEMNTESKQAFYNYILGYPFEDVKLRVNEEDVYGNKSPIAETQLMKRDRYSHIAIGIDWGNTHWITVHGMLPNGKVDLIRLFSVKKMTRPDLVEADLEKIIWEISKYDPDIIIADNGDSGNNVLKLINHFGKDKVFGCTYKSSPKSTGQLRPEFNENNNRVTVDKLMQNKRYVQALKTKDISVYSTVDDDLKTFLKHWQNVVIMDEEDEKTGEMYQVIKRKGDDHYAQASVYAYIGLTRIKELLKEGNGTSFGSTFVSTDYNQEGNKQFYFDE

SEQ ID NO: 1233 - protein, 273 aa, Unknown
  Description of Unknown: Bacteriophage F125/10
MNRGEIDLTDKLFYGTISNEEINKSVLNLLLGEELSLDYVSKNSDTLDVKYEHVYKSLGFDNFFDCFLYANREPEIVHKGGDKNLGGLNKVKRTVIRNGKEMEMTVYEDGNKENDSKEKQEGKEEVSRSAVGARAISNGEEGKVNPKKVANSLSSLSKKGVDVSHINTNLSLYKEFVDDNGDTLGITSFKRTENDIILESYASSPDSDGVGARAIMELLRLSIKENKNAVVYDIELPEAVEYLKTLGFKPNKDGYILRKKDVKQFLGDYSDFI

SEQ ID NO: 1234 - protein, 60 aa, Unknown; identical to SEQ ID NO: 613
  Description of Unknown: Bacteriophage F125/10

SEQ ID NO: 1235 - protein, 159 aa, Unknown; identical to SEQ ID NO: 614
  Description of Unknown: Bacteriophage F125/10

SEQ ID NO: 1236 - protein, 403 aa, Unknown
  Description of Unknown: Bacteriophage F125/10
LKKKPQGNEVIITIITVMIAVFVVIMTIFFNKYQDAKEDKDRYQRLVEIYKKADDNDGETKKKYVKRLNKAEEELKKVKKETNYKDYNKKSSKERQKEDKETREKIYDVTGDDDLILVKNNIDFSDKVDKPEILISEDGIGTITVPVDSGYEKQTVGSIITSVLGSPFLSPGSNSIDGLSVINDNVYPNTVDSIVEDTKPSINLPMDNPIITNPVEPTIPSDTIPPIDNPSVPVFPENPVDNNQGNTDNPNPPPPGYTDEDGGRGSGGGGNSEPPSTEEPSDNGNTGGGDWEEKPDPGEEPSDNGNTGGNGGEVTPEPDPTPSEPEQPNENSDEGNEEKPSEPSDNPDENGGWETEPTEPESPSEPDDKVDEEDKNEDTTDDKQPTEQPDDNNIDNEDKTEEE

SEQ ID NO: 1237 - protein, 94 aa, Unknown
  Description of Unknown: Bacteriophage F125/10
MIFVHSKFSSKNVFVLYVIYAIIGIGTYIVLTMFQTTSVLIKNDVIDSIENTEHYIGFNDPIIIFTISFIGAILGGIWYKMMKIIKKSNFKDKK

SEQ ID NO: 1238 - protein, 126 aa, Unknown
  Description of Unknown: Bacteriophage F125/10
VNRLIFSKDKKWDEAKDFIKGQGMQDNWIEIVDYYRQIGGKHVAVFIALNKVKYMILEATKDNKVILVDKDNNILLEDYDIVMESKKMFYYIEEPFEVKINIPQHIRDVTYNNTVVLTTVRGSRGD

SEQ ID NO: 1239 - protein, 566 aa, Unknown
  Description of Unknown: Bacteriophage F125/10
LADLFKQFRLGKDYGNNSTIAQVPIDEGLQANIKKIEQDNKEYQDLTKSLYGQQQAYAEPFIEMMDTNPEFRDKRSYMKNEHNLHDVLKKFGNNPILNAIILTRSNQVAMYCQPARYSEKGLGFEVRLRDLDAEPGRKEKEEMKRIEDFIVNTGKDKDVDRDSFQTFCKKIVRDTYIYDQVNFEKVFNKNNKTRLEKFIAVDPSTIFYATDKKGKIIKGGKRFVQVVDKRVVASFTSRELAMGIRNPRTELSSSGYGLSEVEIAMKEFIAYNNTESFNDRFFSHGGTTRGILQIRSDQQQSQHALENFKREWKSSLSGINGSWQIPVVMADDIKFVNMTPTANDMQFEKWLNYLINIISALYGIDPAEIGFPNRGGATGSKGGSTLNEADPGKKQQQSQNKGLQPLLRFIEDLVNRHIISEYGDKYTFQFVGGDTKSATDKLNILKLETQIFKTVNEAREEQGKKPIEGGDIILDASFLQGTAQLQQDKQYNDGKQKERLQMMMSLLEGDNDDSEEGQSADSSNDDKSNPEVGTDSQIKGDSNVYRTETSNKGQGKKGEKSSDFKH

SEQ ID NO: 1240 - protein, 384 aa, Unknown
  Description of Unknown: Bacteriophage F125/10
MSVIYKDNNWIDLTNVPYLQKGDSGYRKDIPRKNWKKCLNTEVSFSYKGKKGLFYVTYRKEDKGKVKVEYDKYVKIIDPHDLKTLNINKIVNPPNKAKYREQEVINGDTVRNIRKVKNTGIVYTMLCSEYEEEYDIRESDLLRGRGSPYKSGRKVCYNNSLYSVENLREYICDLEYAKTVTKFSHKDIKCKCPICSEEKVMKVNKLVNNGFSCHRCSSTITYPERLMIGLLELNNLNYEYQKVFKDLPNRKFDFYLPKLNMVIETHGLQHYRELNGYMNHEKTKESDLEKYNYCKNNNIDYIEIDCSYSDLSFILSNVENSKLNSILKNKNYDNLSNYIIRSKNDDVKYNIYLDYCKGLSKKELKDKYNKTSYYINRSIEIFKH

SEQ ID NO: 1241 - protein, 257 aa, Unknown; identical to SEQ ID NO: 620
  Description of Unknown: Bacteriophage F125/10

SEQ ID NO: 1242 - protein, 318 aa, Unknown
  Description of Unknown: Bacteriophage F125/10
MSKEMQNILEEYDKLNAQEAVSKSVEDDEKNTVESTEEQVAETTEEPAKEPEKVSEEDAKEAQEQGEKVESEEVAEDNEDEEVEKSAKESKDPVDQKDTKTENKDNEKRKNKKDKKEDSDSDDEDKDTDDDKDKKEDKKEKTSKSISDEDITTVFKSILTSFENLNKEKENFATKEDLSEVSKSINELSAKISEIQAEDVSKSVDTDEEAVEKSVTSTNGEQEKVEGYVSKSVDTEEQAETGEAKSEEAEEVQEDNTFKGLSQEERTKFMDSYKAQAKDPRASKHDLQSAYQSYLNINTDPTNASEKDIKTVKDFAQI

SEQ ID NO: 1243 - protein, 463 aa, Unknown
  Description of Unknown: Bacteriophage F125/10
MTIEKNLSDVQQKYADQFQEDVVKSFQTGYGITPDTQIDAGALRREILDDQITMLTWTNEDLIFYRDISRRPAQSTVVKYDQYLRHGNVGHSRFVKEIGVAPVSDPNIRQKTVSMKYVSDTKNMSIASGLVNNIADPSQILTEDAIAVVAKTIEWASFYGDASLTSEVEGEGLEFDGLAKLIDKNNVINAKGNQLTEKHLNEAAVRIGKGFGTATDAYMPIGVHADFVNSILGRQMQLMQDNSGNVNTGYSVNGFYSSRGFIKLHGSTVMENELILDESLQPLPNAPQPAKVTATVETKQKGAFENEEDRAGLSYKVVVNSDDAQSAPSEEVTATVSNVDDGVKLSISVNAMYQQQPQFVSIYRQGKETGMYFLIKRVPVKDAQEDGTIVFVDKNETLPETADVFVGEMSPQVVHLFELLPMMKLPLAQINASITFAVLWYGALALRAPKKWARIKNVRYIAV

SEQ ID NO: 1244 - protein, 98 aa, Unknown; identical to SEQ ID NO: 623
  Description of Unknown: Bacteriophage F125/10

SEQ ID NO: 1245 - protein, 302 aa, Unknown
  Description of Unknown: Bacteriophage F125/10
MVNSMFGGDLDPYEKSLNYEYPYHPSGNPKHIDVSEIDNLTLADYGWSPDAVKAYMFGIIVQNPDTGQPMGDEFYNHILERAVGKAERALDISILPDTQHEMRDYHETEFNSYMFVHAYRKPILQVENLQLQFNGRPIYKYPANWWKVEHLAGHVQLFPTALMQTGQSMSYDAVFNGYPQLAGVYPPSGATFAPQMIRLEYVSGMLPRKKAGRNKPWEMPPELEQLVIKYALKEIYQVWGNLIIGAGIANKTLEVDGITETIGTTQSAMYGGASAQILQINEDIKELLDGLRAYFGYNMIGL

SEQ ID NO: 1246 - protein, 292 aa, Unknown
  Description of Unknown: Bacteriophage F125/10
MEKPYMIGANSNPNVINKSTTYTTTTQADEQDKPKYTTRLEFDTIDMIRFINDRGIKVLWEEAYFCPCLNPDTGHPRVDCPRCHGKGIAYLPPKETIMAIQSQEKGTNQLDIGILDTGTAIGTTQLEKRISYRDRFTVPEVLMPQQMIYFVNKDRIKKGIPLYYDVKEVTYIATQDGTVYEEDYEIKNNRLYLNEKYENHTVTLKILMTLRYVVSDILKESRYQYTKFNQPKSKFENLPQKLLLKREDVIVLQDPYKVNDGIEEDLEIQVDDPKASASNPSNLGGFFGGAFK

SEQ ID NO: 1247 - protein, 206 aa, Unknown; identical to SEQ ID NO: 626
  Description of Unknown: Bacteriophage F125/10

SEQ ID NO: 1248 - protein, 278 aa, Unknown; identical to SEQ ID NO: 627
  Description of Unknown: Bacteriophage F125/10

SEQ ID NO: 1249 - protein, 71 aa, Unknown; identical to SEQ ID NO: 628
  Description of Unknown: Bacteriophage F125/10

SEQ ID NO: 1250 - protein, 587 aa, Unknown
  Description of Unknown: Bacteriophage F125/10
MAVEPFPRRPITRPHASIEVDTSGIGGSAGSSEKVFCLIGQAEGGEPNTVYELRNYAQAKRLFRSGELLDAIELAWGSNPNYTAGKILAMRIEDAKPASAEIGGLKVTSKIYGNVANNIQVGLEKNTLSDSLRLRVIFQDDRFNEVYDNIGNIFTIKYKGEEANATFSVEHDEETQKASRLVLKVGDQEVKSYDLTGGAYDYTNAIITDINQLPDFEAKLSPFGDKNLESSKLDKIENANIKDKAVYVKAVFGDLEKQTAYNGIVSFEQLNAEGEVPSNVEVEAGEESATVTATSPIKTIEPFELTKLTGGTNGEPPATWADKLDKFAHEGGYYIVPLSSKQSVHAEVASFVKERSDAGEPMRAIVGGGFNESKEQLFGRQASLSNPRVSLVANSGTFVMDDGRKNHVPAYMVAVALGGLASGLEIGESITFKPLRVSSLDQIYESIDLDELNENGIISIEFVRNRTNTFFRIVDDVTTFNDKSDPVKAEMAVGEANDFLVSELKVQLEDQFIGTRTINTSASIIKDFIQSYLGRKKRDNEIQDFPAEDVQVIVEGNEARISMTVYPIRSFKKISVSLVYKQQTLQA

SEQ ID NO: 1251 - protein, 134 aa, Unknown; identical to SEQ ID NO: 630
  Description of Unknown: Bacteriophage F125/10

SEQ ID NO: 1252 - protein, 309 aa, Unknown; identical to SEQ ID NO: 631
  Description of Unknown: Bacteriophage F125/10

SEQ ID NO: 1253 - protein, 52 aa, Unknown
  Description of Unknown: Bacteriophage F125/10
MNNRQAKIKGYNQFHYYDFPTTKGKFKDIMKRKSRTELKKDLQKERKYYLDK

SEQ ID NO: 1254 - protein, 46 aa, Unknown; identical to SEQ ID NO: 633
  Description of Unknown: Bacteriophage F125/10

SEQ ID NO: 1255 - protein, 152 aa, Unknown
  Description of Unknown: Bacteriophage F125/10
MSTFWSERRTTNKDRQVKKHYTQMSMYERKKCVELLQETITENRIINFTRHSAKKVKGKPTTNIPKLIGFIFKNKFAYENIIEYNNTDYNGNIERRIVVKHPKVITVEGKPSYQFLTISLEDARVITVWYNSVDDTHRTLDLNYYSKDLTIQ

SEQ ID NO: 1256 - protein, 63 aa, Unknown
  Description of Unknown: Bacteriophage F125/10
MGITIVNSYFILSNIFLIILTILNGKGTVTRESLTMSKILVVITSIQFLACLIINGIYWSLKF

SEQ ID NO: 1257 - protein, 103 aa, Unknown
  Description of Unknown: Bacteriophage F125/10
MSQDKLRAIYTEMKVELHKFPKEVDITSKSTAIAINQILDKFKTLTEQAGKITRKYLEGQEILTIDYEYYDSLQEYYIYLLRNSEKIEQSLQEITKRTGEYVK

SEQ ID NO: 1258 - protein, 152 aa, Unknown; identical to SEQ ID NO: 639
  Description of Unknown: Bacteriophage F125/10

SEQ ID NO: 1259 - protein, 178 aa, Unknown
  Description of Unknown: Bacteriophage F125/10
MESIVKQPLSRNLWAIMKEFNVLPTEQRFKDLDDYQIEFIIGNMNRDVYEHNKQLKQAQKGGKFDSQFEDDDSSWWNESHEDFDPVPDFLDADDLAQQVEAKLSDRDKEERAKRNDAELNDETEGLTTQHLAMMEYIRQKQQELDDEVGNGKTSEEDATISQDSVNKALEDLDDDWYM

SEQ ID NO: 1260 - protein, 1351 aa, Unknown
  Description of Unknown: Bacteriophage F125/10
MAMNDDYRLVLSGDSSDLENSLKAIELYMDSLESKNIDAPLDNFLKKLKVIAKEVKNVQNAMDKQDGKSVISSKDMDESIKSTQSATKNINELKKALDDLQKENISKGIAPDPEVEKAYAKMGKVVDETQEKLEKMSSQKIGSDASIQNRIKEMKTLNQVTEEYNKISKDSSATKDYTKRLRANRNMTRGYMERSEGTGRLTYDQGARVRSELGKISSYESQRKQNQRNLGQAREQYSNYRNQQQDLTKRRASGQINKAQYEQELASIKQEMKAREELISNYEKLGAELDKTVQYYKGSVQKDFQSRDVDQQRGTFGRMVQERLPSIGSHAMMGTTAMATGLYMKGASLSETNRPMVTSLGQNSDNMDIDSVRNAYGDLSIDNKLGYNSTDMLKMATSYEASVGHKSDEDTMAGTKQLAIGGRSLGIRDQEAYQESMGQIMHTGGVNSDNMKEMQDAFLGGIKQSGMVGRQDEQLKALGSIAEQSGEGRTLTKDQMSNLTAMQSTFAESGSKGLQGEQGANAINSIDQGLKNGMNSSYARIAMGWGTQYQGLEGGYDLQKRMDEGISNPENLTDMADMATQMGGSEKEQKYLFNRSMKEIGANLTMEQSDEIFKDAQSGKLSKEELAKKAKKMEKEGKKEGEDNATDYKESKSGKNDQNKSKTDDKAEDTYDMAQPLRDAHSALAGLPAPIYLAIGAIGAFTASLIASASQFGAGHLIGKGAKGLRNKFGRNKGGSSGGNPMAGGMPSGGGSPKGGGSPKGGGTRSTGGKILDSAKGLGGFLVGGAGWKGMFGGESKGKGFKQTSKEAWSGTRKVFNRDNGRKAMDKSKDIAKGTGSGLKDIYNDSIFGKERRQNLGEKAKGFGGKAKGLYGKFADKFGDGGKNGILSQSPKAGGSGIGKLGKLAGGLGKGAGVLGVATSALSLIPALASGDSKAIGGGIGSMGGGMAGASAGASIGALFGGVGAIPGALIGGAIGSFGGGAVGEKVGDMAKKANTKEGWNLGWTNGDKDGKNKFQDSLLGKPISKAWSGITGLFDNDAEASEEDSKDKKKGVKGVKGDTKKKEKMTAEQLREKNNQSETKNLKIYSDLLDRAQKIIESAKGINIDGGTSDSGSDSGGSASDVGGEGAEKMYKFLKGKGLSDNQVGAVMGNLQQESNLDPNAKNASSGAFGIAQWLGARKTGLENFAKSKGKKSSDMDVQLDYLWKEMQSDYESNNLKNAGWSKGGSLEQNTKAFATGFERMGANEAMMGTRVNNAKEFKKKYGGSGGGGGGGALSSTYQEAMSNPVLTTGSNYRGSNDASNASTTNRITVNVNVQGGNNPEETGDIIGGRIREVLDSNMDIFANEHKRSY

SEQ ID NO: 1261 - protein, 808 aa, Unknown
  Description of Unknown: Bacteriophage F125/10
MRRIRRPKVRIEIVTDDNTFTLRFEDTRDYNGDEFGAKLLGFQTKNSMEDDSSVFQINMAGDTYWDKLVMANDIIRIFITPNDDPNDKEGRQERLIQVGMVSQVSKVGSYGNDQTQFRITGQSFVKPFMKFGLGVIQEVQAVLPEVGWLIDGDGDNEVKFTGSSAHEVMTGIIRRFIPYMKYNYTEKTYNTIDNYLDYDDLSSWDEFEKLTEVSAFTNFDGSLKQLMDMVTARPFNELFFKNSEKTPGKAQLVLRKTPFNPTEWRALDMIKVPTEDFIEEDVGKSDVETYSIFTATPAGMLKELNGDVFSKPQFHPELTDRYGYTKFEVENIYLSTKSGSATEDSDSSGDDNGTERGTYSKIMKDLSNYGRDNISKGIDKYTSKLSSKYKNLKKAQAKKIIEKFVKEGKVTEKEYEKITGNKVDDELTSDNRPKLTKDKLKSILKEKFKTQDDFNNSKKKKKAKTDALKELTTKYRFGNKTHATTLLDEYIKYKGEPPNDEAFDKYLKAIEGVSNVATDTGSDASDSPLVMFSRMLFNWYHGNPNFYAGDIIVLGDPKYDLGKRLFIEDKQRGDTWEFYIESVEHKFDYKQGYYTTVGVTRGLKDAILEDGKGSPHRFAGLWNQSSDFMGGLMGEDTSKELKEKGVAEKQSSGGKDGGSDSGGAQDGGSLDSLKKYNGKLPKHDPSFVQPGNRHYKYQCTWYAYNRRGQLGIPVPLWGDAADWIGGAKGAGYGVGRTPKQGACVIWQRGVQGGSPQYGHVAFVEKVLDGGKKIFISEHNYATPNGYGTRTIDMSSAIGKNAQFIYDKK

SEQ ID NO: 1262 - protein, 295 aa, Unknown
  Description of Unknown: Bacteriophage F125/10
MATDKEAKDVIDKFIDNVFNFDVLTKERIKEKDEEIKKITTDDMYEKVVYIRPYVGVIQSLNPQHVQYESFSNNGYDIEAELSFRKVSYLVDKGSIPTDSLSTLTVHLVERNQELLIDYFDEIQDVLYGEYMEEEYVFDEDVPLSTILALDLNDNLKSLSNIKYMFKGAPKENPFGTDKDVYIDTYNLLYWLYLGEDEELAYPMNINYFFTEGRFFTIFGKGHKYKVDVSKFIVGDILFFGRSDTNIGIYVGDGEFISMMGKFPKDETPIGKYKLDDYWNEFNGRVMRFDEEVYI

SEQ ID NO: 1263 - protein, 848 aa, Unknown
  Description of Unknown: Bacteriophage F125/10
MVVRFQSSMGRSLKRVDSDDLNVKGLVLATVSKINYKYQSVEVKVNNLTLGSRIGDDGSLAVPYPKSFIGRTPEGSVFGTKPLITEGSVVLIGFLNDDINSPIILSVYGDNEQNKMINTNPLDGGKFDTESVYKYSSSLYEILPSLNYKYDDGEGTSIRTYNGKSFFSMTSGEEEKPQATDFYTGTEYQDLFTSYYGNKTLIEPRIQKAPNMLFKHQGVFYDDGTPDNHITTLFISERGDIRASVLNTETQKRTTQEMSSDGSYRVIKQDDDLMLDEAQVWIEYGISEDNKFYIKNDKHKFEFTDEGIYIDDKPMLENLDESIAEAMKNLNEIQKELDDINYLLEGVGKDNLEELIESTKESIEASKKATSDVNRLTTQIAEVSGRTEGIITQFQKFRDETFKDFYEDASTVINEVNQNFPTMKTDVKTLKTKVDNLEKTEIPNIKTRLTELENNNNNADKIISDRGEHIGAMIQLEENVTVPMRKYMPIPWSKVTYNNAEFWDSNNPTRLVVPKGITKVRVAGNVLWDSNATGQRMLRILKNGTYSIGLPYTRDVAISTAPQNGTSGVIPVKEGDYFEFEAFQDSEGDRQFRADPYTWFSIEAIELETETMEKDFMLIGHRGATGYTDEHTIKGYQMALDKGADYIELDLQLTKDNKLLCMHDSTIDRTTTGTGKVGDMTLSYIQTNFTSLNGEPIPSLDDVLNHFGTKVKYYIETKRPFDANMDKELLTQLKAKGLIGIGSERFQVIIQSFARESLINIHNQFSNIPLAYLTSTFSESEMDDCLSYGSYAIAPKYTTITKELVDLAHSKGLKVHAWTVNTKEEMQSLIQMGVDGFFTNYLDEYKKI

SEQ ID NO: 1264 - protein, 263 aa, Unknown
  Description of Unknown: Bacteriophage F125/10
MPQSDGISNLHRIALRFPKEGGGYDMYRFKVNPENYTIDSPQRTTAIKTKSDIVIEDYGKDIEVINFTGTTGFRPVREADGLKTGKQKMEELQSRVSEYAMQGGSGNVSGSYLQFFNFTDDSYYKVHLAPQGLKITRSKDEPLLFRYEITLVVIGSLTEADRSAVTTEEFGNVKPNASQRVDEGIKELDKNARKTRDRNNQEISRRENTIPKSTGDNTNEGNRLKQSFPSSSIYNPRQSTNGLKGNIDNMALIIGYGDGGVSS

SEQ ID NO: 1265 - protein, 174 aa, Unknown
  Description of Unknown: Bacteriophage F125/10
MNNFIPQPQGLLRFLNALDTDLTSSHMNLLDEEVSFVSKFYTPQLQLSELAKKVLTNIKTDDIPVLEREFNDNTIIHKANDTLLKVQAPRMYMILQSIVLEAYAIVNCFVENPSSLKYLTEEDVSITRENLNYVADYLGNYDDYNSVVLDLRDLDLCFSAIELQLPLIKKEANV

SEQ ID NO: 1266 - protein, 234 aa, Unknown; identical to SEQ ID NO: 649
  Description of Unknown: Bacteriophage F125/10

SEQ ID NO: 1267 - protein, 348 aa, Unknown
  Description of Unknown: Bacteriophage F125/10
MKTRKLTNILSKLIDKTMAGTSKITDFTPGSASRSLLEAVSLEIEQFYILTKENIDWGIQEGIIEAFDFQKRQSKRAYGDVTIQFYQPLDMRMYIPAGTTFTSTRQEYPQQFETLVDYYAEPDSTEIVVEVYCKETGVAGNVPEGTINTIASGSSLIRSVNNEYSFNTGTKEESQEDFKRRFHSFVESRGRATNKSVRYGALQIPDVEGVYVYEETGHITVFAHDRNGNLSDTLKEDIIDALQDYRPSGIMLDVTGVEKEEVNVSATVTISNKSRIGDTLQKHIESVIRSYLNNLKTSDDLIITDLIQAIMNIDDVLIYDVSFDNLDENIIVPPQGIIRAGEIKVELK

(The sequence listing continues in the following parts.)

What is claimed is:

1. A method of treating or reducing the incidence of a *Pseudomonas aeruginosa* bacterial infection in a subject in need thereof, said method comprising administering to said subject an effective amount of a pharmaceutical composition, said pharmaceutical composition comprising
   a pharmaceutically acceptable carrier and
   a purified bacteriophage having a nucleic acid sequence of SEQ ID NO:4.
2. The method of claim 1, wherein said pharmaceutical composition further comprises
   (i) three additional purified phage selected from the group consisting of F391/08, F394/08, F488/08, F44/10, F387/08, F170/08, F168/08, F770/05, and F1245/05; or
   (ii) three additional purified phage selected from the group consisting of F44/10, F391/08, F387/08, F488/08, and/or F770/05.
3. The method of claim 1, wherein the infection is a nosocomial infection.
4. The method of claim 1, wherein the pharmaceutical composition is administered topically.
5. The method of claim 1, wherein the infection is an infection of the skin.
6. The method of claim 5, wherein the pharmaceutical composition is administered topically.
7. The method of claim 1, wherein the infection is an infection associated with a burn injury or diabetic foot ulcer.
8. The method of claim 7, wherein the pharmaceutical composition is administered topically.
9. The method of claim 1, wherein the infection is an infection of the lungs.
10. The method of claim 9, wherein the pharmaceutical composition is administered by inhalation.
11. The method of claim 10, wherein administration by inhalation uses a pump, a spray, or a nebulizer.
12. The method of claim 10, wherein the pharmaceutical composition for administration by inhalation comprises a dry powder inhaler or an aerosol spray.
13. The method of claim 1, wherein the infection is an infection of the urinary tract or kidneys.
14. The method of claim 13, wherein the pharmaceutical composition is administered by a catheter.
15. The method of claim 1, wherein the subject is a mammal.
16. The method of claim 15, wherein the subject is a human.
17. The method of claim 1, further comprising administering to said subject an antibiotic for treating said bacterial infection.
18. The method of claim 1, wherein said pharmaceutical composition further comprises one of more additional bacteriophage known to have antibacterial or antimicrobial activity against *Pseudomonas aeruginosa*.
19. The method of claim 1, wherein said pharmaceutical composition further comprises one of more additional bacteriophage known to have antibacterial or antimicrobial activity against a bacterium other than *Pseudomonas aeruginosa*.

* * * * *